United States Patent 6,812,339 (POLYMORPHISMS IN KNOWN GENES ASSOCIATED WITH HUMAN DISEASE, METHODS OF DETECTION AND USES THEREOF) - sequence listing, part 53

SEQ ID NO: 15308 - DNA, 16704 bp, Human
agggagatgacttgagtaatcataaaactccagtctcccgcacagctgactctgcgtgaattactctttaactattgcaattcccctgtcttgatgaatcagctctgtctaggcagtgggcaaggtaaactcctcaggtggttccactgatataggtgatttaagtgttaaataaaaatctgttacattaaaatgctgaataaagagtgtttaaagcactccacaaagattattttttaaatgcctctgtgtaagaggaattctaatattgtgccaggatatgtcaagctataagataaaaattgagtgcatttcctagaatgcttattctactctaagattttgtgagaggtataataattcatttaactggtaataaacattaaagaagagtcaaacactgatttttgttttaagggagaagagagatttttttttttcaagacacttgcttgagctagatccccaggagtatttttaacactcctctgtaattagggaaacatcagtatgtctgtattgatacatatacacacatatataatatgtatatatgtaagactatgaacagtcctaaatttatactttgggctgataactgtggttttcaggaaaaaaaaaaatttaaaacgggtgcaaagtctccccaactggtctaagtgagaaatcatttggcattacctctcccttatcccctacctgctaattacaatttttcaaatatagttatcattaagtgcaaactaccataatcttggcttatcttcatggcaaacttcaattagaaatttagaaaatggggagaaagagtaaacaaggttaagagagtgggttctcagatagaattgggtacaaatttgggctccaacacttaggtatatgtggccttgtgtaaccacctaggttacacaacaggtgtaggttaaccatcagctgccttatctcattaggtccttatgaggatttagtgagctatgcacctgaagtcctcagctgtagccagacagcaagtgttcaaagatgttagtcattgtttttgtttattgttttatcattgtgcagggtcacatagctaaggggaatttcaaatccaagtccatcctacttcaaactcctttgtgctcctaagctgtacagtatagtcaccttggagagtaggtgattggccccaaactacttcagggactgcaggtcgtggccagccagtcctgtatcagacctcgtccttgccagatgcctagtgccccagattccctcaaatctcaggccagatcacctcccacctggtaagattcctccaccttcacccgagcaaaactacacttggtttgggttcccgggtaccttcagtctgcagggacaggggctgcagagtgtactccccaagtctgcctctgctgtcggcctcccagctgagtaggcaaaacattcctttacagagcaatgtgttcatggataaacttgtctctagtgcagctctctgtcagagcacagaacatgaggccaaagcactgcccttcctagggagtcccggttctcgacttccccagaatggaagtttgatttttccgttggcccatttctcagatggaaaaacagattcagtaaggtgccaacgctttgctgaggactaccctggaggctaccgttttgtgaaggggtagacattgagactggagtcagatacgcattctggcttatctcctgacttactgagtgaacttgagcaggtccctttcgcccatgggcgtcggtttcttcatctgcaccaaggagacggaaaactggattacgtgtcgctaaggccccgggttctcagaggaaagctcacccctgcagggccgccttgccccgcgcgcttggggccagctgcacgacaagccccagcatgctggggaggcggggctcagtgacggacagggagctctgcgaattggcgcccggcaaggggtgctcaacggcgcgtgcgcagagggaggcaggcgggtgggctgccggcggtggactcgtcggagccgcgggcggtcaggtagggggcgggaaggagggttggggactggggaccgcggccggagtcgtgggccgtggctcagcggccaggcgggggaacgtgccggcgtgcagcggccgcgcccgaatggcagggtgtggggaccggatctggggggggcaggactagggtgggggtggggctgcgaggggcaggctcgggagggattcgtggggctgaggagatccgaggagatgcagctgggggaggggagcgaggggctctgaagagatttgcggttgcagcatctcgggaggtatgaggtaatgtcggggccctgaggaggaacggggtgtagcatgtgggagatgggagggaatcagggccctggagggacctgggtgcagaatttcagaaatatgaaggaactggggggccccgatgagatttgaggaaatctgggggcgctaggcatctggcaaggacagggtctgagatgataggagcaaggtctagggcgatcctaagtgctattgagaaagggttttcggagtgggctgagggtgagattgagggggtggggtgagttcttgagggactctatcttgttagcagaaagaagggagctggctgaggtgtgaaggcagcacatgacattcagtgcataagaggaaggagcagggtatgagggcagcacagtgcccgatggaatgcaggagatgggggctcagattgagggagagcagaaatctggggtgaggaattggggcgttgaactgaggtgcggggctgagtgtggcagagatttggaaatagggattaaacgatctgagtccgagggatttggggcatatgagtgaggaattgacgagggttgcaatatacagccccaaagattggaatttggaattgtaagagggttggggacagggtttggagaggattgaatcgtggggtggagatgtcctaactgggctataaaatcaaaggaccctgagtagatttgtggattggtgtcttgggctgctaaagagattttccttaaatcgctgcatgggagacagagggagttcaggggacccaaggacctaaaagtaatgtatgaaactggatgagtatatgaagatgagcagagttcaggtgctgaggaacaaagtgataaatcttcagttcagataatcctgaaggagtgtggtaatccctgtgaagggcagaatcttcttcatttattaaacaaagatccgttatcatgaggcaggtatggtattgccactaactccattctgaccaccggtcccccggcccactgaaagtggtaggctttggggaagaagaagtggaactattcaaggtcatctgcctaagccctttttccctgtacccccaagctacgatagcagatagaaagtgagacctccaggggaatgagtggaataatttatcctatataagatccattacagcttgaaggggcagtggctctgtgagtgaggtgtttgggctcggagacagacaaaacaacaacaacaaccaccagaaaaaaaaaagggaacccttaggtattgagcatttagtcctgtgctagactgtaaagcagtggttcttaaccaagtctggctttgtctcctaggagacattaggcaatgtctggagatgttttttggttgtcacagggtgggggatactactggcctcaagtgggtagattaaacattaaacataatgttttatgttaaacatttgacaatgtgtgggatacgcccttcccccccgcagtaaggaattatcctgcctaaaatgtcagtaatgccaaagttgaggcactctgacctagagtcagataccctgggttcaagtcctagctctatctcttcctgactttaagtcctagctctatctcttcctgactttgtggccttgaatgagttacttaaccacccagtgccttggctcttcatctgtaaaatggggttatgataacaagaccaatgtcacagaattgttgtgaggatttagtgaagtaaactagcatgcctaggatctggcacatagtaagttctcaaaatctagtaatttttagtcttgtatctacttctttactcagttttcatgacagtccttctaagtaggctctactgtattcagttttacacatgaggaaactaaggcttaggaagtgacttgcctaagtttccatagctaggaatgacacagttaagctcatacccagatctctgtaactccgtatattcccgctttccttgcttcttccttgctagggcctgcttagtcttattttctcagcccattcccctctaatgaaaaagaggattgccagtgagtatcactgactatcagattgaactctaaagttggggggtaaatctctctgattaggtagggaggagccctggactttgttcttggtttgcccttagaccaagacctggggctagataaggagaggagcctgaggttatcaggcaggatgaggtgcaacggactatagggtgaggtatggaggccattggcttgaaaaaacacctcatagcagggactgaggctgaaggcagtcatactctgaaggagagtaactactgttctgtatggtctcttttggtctgcttttccctggaacagaatttggctctatcatttccaggactagctacagggttgctgaagccagttcagaaacaaagctagactgtgtctgacagcaagacttagctggaatatctgtgcacatccctaaaagaaaatatgtcatgggaattaaatcagccctgtctaaactccttactctaatttcctatgttaccttgtcagtagctacggcacttgtcctgtcagcctcaatctattaaaaatgcaaatgattataatttgttgagtgcttattatgtgcattatcttagtgaattcaatcctgctaacagtctaggttttattccttgtttacagataagaaaaataacaggttaaatgacttacccagggctacagagcaagtagctaggttgggatacaaacccagttctgtcttacacctatgttacattatagtagttttattagaagccttttccaacccttcagagcccctatgtttatgtctggagaatagttggaagccagaagtttataaggcccttaaagtagatcattgtctatgcacactgatgtgtaacctttgtgacattccctccatcttgtctttctggtaaaacaatcaaatttaaaaatcatttctaggtgcccttaccaacctctcagccagactttgtctaaagctagggaactatgaaacatcctttaagttagtaattttatggctgggagttgatactgggatttgaatccttgctctattacttattggttttgagaccttggacaggctactttctctgagcattggtttccttatttttgaagaggaatcacacttactttacatggttattatgagactatgagaacatataaaaaaatgcctgacaataaatagtagttgctttaagagtgttagcaattatgagaggaaggcagtgctggaagagaactaagtgttgctttgtcatatttatttatttatacagggtcttgctgtgtcacccaggctggagtgcagtggtgcaatcacagttcactgcagcctcaacctcctaggctcaagtgatcctcccatctcagcctcccaagtagctgggaccacaagtgcatgccaccacacctgattatcttttaaatttattgtagagatggtgtttcactctgttgctcaggctctttgccagattttgataaccctaagtagtctctgctagtctccccaaaattctcatcccattttgtatatttcctaggatctccttgatcctttaatcataatctcatgattaaatgaacagatgttatatgcagagaaaggaattgaaagagagagagggttgaggttagttggaggtccctgagaaggggctattgatttttcctttgtcttatattccttgagtcatactggcagcgtaggtactactcaaatgtttgtgaaagatgcaagggagtctttctaggtcctgcagttttagaggaagacagagacaacaggcaagcatgttttccaggaaaccctattattcatttagcctgcccttgacatagtttagctatgtttaacttagtaatttagctaaagttttctttctctacaaacatacttccttctggatcgttttgtttgccccagactggtacaacttcaggagcatgcctgtgtttccctataagcccctacttgttgagtttatcttagttgtctgcaggtgccttaaatgccctgagtaatctaaacttcatcagaatcctctcccacacacaggagtggatgtcaggtgatgacctcactgaattcgttaaagtcagtcctgctaacgagtggcctttggtggcacagtgatagttttgcacttgattagcattctgttagaatgcatgaggaataaagtttagaaagctgacataaaaggaaatgagataaaccttgcaaaaaacccagtcaaaccaggggagcgtgtcaatagtaggatggacctttatgtcttgtgaaaggaaatgcaatattttacatgttgtctagtttttaggggaaagcactgtttatgtctggtttttgctcaaaattgtatcaccagtaccgttcacagggccagacacatagtaggtgcttagtaaagatttgttttgttaattgcttaaagttctccagttttgctcatggcctaagccaccaaaggctgatataggtaaaggaaatggagatatctagagaaccaccccatggtggcaattcaagcattaggtgaagatttgaaaccttagatcatctctaatctttagattctgggatcaggtaaaacaatttctaggagggcttagaatttttattatttaggtttatgtatctggggccttgggtacagtctgctgaaaagtgcctattcatttcttctaataggttgggtggtggcagcagcagttgctgctactgctaataataataaaaactattatttatgtatagttaattgcatgcctggcttggtactgtacttagtgctttacacacataatctcatttaatctttgcaataactttgtgaggaagatactattttaaagtcccttttcatagataaactgagaactacagaagtattaataacttgctcacgtctccacaataagtagtagagcttgaattcaaatccaggaaagcctgatccctcaggcctgcttccttaatctatataatactgtccactcctagttcgtgtcttttagtcctagttctgttgtgtgatttgtggtcttaatttccctctcctggtcttagttttctcatctattttacaacttgagattactaccttttcttccccttttgcccaggctgaagtacagtagcatcatcacagctcactgcaacctccacttcctggtctcaagtaaggagattgctacgaattctagcatttcatacttagtctctgcttgaaggagctacagcagctcattttctgggcaagacaagttgtaaattcatttacccatcagtttttagcctgtatgtctggcattctcaatcaaaactcttcaaaactgaccagcccttttattaatctttatatgcctttatatgccatgaaaggaaaggttgttcatgctttcaaaatgtagtttgtaaactgaatgcgttattaatactagtactagttattgttaatgctgtttctggttattatttatttagcatccttttattgtacacctaagggtatcaggctaagtactttatatgcattttccatagtcattacagtactctttttataaactaagaaaacaggtttagacaggttaaataaattgcctgcttccccacaacttgtgacagtgctaagatatgatctcagtcctatataactttaaggttcattcttttgttttgtttgctttttctactaccttggttactcatttcatggaatggggaaaacccagtggtgctagaagaggcgagattaatatggaatataattatgtaatttttctgagtcttagggcagccagagtagacacagcttaagggacagattctcatcgggagctgaagagatgtgctagtacagtatggtatgggatgtacagtattaatcattaggtcaagggatgtgggaagatggtaggctgatgttagatgaggtgggaggtcaagaattaatggcacaaagtgcacaacaggaaacagacattcaagggatcatgaagggagccaagatgatacatagcatgttggatactcattctgattggttgtacagttgatagctggcagaaaatgggcagcttacttaaagatttggaatgataagacaattccttttatttgtgtagtcttttggggaaactgaagtcaaattgaccttctatctgagtcattctcagtattacagtaatgaccagatgtgcccttctggaggagacgggctctatctgcctgtctcttagctccatttcaggctaagatccttcacaaagcagtgttttcaagtcatggaagtgggaaaagtggttctggctttttccaggtttgagactatttccgtgcctcatgctttagtgaggggaacacaggttttcctggcaaagcatggcagctttggggcaggaattcttgacatcctcagagagcttggtgaagctgtagtcagctgagataatttggggatgtgggcatagtaaattcatttttttaaacctgatgtcttagacagagaggtaggaagcttttcaattgaaggagggatatgatattccagaaagcttgggaaataatttgctgctatttttacaagttggcagccttgtttaataaactgatctgcactgccagctctgggaagaacacagatgtccctgtgcattgtaaggtaacgttctagattcaaactccaaatgtcctcagtctgttgtcccagacgatagaagagagaactgtagctattgatttagaattgagaagggttgcatggatcctgagttgtaatttctcttttttttttttttttttttgagatggagtctcgctctgtcacccagtctggagtgcagtggcgcgtctcggctcactgcaagctccgcctcccaggttcatgccattgtcctgcctcagcctcccgagtagctgggactacaggcgcctgccaccacgcccagctaatttttttttttttttttgtatttttagtagagacggagtttcaccgtcttagccaggatggtctcgatctcctgacctcatgattcgcccacctcagcctcccaaagtgctgggattacaggcatgagccaccacgcctggccctgagttgtaatttctatcagtatgtctatgctattgcccctagacacttggcatttaagaatttaccattcatagtttcagatatccacatcagacctcatacgctcatgatatatggtaaatattattttgctgaggtatggatttgagtcataatgggttgcaagcttgctgtgtgagagtaggtcactcagctaataaatcaatctatcccactctatagcagcagaatctcataactatattagtgttccttctgtgttatggagaaaatgcgtatgctataaggcagcattccccagagcgtggtcaagggaacattagttaatcattgttatgtgacagtaaaaaatagcttgaaataatgttgggttaaataaagtaaaaatatctgtacttcaaggttccactatgtttgagctgtgtgaccttgagcaagtttttctgagcattcgtttcctcatctgtaaaataggataataaaaatattaccacttcatagtgtcatcatgaagattaaaagagattaagcatataaagtatctgtcatagtaactagcatataataggcactagatgcatagtttcccttgcagtacaaaggaagtgggatatcagggaggaaggattaactttagataattgtgcatgtctgctgctatatatttgtcagattgcattccaaagctaatatggtagaaatttgttgtaatgtatatctctacattaactccccttcttctctatgcctggagaaagagttgatgtcatgtgcaaagtgttcttgagctaaatgcattgtccttaaaatcaaacgaacttgccctccacttcctccttctcctgggtggttgaccatctgcagatcacaagactgcacagatacagctgtaggatttgcgtttatgaaatgctgactttatcatatgcctcaacttgctagacctattcattctgatttggggtatacgttgacagtgacctaaggctacagagcactgagatctctctgggtcaacttcataagtatatgtatatcaagagggttggagtgttcatggtttgtattgggtgacgcagagggtactctaagccagaaataaactgtcttgataaggcactgctattttttaaatcatctaggcttgagtctttggctatctctgctcttcaccactcccccaccataatccactcacctttcaaatcttactgactatacttctggatattgctcaaatgaatctttccatttccaccacctgctccctagttcagactccccattatccccgtcttctctgatgtttccccactccattcctgctttgatcatatcatcttcctgcttcaaaacattcatcacctcaccatgcccttgaaaatgacgctcaaaaatctcattttggctctgaagaccttttataattattcccccaatttacctttccaagtctgttactctattccccatatatactcccacagttttaatctaaggataataaaaaagagaactaaaattcattaaaggcttttttggtgcagagccaaatcttagcattctatacactctatatattatttcattcttacattaactctgtaaagacagtatttttccattttaaaggtggagaaaataaaatgcatagagtttaagtattctctgttttctttctaatacatgaaacttcttgtcctttcctttgccttttatactttgttaaggttgtgccttttgcccacttctttcttccctctccatgtatttatgcatctttccaggccaatataaaatgtcatcttccctttgaaaattctgtatcccttcagattggaatgactcctcaacccccatcaaacttagtttttatttcgtttatagtaccactttctgccttcattattatttacctacatgtcttgtcttttataaagtttgaatatctgaagagcaggatctgtatcctaaagacctcttgtatctagtacagaacaagatacctaaacttagatgggtggataggtgagtaagtaggaggatagatgcgtggaaaatgtgtattttctgatctgatgttttgcagatcacctaaaactaatcatcacaattttctgcttctgtggatgattcctaggcccccaaacatgacacaataaactctgtgacatgattaaaaaaaaaaaaaaaagcctccacacttttgcttacatggttttctttgcttaaagtacctttatcctcattccttcatttctttcaagacatatcttaggagtgaaactgcttttgggaagccttccccaagtctgttaggtagaatccatcattccatccactgtactccagcagaacattatgtggacttgcatgttatacttattccttttactgtgcataattctcctgtgcttttctcttagtgtaaatcagaagttgtaaaattcaccaaatatgaaaataatcattagctcattagcatttattacaagtatactacttccctggtgctatactaagcacatcatatttatcttgttacttagcccttataataaccatataaggcagacaccattattacttctattttacagatgagtgatggggaaagagcttttggaagtttgagttaattccttatggtcatgcagctaagtaagtgtctgagactacagaatctgaattatttcccactatgcagtgttttgtctggtttgtttccctatctgtcaccctcacgtgacatataatagacctcaataaaatagttgttaagtaagggaatgactgaatgactggtcatagctattctctaaatgtttcttgagtgaatttatttatatagtcagaggaaaatgaataatggtttctttttctctttagcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccttcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaactttagaagctccatcttttaatgtttttatttgttatgtccccctccccgcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttcccatttggctttgatgcccttgatccattgtttccttcctactataatgtgcttcatctgtgacactttctcttgaactctgattggattcactgtgcatgcttcagtgggatctgctccacctttcagtgacatttaagacatcatattcccgtaacattatgtctcagtctgatcgtctttaccagtatgaaagtcattcatttagtgctaccaaaggggatacacaagccctttaggaagcagtacctctcgcctggaggatctgtgccatcttggattgagaattgcagatgtgacagaatggattgaccctagttggttggtattgatgacttcagcctggaaattgcttgccttttaaagaagcatatatgggttggaattatgccaaagcataggaagctgggaataagcaaacaaatgctgatatagtcagcaaatttggatagtctctagggctcatcatttttcatactacctctctcttctggcctgtgtctaaggaattgtacaacataggccagggccaacaaagtggagaggtggacacattttcatgttcattactaaaacaaacagcaaaactattggtttgttattctgtgttttcctcaagtcagtacatactatttggtttcaggatttctttccatttctctatcaagcattaaataattgagaactgtttcttcatctctggtgttcatgtcttttaattaaatacggaattttggagatgataagagggataacctgcgctatgccattttgcttccttatctcactgtgttctttcagagtgtagatatctacccaggtcaaaattcagccaaaagcactattatgtaaagataataatccaaatctttctcccaaatacatgtgtacagaatcatcccccaaggtttagagtcaccaataccctattctgagcttctgctgtatgttttatgtttataattacagttcacaaaaaggaagttagtcttgtttttaagatcagaagtgggtgagaggacctgtgatgaggttcctgagggtttggtgtttactaagtaatatatcttactctaggtgcagggctgatggcaagccaaagagcaactgccttactttgatgtaaacaaaatttgctaaactgagctgctcaaaattgtttttatggtagtagtgtttctttggattgtatcataatagctgccaaaggataggtaaagaggtcattaaaatgatgttgaactagtttgtcttgttcttttcatctggagaaagccccatattctgattatgaaattgcatccgattttcaaagattgggtaattgagaggaaattgatccaattgaaagtgcatcacaaatgactccactagttattagagccactttatctgtgggggcacccagcagcaggagatctgtctttgctgtcagtgggggacttgctgaggcaataacagtggctcaggcctttggcacacagtttgcagtggagagagaaatataatattgtgggcaggctgaaggtaaatgaggccaggaatcctccagctgtctgtgcttttgaaagaggtgccatcactgagtgacattcagcatttagatctctacccatctaaaccagtcatgccttttccctcaagtaaagcagttatctgttggctcaaaatggaagtgtgatctgagtctttttcctttttcccctttgatgtgaatattttaggctgtgcttagtacagtcgatgtttaattatctgctgtgttgactaaattgcagactagggccccaagaaactaatttgttcaattacagcagttttttgggttttttttttttttttgctttgttttttaaagcagcagtacccttgtccaaataaagtcttatatggaagtctatcatgtaaaatagatcaaagagcagctgctctggttgaagcaggtttgtgccgctgaagaatatgctgtttcctccctttaccttacctcctgtgctaccat

SEQ ID NO: 15309 - DNA, 15346 bp, Human
ctatctaggacttagcatacataatattcctgttttaaatcaggttcttatttaacagaaacttacattgcacttgctactttccagacactgtcctaaaagctttacaaatgccagttcatttaatcccaatacaatactttgagatacatattatcatcttcattctatccacattttcaatcctcatcatagctctcatttatggaatgtaatgatgatgctctagactagacgttttacgtaagttagcttaattcagtaattcaaaacacatgcgattatcttcgttttaaagaccagaaaactaaaggttggtaggtttgtataatttgactaccattgcgtatctttattttaatacattttataaatgcaagcttctgctatgattaaaagtgattaccacattttacagaccagaaagtaataataagtgttggtgaagatgtgaaaaaatgagaactcctgtacaccatttgtgggaatgtaaaatggtacagatgctgtggagaatcatatggtgggtgctcaaaaaattaaaaatagatttaccacatgatccagcaatctcacttctgagtacgtatccaaaagaattgaaaacagagactttaagagatatttgtacaaccatgtttatggcagcattattcacaatagctaacgtgtggcaacaatgcaagtgtccatgaacagacaaatggataagcaaaatgtggtctatacatacaatggaatattgttcagctttaaaaaggaaggaggctttgatctatactacacagaaaagaaccttgaggacattatgcaaagtgaaataagccagtgacaaaaagatacatactgtatgattccacttctaagagctgcctagagtagtcaagattatagagacaaaagtagtgcatagattcaagggcctagggaaaggggaaatggggagttatttattaatgaatagtggtgatgattgtacaaaaatatgaacataattaatgccactaaattgtacacatacaaatggtcaagataataaattttatgttatgtcatgttatgttatgtgattttaccataatacagaaaatgaaaaaagaaaagaaagaaagtaaagcttagcggtttacatgacttgaccaatgcctcaaagccatgagtcacccagctgagatctgaacttcagtatattccattctgaaatcccagacttttcccaatcttcttgtacttttcaaactgtgtttcagttgaggtttattttcagttttgtatgtgagtttcttcacaagaaggggcgggccaaattgtgtcctgcaaaaacctacatatcgaagtcctaacccctctacctcagactatgactgtatatggagagagagccttgaaagaggtatgtaaggtagaatgaggtcattatggtgggccctaatccaacataactggtgtccttataagaaggggagattagaattcagacacacttgctgacaccttgagttcagactggaagcctctagaattgtgagaaaatgaatgtctgttgtttaagccacccagtctgtggtatttccttatggcagccccagcaaactaatacaaatagtgtttccacagctgaaacaaaattggaaaatcaccgtcatcctagagagttacaagggctattttaatagaacctgattgttttcctaaattcaccaagcccaggcagaggtcagatgactaattgggataaaagccaactagcttcctcttgctgtttctttagccactggtctgcaggcgttttcttcttctaacttcctctcctgtgacaaaagagataactattagagaaacaaaagtccagaatgctaaggttgccgctttcacttcctctcaccctttagcccagaactgctttgaatacaccaattgctgtggggcggctcgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggaggtatgtggctggagtcagctcctctgaactttccctcacttctgcccagaacttctcactgtgtgccctggtttgtttatttttgcaaaaaaaaaaagagttaaattaccttaaagactcaagaagccacagagatcaaataattcattgttacagggcactagaggcagccattgggggtttgttccatttggaaattttgagtgctaacaggggcatgagataacatagatctgcttaaggtccctgctctgctaccttgtggctctgtgaagaaattatcaaacctgtctgagactagttttcgcatctgtaagagaattataataccttcttcactagagagtaagcagactgcttcagtgtcatttcttcccactggtggtctttacactcagcttcaagcagtcaccctgctcctttcaatctcaggaaaaagatggcttttgtgtgtgtgtctctagagaaagaactttctaagtgggtgtcagacttctgtatgcagtaatatagtttagtccagaggatgaaaaaaataagagaatgaaaaaggaaaagagagagagagagaagaaaaaagcaagagggaaatatgtataatgtcagctaatgcaacagtttctttcttagtgaaataccaatcagctggttggtaatcttattcatgatggatctcttttgtttttcccctgcgcagacttcacagttgctttagaaacccatagtagagccgaacagctaagaaaatgatttacagtgaggcagggtcagaaactcaagagagaaaaagccagctgcagtcctgaagttgaggatataggagaaaatcaagtaatatttagcaaagactaattcattatcttgaagccatcccttccctcaattccctgcccatagtcctcctccttgtcctcttctctgtatccctctgctgttaggttaatggagatagattttctaattaggctcactgcgagataaaaccacagccaaacttgacttcttttccccatgtaccttttcctgtcagtccctgaagcctgtccatccctgcccatccccttagttccactgtaaggcaggccctcatttcccctggcattgactcttacacactaactgctttcctgattccagtcttcttcctttaactcattctgcacgttcttgtttgttatgtacttgcatttgttgttattatttttccttaggcttcaatctaacaaattactctccttaaaaacttttaataactctccattgccattagaacagctttctaccacagggcctttgcactggctatttcttctacctagaatgctagatcagtgctatccattggcaatattatgtgagccacatatgtacttttaaagtttttagtagcctcattaaaaaaagaaacaagtgaatttaatttcgataatagttttatttaacttagcgtatttaaaataatgtttaaaattttaatatatatttacctattattgatatttttacattccttgtttggtactaagtctggaatttagtatatattttacatttaccacacttctcaatttacactattcacatttcttgtgtttgataactgtgtatggctagtgactaccgtattggtcagtgcagcccaagtccttttcatgctttaatcactccattcagatctctgattaaatgtcccctcctcagggcagtcttccttgattgccccatgtagagctctccagcctcacttatttgcctcaaatccccttatactgcttaatatttttttttctagagcacaacattttatatttttgtttgtttattttctctctctccctttgtaatggaatcggtaaggaggcaggatcattgctggttttatttaccactatatttccagtggccagcacacagtagccgctagatgtgtaagtgataaatgattgaaataattgctgcaggacaaagtctgaggccctcctgatctggcttgccctcttacttagatttcaccactcccaccactcaccagctaatctgagtttgttttccactctttacgtgctcacgttgtcctctccttaggacatgtttttcttcccctttccacatatctaaaccttactcatcttccaagacccactttaaaatcttccttttctgggaagcctttcctgaatccagacttgatctctgctttctctgaaccacagggcatattttctaagcctattttatggccccttgagatagtgttagctttgctcctatctaaactcttactctagactgtgagtccattgaagtctggagctgcatcatatttttctttgtaatgcccacagcacttggcaggaaatgcctacaatttggacttaagtaaaccttcatttaatcagttattcaatcagttagtgattcagcaaatatttattgagcaccaaccatttgccagacaccattctgagtgctggagacaaagcagtgggcaaacccatcaaacttgcaatggaatacaggagatgaacaatacgatgagaacaatcagatagacaacataatgttagatggttgtgcttcctgtgaaagggaataaaagagggcaaagaaagagtgcctggcactgtttctattagacaatattgtctttgaggctccatggcttgcaacatttaagcagacatacgaatgaagatctgcatgtttgaactctgactttgcgcatattacttcatttctttgaatttccattttcctcatctttaaatgcttatttgaagattaagtgaaagtatataacaaacaagaactatgcaggcgtatggtaagggattaatgatagatgataataattaatgttgacatctattgatcacttatactgtagcgggcttttaaataaactctttaaacaccttatctcatttaatccttcaaacattctattggtttcaaacaacagaaaactacaattagctggcttctgcaaggaattttgttggaggaaatgagagcattcagaaattagatgggagcgttagagaattaggcttacaaagaatgtgggaaagtaggctagaaagcagtgtaaaaacaaagacagcataaagcacttgaccttatttactaggttccaccatgggaatccatgcactctaaagatttccccctatttctacatcactttgctcaagggtcaatgagccaaggaaaagaatgcagttgtcaaaatctgggccatgactaaggaaggtctggacatcttgactgccagacagtctccccaatgatatggagtatttagaatgatactggatattttatttattttttgtattttcaacttttaagttcagaggcacatgtgcagagcatgcaggtttattacataagtaaatgtgtgccatggtgatttgctgcatagatcatgaaaatatggaacgcatcatggatttgtgtgtcatccttgtgcaggggccatgctcatcttctctgtatccttccaattttagtatatgtgctactgcagcaagcacgatattggatattttattacctacattttacatatgataaaatgaggctcactgaggtttttcttttgttcgttttattttgttttgtttttaaagacttggccctaaaccacacagaagagctggcatgaaacccagagctttcagactccggagcctcagcccttcaccccgattccattgcttcttgctaaatgctgccgttttatcacggaggttagaatgctgagcacgtagtaggtgctctttactttctaatctagagtaagacaatttataagcatgaattgagtgaatggatggatggatatatggatggaaggatggacagatggatgaaaggttgactgaattttgtgcttgcacaaaaagaggcccctctccaccatctctggtctaggagaggggagttgggagaccatgcagtaaagatacttcatgtcatgtgtaatcattgcaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtaatgaatccacttttacatactgcacaaggtgaggtgttcattgtcctatcatttcattattggactggaaagcttggtttgtggagtctcatcttcattcacttattcattcatacaacagatgtcttattaactatataaccttgagcaagctacctctattctccaggtctcagttttctaatctgtgaagtaggcagttggctgagacagcttctaagggcaattctaattttaggttttcttttaagacaggagagaaaattagcttaaattctttcataagcagctatttattgactacttgctatatgttgtacactctgcaagaagacaggcatatattgatatataacacacagcccctgttgttaaggaggcatatcttcttgaaagagttaataccttaaagtcctgggtatggtcctgggtacatagtatatagtcaacacattttaattatgattttttggatctggaaactgatataaagatagcgacatataacagtaggtgataaattatgtttaaactaaaggtaactaattgtatttttcagaagaggggccttctctgtggtgggtagtcaagaaagatttcatgaactgcataagattcaaacaatgtctagaatattaaaactagtgtacaggatagggaattaggaaaagacaagtaacccaaggagaaagatgtcaagattaaaggaaaacatctgctgtgggcagggaataatggctaagattttcttttctgatgcagggaagtatatcgtttgttgtggcaggtgaaatgtcatcttgatattttaggggaaccaaattctaaaagggttttcatcatcggggccttatttgcaaatcgaactagataatggatcatgttctctgcaatggtttgtaaaacatttcaaaacattttacatattttttattatagaaattattgataaagactaaggtcacagtataaaaatcctttttagagcagacatttctgtagaagagtgaacatatgacctattatactctaatttggatatagataggatgtaacaaaggagtaatggaacaattcaaaggcagtggtatagtgcatagagtcctgttggggtcagaagacctgagccaagtttacccccaacatttataaccatgtaaccttaggcatattacttcatctcccttaatcttagttttcatatctgatcaatggaaatgatgaaacttattctgctggattaaatgtgataataaatattaatatgctgtatatatttaaatttttataaaatatattttataagcataaagtattcttacagaatttcattaggtttttaaaataatttcaacttttatttttgattcagggatttacatggttatattgcgtaatgctgaggtgtagggtacaatcgataccatcactcaggtagtgagcatagtacccaatagttagtttttcaacccttgctgctttctctctatcccctctctagtaatccccagggtctatttttgtcatctttatgtccatgtgtactccatgtttggatcctacttataaagtgagaactcatggtatttggctttctgttcctttgttaatttgcttaggataatggctactagctgcatctatgccattatgttctaaatttcagtttcctgcatgaaaattttgtcaagtactctattaaggtagaccacctctccctttttttttttttcaaacaagaagtagtttttcaccaaacaatgtctcttatgtaattcatcttcaatccactggatacccaataaacttgccccagaaaccttaaatctgtgcttacagagaggccagcttcccttcttgttaacccataggagattctgaattagggcaagcacaaaagatagcacaatagacatcctttgccttttcgtacagtgttcacatacagtaactcaactagtcttgtaagaatgctttgtgatagaccaggcagccttctttcccctatagaaatatatatatatttctttttataggtgaggaaactgaagcttgaataatttaaatgacttatatacattatcattgcttgttagccacagaccagagatttaagttcacatctccagaatccaacttaaatgttttctttgtcttaatactctacttctctaaagtgattatcaccaatgtaatgatatagagacacagcaagaccctttccttctcacctaatgtatagagcaatgcagagatagaatgatgggctataacaatcatataattgaaagaaagaacttcaaaaataatcaagttcagctgtttgatttataaatgtgataactaaaacctagagaggaaaagaggtactcaagatcacacagtaggagaggactgcagaaacaccaaacccaagctcttttgtccactcttccagcgttctttctactatactgcctatcctttatctagttaccaataaataacaaaagcttggaccacaatgcttttattgtctaggaaactcctgaagaagctaaataaaatgggtggggaatattgtaaatgtaattcaggctggattaagaaagaacttatttgtacattgtaactgacaagcacctgcaatgctgaaaggaatttttcattggcttgctgtttgctggctgcatcaaagccctgtctctaggacatgtctctgaacattgtgtgtagcatggctttcatttcttttaggataaaattcaaaaccctttatctggttggtaaacctctgcctaattgggaaccttctttctccacaactccatattgtacactccaatttcatctctgttctccaaccatggaagctatttgtcatgattcctccttgtgtcattttttttctgtcaaccttggggcttttgtgtttgctgttcacttcacctccttttattgttaacttctactcatctttcaattttcaacttaagtgttctcagagaaacctactttgattttcttggtccacaacggttctctggatgtgaactcttatagcacataattttcacttttttccacaaaactcgctcctatcacctgttacaagcatttacctctgataacaagaactttcaaatatctagctgtcatgtaagcacttttcataaacattaagagtatctgtgacacttatgtgtaatgtttcgtatctctgaaattgatatttaccagtcatttatcttggctaccaactaacaactatccatattatctgtaccaatcagatgtataatcacaattttgtgtgacagaaaatggctaaacttgatccaaggctattacatgctttatcaactgcacaatctttatatatgtcaattattgatctttaactgatttccttcttatggattttctcctctgcttatcatgtatgcctaacatgacaaaaaagagcctatcattgcagccagtatgataatactcagtctgtggggcttcttatttgcttattccatcatcatctgtcctgcttgatgtctttgcctatgcacaatcatatgacccatcacatctgtatgaagagctggatgactaggattaatattctattttaggttcttattcagcagaaatattagataatcaatgtctttttattcctgtaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatcaattatgtctgaatgaagctataaaaaagaaaagacaacaaaattcagttgtcaaaactggaaatatgaccacagtcagaagtgtttgttactgagtgtttcagagtgtgtttggtttgagcaggtctagggtgattgaacatccctgggtgtgtttccatgtctcatgtactagtgaaagtagatgtgtgcatttgtgcacatatccctatgtatccctatcagggctgtgtgtatttgaaagtgtgtgtgtccgcatgatcatatctgtatagaagagagtgtgattatatttcttgaagaatacatccatttgaaatggatgtctatggctgtttgagatgagttctctactcttgtgcttgtacagtagtctccccttatcccttatgcttggtggatacgttcttagaccccaagtggatctctgagaccgcagatggtaccaaacctcatatatgcaatattttttcctatacataaatacctaagataaagttcatcttctgaattaggcacagtaagagattaacaataactaacaataaaattgaatagttataataatatattgtaataaaagttatgtgaatgtgatctctttctttctctctctcaaaatatcttactgtactgtactcacctattttcagaccataactgaccatgaaacctgggaaagtgaaactgtggataagtgaggaactaacatacatacatgattgtttatctacagatgtatgcctcagtttcttagtatgcttgaaaatgtatgattttgtgtatatccgtgctacatgtaagtgtggttctattcatatttgaatatgaattctgcataagtgtgtttattcaagcaaatgtacaaggctctgagaaggaagatcaacatacaacttggaatat

SEQ ID NO: 15310 - DNA, 10186 bp, Human
ctgtaatcccagcacttttggaggccgaggtgggcggatcacaaggttaggagttcaagacaagcctggccaacatagtgaaaccctatctctactaaaaatatgaaaattagctggacatggcggtgcttgcctgtagtcccagctactcaggaggctgaggcaggagaatcgcttgaacccgggaggtggaggttacggtgagcggcgatcgcaccactgcactccagcttaggcaacagagtaagacttcgtctcaaaaataaataaataaataaaataaaactgttattgaagtgtttaggggtaaagtttaccaatgtctgcaacttactttgaaatgcctcaaaagatgtattggtgggtggctacagggatgagtagatccacgataaagcaacagcaaaatattaattgtagcatcattctcaattccccctcagcttggtgatgcatacacgtacagttttttcaactgttctgtaagcttcattaaaaaatgaagggacatttttaattttttattttttttagactgagtctcactctgttgcccgggctgagtgcagtggcacaatcacggctcactgcagcctagacctcctgtactcaagcaatcctctcacatctccctccagagtagctgggactacaggcacacaccaccacacctggataattttcttttttcacttttcatagagatgagggtgtctcattctgttgcccagactggtctcaaacttctggcctcaagctatccacttgccttggcctcccaaagtgctaagattacaggcctgagccactgcacctggctagaattttttttaattgaaaaagaaggccaggcacggtggctcatgcctgtaatcccagcactctgggaggctaaggcaggtggatcacttgaggtcaggagttcaagaccagcctggccaacatagtgaaacttcatctctactaaaaatacaaaaattagctgggtgtggtggtgtgcacctgtaatcccagctactcaggaggccaaggcagaagaatcacttgaacctgggaagtggaggttgcagggagctgagatcgtactactgcactccagcttgggcaaccggagagaaaagaaagaaaggagagaaagagagagagaaagagagaggaaggaaggaaggaaggaagggcgggcccatgggaccttctgggacttctgttacaaattgtaatggacttgatgaaagtaaggtggggtaaatgagaacaacataaaggacacagaacgcagtccctaggacacttagtaagtatcaggttttatcattatcatttggaatggaggaaatgggtacagactgggggacatgagttgttttgtttgtttgtttgtttgtttgtttgagacagagtctcactctgtggtccaggctagagtgcagtggtaggatcttggcccactgcaacctccatctcccaggtccaagcaatcctcccacctcagcctcccgagtagctgggattacaggtgcccgacaccactcccagctaatttttctatttttagtagagacggggtttcaccatgttcgccaggctaatctcgaactcctgacctcaagtaatccgcccgccttggcctcccaaagaggagtcttaaatgagtttcactgagggatttcagcagattttcattacagtgtccaccctgaaagtgtaggggccagagttccacgctggttaatctctcttgctgtgtgaacttatacctgtaatttccacctctgcacctcacattgcttgttttgaaactatgagaattgaactctaaggtcccctgaagtttagaagtcctgctggatgaagcccctttcctgttcctgcctacattcttctttccctggacgccttacttacgtaaaaactacatttcccatgagcacccacaggcgtgcacgcagcgcagccctccgtcgtcgctcgcgccctttatactcacttccgcccgcgagccacttcctttcctttcagcggagcgcggcggcaagatggcagtgcaaatatccaagaagaggaaggtgagcctctggggactgggttcggagaacgacggcgccgcgcgggtcgagggcttctcggggtgccaccgcgaggcctgcagctccgtggcctgccctggaagcggcctaggcttcctggcgttcctgcgggccgcggatggcggtggattgagtgagaggccccagccaggagggcgctgtgtggccgggttccaagtgaagcgcagagagatgggcaccaggcgccccttctgtcccggagaaggcgtttgtgagcatttgtcggtcaacggaattagtaaacgtggtattttgagggcgtgtgtcatttccctcatgtcttatcccgtggttttgggaagagaaggcagcagtgtattcttgccttaactggtcgtttctgggtacagtccgctggccccaggacctcaacttgaagggttgctgacggttgcttgctccgtctggggaccccgggaggaagctgcctcggatttaacgccttgtcattacatgggatagaactgtgtaaaaatcattagctttaaaaatagacagtttgtcatttcgtatatacacttcgatgtcaaaattaaatccacaacttctcgagagttaggatttgccagctctgttggtaccgtaaagccaaataacatggctgggattctttagacggtgcaggttgtgtctacaagtgagagagcttatatgttaagtctactatctattccttaacagtgacaagtacagtgtctttgctgtgctgaatgaagtgtaaataggccattagagcagtttcttgttttgcatgtggaactgttttaaacccttcgatgaagagatgatgacgagtctgacttggggatgttctctttgcccaggtggcctactctgtgctgcgttctgtggcacagtttaaagagccctggttgaagtaatttcctaaagatgacttagaggcatttgtctgagaagggttgctgcactcctgttggaacaagggtttggaaccattggttggaggtatttagttttggtgagggatgcattgactaataagactagactggctcaggcgaaagtgagcctacaccgatctcctaattttgaactttgctttgtttggattagtttgtcgctgatggcatcttcaaagctgaactgaatgagtttcttactcgggagctggctgaagatggctactctggagttgaggtgcgagttacaccaaccaggacagaaatcattatcttagccaccaggtaaaactcatttgactggccatcacctataattgttataaatgctaagttggtttatttatttatttatttttttgagacggagtcttgctctgtccccaaagctggagtgcagtggcgcgatctcggctcactgcaagctccgcctcccgggttcacgccattctcctgcgtcagcctcccgagtagctgggactataggcgcccgccaccataccttgctaattttttgtgtttttagtagagttggggtttcaccgtgttagccaggacggtctggatctcctgacctcgtgatccgcctgcctcagcctcccaaagtgctgggattacaggcgtgagccaccgcgcccggcaggtttatcctttatgaacttaaggggacagacggaacagtgaatctgggcttagtgaatgtaattgcttcttaaaagctagattttaaggccaggcgtaggatcacttaagctcaggaattcaagatcagccggggcaacatggggaaacccccgctctacaaaaaataaaaaagggtgtggtggtgcatgcatgtggtcccacctattccagaggctgaagcaggcgatggcttgagctcaagaggttcaggctgcagtgagccattggtgtgatccagcctgggtgacagagtgagaccctgtctcaaaaaaaaaagctgcgttttaaaaattttagtttttgtcaatgaaaattatatgctttgtggcagagattttgctaccacacatatatgcaagatttaaagttacatctagcatttgtgagaatcttgaattgtcacttttcccccccagaacacagaatgttcttggtgagaagggccggcggattcgggaactgactgctgtagttcagaagaggtttggctttccagagggcagtgtagaggtgagtgattctggcatatgccagaggtaatggctcttcagaatgatacttctaaaaactctcaacttggagactttaattgtttgttcattacaaatggactggtataactgttgaaattctcttaatgaataatgggcttaactttgtaagcctattctgctaatggctgatggttaaaggattttacattcaacttgggtatagaaatgatgcatatgatggattaactgtccccattggtgtacttggcatggccaaaggagccagggtgggagggcaaggaacctgcattgtgtgtaggtggtagaagtgctttaggaattgagggatactgaaattatatgctgtatatgatggtggtgtccgatcttttggcctccgtaggctacgttggaagaagaaatgtcttgggccacactactactggtagcgcaaaaaatcacgatgttgaatttgtgttgggccacaatcaaagccatctcctgggcagcatgcggcccgtgggttgggcaagcttggtgtagaaagtgatacttgtgtggcaaatgccaaattttcaactttcagttgaaaataatggtgatggtaacaggatatcccttgcttcctttaaagctttatgctgaaaaggtggccactagaggtctgtgtgccattgcccaggcagagtctctgcgttacaaactcctaggagggcttgctgtgcggaggtaagtgtcctgagacctaatggtcatgaccttttgtgtgtatcaacatacatgtctgccatttgttaatttagcagatgaactgttacaaagttacaggatctgctagtctcccagggttataataagatactaagtcatgccctcactgaactggcaggctaacaagactactaaagcagcaagaactgtaaagggtggtcagtcctgtaatggagaagtgttctgggtgctttgggagttaaacacaaatagaactgtccaaggaggggaccaactcctgttggtcttcttgagaaggctttacaaagagccctgttgcggggggcggggcagtgggcaatgaggaataattaggcctgttactgggtgtgttacgtatccctaggtagaagtgccttagtactagttaggataccatgaaactttagtagcaatcattcaaatctgcttagtgtgttcactcttaagatggtattgtgaagagataagatagacctgatgcaaaatagcttaaaatctagacacttaacctctgagttgcatgcagatagtagtaatgtgagggtctactggtaagatttcaacaggaagttctttgtgcagtttgactgtatgtaaaggcactgaaatgccttgcctagaggaatgacaggaaagctgtgctgtaggaaggttgactggtagggatgggtagtgtaggcaaggctctaggtaaggacatagaaaagacggcttacctggtttgagtgccagctaggctgcttagaacaatggttctcaagattaatgccagccccagacccaccaaatgggaaactggatgtgtgactcagcaatctgtcttaataacccctccacatgctgtttgcacacattgaagcaagttaatgaacctctcagcctgggatctgttatcttctaaggtggaccattataccacctctcagttgtggaatattaagtaagataatgtgaaagggcctggaggtggctagctctccagttagtatctcgcagagcgtaaactgccgaatgagttggggggtaggtcatattttaaagtgttttatcagcgttctaatagcaagatagccaggatcctaggtgggtaagctttcctagtgaatgagacttcggaggttgcagagtatttcaagggaccacaaagtgggtaattgtggagtgtaaatgtggttctcagttttggttatacatgagaatcacccagggagcatttttaaatagatattcctggactttgcacatttaattggcctagagtagggcctagatgtcagggtttcttttgttttttattttagccttctgaggtgattccagtatgcagccagggttggaaagtacatatttaggagcttgacatacttgatgaatattaccctaaggttcggaatgataggtgtggaagagaattggtattcttggggccggactctggtcaaattattctccattaaaggaacattgaaaaccaagtctttgttttgttttttaaacttggtggaggtccttggcaataacacagtggctctcttctgttcttttaaagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgagcagctgagagtgcttggcaaagggcatttgtggacagatttggttttccacagacatcttaagtatttgggggagtttatcatggaagtagctgggcatgttcatattccttggtgtatcgattgccacgttgatctgtaagaatcgatttgctgagatctgtcagatccaagagttggtttgtccttgttttagccatctgtgtacccttcagtgatgacacgatgacgagtcagaaaggtcacgtcctgctcttggtccttgtcagtgccatgttctgtggtgctgtgcacgagttcctttggcagaagtgtcctatttattgatcgatttagaggcatttgtctgagaagggtccagacccaggggtgcttgagtaaactgcttgctctctttggtcttgtgtgatgggggcctttgagaccccagctgtgtgctaacaactgtggtgtcctctaggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacaggtatgtctgcaagggcaggggcctcttggggcataatagggtccttccgagtctttctgttaatacttgtatcccacattctggtaagcgtttggtgaataaaaatttcatttatttgctttatgtgggagaatacaagttgaaacctggggtctatttaacccttggttccaatgggacaggtgttgcctttattctttccagaaagaagttcctgcttttactcgtgtatatgaaatagttttcccttatcctcccttatttgctcaaaatttttggctcagtgcaacctctgcctcccatgttcaagcaattctcctgtctcagcctcccgagtagctgggattataggcacctgccaccaagcccagctaatttttgtgtttttagtagagacggggtttcaccttgttggccaggctggtctcagactcctgacctcaggtgagccactgtgcttggctgctcaagattttctaggcacttttgctattctgtcctttagcagcccctgtaaaacactaacaagcctcctgtggtcaacacttggggtttttttgtttataggtgttgtgtctccaggtgccttgtatttttttttttttatatgaaaaaggacaaacccttatgtatgcattttattaatgttgctgcaaaccctaagtgggagtgtgtatccatttggtaaatcaggaacttaataactctggtaaagtttcttacttttgtgctttatttggtttcagggtctccttggcagctgtattctggagtctggatgttgctctctaaagacctttaataaaattttgtacaaagacacaaggtctgactagactgttcagtattcagactgaggggcatgttggcctctggagcattacatatcttcttggttttaaccatacttgtggtatttgcaagggccagaacagtaagacccaagcagagccaaccagagaaataatatttgtgtgatagagaaggctgatagcaagcaaggcagcaccttgattcgttgtcctgtagttcaggattgtaggtttagaagagggatatgtttgagtttttcctatgcataaggcgatccacgttgcacatagaaagtgaatataaatggccattatattttgtgtcatgctgtgctctaagtgttctttacatatgtactcgttaatcaacctctctaaagtgtaaaggaaatttgcttgcaccactgaaggcacataaggctcagaagtaaatttgcctaagcagtataaagctatcattagaatccacattcctaagttgtgttctcttaggggatcatggaaccagtcattggtactacaggctattatgttctggagaactgtgaagaacatttaaattgtctctgattttatctatcaatgttttgaagtattttctaccagtgtctgtacttcacaagaaattcggcactattttttcaggcaaaactagtgagggacaggttggcttgaaaatcatgagactgttgttaaatcagatgctggttgatcacagaggggacttccagggaaagctgttatcaggtggctgcttcctggtgatgcagcctggctgatgagataaccctggctccacagatggcttagcaggtgctgtgatgatttggttttcttctcaattagactgagctgcacatggtgtttatattgcttggcacatggtaagggcttaatatttgaggtaattatgtagggcgtacactgacaagtatctgacccccccttcctttttgactcataaattggtcatcttaaccatttaagtgtacacttctatagtgacagagttagccctctgtccaagggatttgcatctgtggattcaaccaactttgggtcaaaaataatcaaaaaggatggttgtgtgtgtattgaacatgtagacttatttttcttattttcaaaatactatattttcttgtcacttattttcttgtacactgcagttgtaacagctatgtagcatgtacattaggtattaaaagtaatccagtgaagattgaaagtctaaggatgtgcctaggttatcttaggtataaatactctaccattttgtataaggagtttaagcatctggggattttggtatttgaagggggtcatggaaccaatcattggtactgcaggaagactgctctatattctcattgtgcatcaatctccagaacttcatcttgcagatgtgctgcccctccctcacctttttgaaagagcctttgatgattatatggattcctgtcttttttattttttgaggtggagttttgctcttgtgtgccaggctggaatgcagtggtgctatatcggcttactgcaacctccgcctcctgggttcaagccattctccagcctcagcctcccgctagctgggattacaggcacccgccaccatgcccagctaatttttgtatttttagtagagaccgggtttccccatgttggccaggctggtctcaaactcttgacttcaagtgatccccccacctcggccttccagagtgctggaattacaggcgtgagccaccgcacccagccagttgaacttacttgaacatccgcaaattattttttattatttttattttttgagacggagtctcgctctgtcacccaggctggagtgcagtggcgcgatctctgctcactgcaagccccgcctccctggttcacaccatcctacctcagcctcccgagtagctgggactacaggcgcccgccaccaagtctggctatttttttttgtatttttagtagagacggggtttcaccgtgttagccaggatggtctcgatct

SEQ ID NO: 15311 - DNA, 22390 bp, Human
tttgtccggtttattagatatgtcaagactaatatttgcttttgtcagtcccctctattgtactttgcttcttgtttcatttattctgttcttattttcatcatttccttttctacctttttgggatttattctgttcttccttttctacattcttaagttagatccttaactcattactgttttgttgttcttatctcctggtatagggtctttatttgagttctcccagaggcaagttctgagaccaggacctgagggcaatagtatatgtgagagatgcagggagtgccataatgaggtgggaaagtaggaagggaagaaaaggtgagcaataagggtgtagcttttagtagctattgataattgctgtctagattcattaaattcattttgtcattaaaggacaaaatgatgaaattctatcattcatttggcattggtcagttaattattttatgaaggagaacttttccccatcaactatttagttacccagaaatagggtttgtacaggaaaggcagaataaaaagctgctttccttagcaaactctgaggtgaccaaagtgacatttttctccatatgtcgatatgaactttctttgcagtccttgttctttttgatgttctaatttttccatatttggccagtggaatcaccttcaaattgattcttaccttcttttgacatgacctgaaatagtcttttatggctttcttgctttctgttaagatgttctaggctaatcttataaattttcttccctgcacctaaaatcagccatttttttcatggaaccctggttcctttggggacaaaatagtattttaagacccattattgccaggcgcggtggctcacgcctgtaatcccagcactttggtaggccgaggcgggcggatcacgaggtcaggagatcgagatcatcctggctaacatggtgaaaccccgtctctataaaaaatacaaaaaattagccgggcgtggtggtgggcgcctgtagtcccagctactcgggaggctgaggcaggagaatggcgtgaacccgggaggcggagcttgcagtgagccaagatgacgccactgcactccagcctgggcggcagagacacactccatctcaaaaaataaaaataaaaataaaaaagacccattatttgggcttattacgatgagttggtctctggttctaggccttttttttttttttttttttttttagaaaaatacagcaggttgtattgaggttggcacctatgttctttcaaagaaccctcatcattttgtgagttctttccttgtggcaccacgatgttccaggctcatcttgtatgttccctgcctcagcacaggattttttttaatgagaaaaatatcacgaattcaaatttacagaagctttacatttttatgtcctctaagttagcagtctgtctttccttttattggtgtttgtaaaatttcttctttttaaaattgttatattttagagacagggtctcgctctgtcacccaggctggagtgcagtggtgcaatcacagctcaccacagcctccaactcctgggctcaaggcatcctcccacgtaggccttccaaagcgctgagattgtaggcataagccaccaggcccagcctattacctttacgttgtacttagtcccagataaaaaatgaccttagatcagtcctttcctctttggctggggagaggggggcttaaattccggtactgtgaaacagaagaatggactcagtgctatgtgacaaatctatgtatgtaaatgtgtgtatatacacacacataaattatatatatgaatatattttcattttcatattttgcaaggagagtagccaatgctctggacctctggtcctttttgtagggtaccctctgaggccgggaacctttgctcaactctcaggctgtccagggaagctttaggcggtgataccgagctacagaccaatataagagctcggggctgtggcactgaagagaggaggcggccgttgggaactgaggtgggcccagggcttgagctgagttggcgagggtggaggtggtgccggtcccacgccgtggtggggaccgagctgcgggctggagggaggggcagcgccgagggggcgggacggggagggctcgcggagtaggccaacggttggccccaaccgccactgactacagcctgcgcccgcctcttttcgttgccgttacctgtttccggcagtcgacacgctcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcaggtgagcggggttgggagacaggagagctccccgaggaggactcaactgtggggacaggttgagcaagaccatctgcgtttgggaaatccagccttggattattgagacagagccacctagtcggctaggatctgacctggccagagaattcttggctagtcctatttttattcgttctcacagaagccgaacttaaacctcagaattatcactccagagatgaaagggaactgagactggaaaagccctgcttaccaaaggtctctgggcggcagaaagagccctgagcttcagtttcaacttaggagacctgggtcttggtccagattttactgtggagtggcgttcagtaagctttgtccccatcccgggcccgagttttcccatctataccatgagagggtttagactacagatcttcaaaggtctggcacgtggtaggtgctccttaaatattacttgttaggagtgaataaatgagataggaaggcctcctgggattcactggaggctcattgggttagttggaggctgtggaattacattattatagtctgagaagtaggcggtattatctccattttataagtgaggaaactgaagctcagaagtaaagtgacttgctagtaagtgtcaaagataagtcagacttcagagtccatgctaggctatactctctcccagtaagaaagcggggaggacttgatgggaaagtgattatatcgagcagcaagtaatcatttgaattctctgcttaaatgaaccccagagcaggcccatatctgattattttctatcccgtttccagcacctgatttgtgtgaaacgttttgggtggcaatgccagaatcaccatctatattacttctgtcatcaacacgatcagcataattacaaaaattaatggctctaattgttatagtgataataaagcataaatgaaattgtgaggacatcaaaatttataattaaagacacctattaaaacagcagtttaaaatttataaaacacttttgagtggttcttcatattgatctgcttaggtaggtattattatccatagtttacaagcaaggaatccaagacctagaggttgagtaaccatcaaaacgtcatgcagcaagaaatggagctgagacttgaatccagcccatgtgacaagttgtgcttctcctttggtgattatttccctatttcctctccatttccttttttttttgagatggagtcttgctgtgtcacccaagctggagtgcagtggtgcagtctcggctcactgcaacctccgtctcctggtttcaagtgattctcctgcctcagcctcccgaatagctgggattacaggtggatgccaccatgcctggccaattttttttgtatttttagtagagatggggtgtcaccatgttggccagggtggtctcgaactcctgacctcaagtgatctgcccacctcagcctcccagagtggtgggaatataggcatgagccaccgcacccagcctcttcctttcctgttctgagccctaacccgctccatgcctatcctgtgctccattcttcttatcacctggagaattcctgtttagatttaactaatagtcacatgttgactgatgatagtagtgttggtttaacttgtaattaaggtgttaagagtttaaagtatgttctctttcagcaataaagggggatttaaatgtttttaagaaaggagttgtaattgttattattgtcattgttatccacaggattcaaggaataaaactagaatatacagtaattggtagtttaaaaataataactgtcatatattgcactcatactatgtcataggccttgtaatagccactgtagttaagcattttatttctatcacctactctgctgaattgtataggggaggatcctgaagcatagagaagttgaataacatgcccaaggtcacatagtcctggcctggtccaaatcctatgttcttaaccattacaccagcctggctcagagacagattgtttgcttagaacaaagcctgaccctcccggggaggagagcctgaattgaggggagagaagtatgctctagtattgagtgagaagatggtctccccttgcttatcttttgattctgctgttgagagcctgggattgaaatgaagggaggcttttcttctggactcagcaaggccactctcccagttcccctcatgatactgagcaatagttcttttcccttcttcaagttaggaacaagtgactaaatattcatatgctattgataaaagtttgtcttggttgacactaggaggctgtagccaaaagcagtgcaactttgccgtatggttcactgtcctgaaagcttcctggaagattggtctaaaatcatcatgccattcctctgtcaaaaattcttgagtggtctcccatctgtggaataaacaccttaataagttatctaagcctcccaggatctggactgtgctgaccccttcagtcccacctctgcccccatcccttgcactccaccttactgtagtcacactaaactactgagaggccccaaaactcactgttttctgttgcctataggcttttcacatccttgtcctctgcgcttctccttttaaccctcagttggctaatccactgttcattctttaagatctggctcactgattcattcaatcattcaacaaaaatttgttgagtgcctattacttaataggcatagttctaggtgtcaaggcggagcaataagaaaacagacatacccttgctgtttctggagcttccattttgtggtatgtattaaacaaatgtaacataggaggcatcaaagtgtgataagtggtgtggagaatagaacaaggaaagaagataggctggggcaaaggagttgacagagaaaccttcctgattggatgatgtttgagcagagctgaagaaggtgagggagcgttatgtggctatctgaaacgagtgttccaggcagagcctgtgactatatgaggcaggagttcttttggctcaatcattctctccaaaaatccttctctggtgccttgatctggatagatgccacttttgtgtttttctacttgctgttgtgtttacctctaaagtagcacttattacatcatgttataattgtccatgtatatgtctgtttccctcacttggattgggtttcttgagagcaggaacctctgatccttctctgtcttctcagcatctattttagggcctgacacagaggaggaacctagaaatatttattgaatcaattgttcttacagcctgataatatttacaaatgatttgtaaaattgggtttggatgacagttggtttgaggaaaaagtaattctaaggctgctttttgtctgtctggcttgattccccttttggacctctgagaagtggaacacctggttttctttaagaagaatacttggagactccattgtgagcattatggcagggtagccaacctgtaaaatggtgggtaaaatataacaaagccggccgggcacggtggctcatgcctgtaataccagcactttgggaggccaaggtgggtggatcacctgaggtcaggagttggagaccagcctggccaacatggtgaaacccgtctctgctaaaaatacaaaaaattagctgggcgtgctggcgggcgcttgcaatcccagctacttgggaggctgaagcaggggagttgcttgaacccaggaggtggaggttgcagtgagccgagctcacaccattgcactcaagcctgggcaacaagagcaaaactccgtctcaaaagaaaaaaaataacaaagccctttatagctgaatttgcaagaaagtaagagaaatctccagggacctagaaaccaagagtgaactgaaaaccagagtggttagctccttatctgccctcagctgcactggatgtctcacctagaaacttggactttaataggcctgttgttataccaaatgaagctataggtccgcatgggttagactctagtgggttttttgttgtcgttgttggtgtttttttgtttttgtttttgagatggagtcttgctccgtctcccaggctggagtgcagtggggcaatctcagctcactgcaagctctgcctcctgggttcacaccattctcctgcctcagcctcctgagtagctgggaccacaggtgcctgccagcacacccggctaatttttttgtatttttagtagagatggggtttcaccatgttagccaggatggtctcgatctcctgacctcgtgatccgcccaccttggcctcccaaagtgctgggattacaggtgtgagccaccacgcccggcctggttagactctagtttttgacagaggatggcatgtgaaatactcacatgaagctaggtcccttgaaaatctgcaccctgtgtagggtgtataccttctgatagggtggactagtatcttaattcactttctgttgcttataacagaatacgtgaaactgggtaacttataaagaaaagaaatttcttgcagttatggagtccgagaaatccaaggtccagaggccacatctggtgagggctttcttgctggtggggactctgcagagtctggaggtggcatagggcatcacatggcaagggggctgattatgctagctcagatctctagttttcctcttataaagcccctaatgcactcccatgataacccattcatccattcatccattcatgaggacagagcccttataaccctatcatctcttagaggccccacctctcaacactgccatatcagggattaagtttcaacatgagttttagaggggacaaatatcaaaccagatctactaggaaaaaaaaaaattctccctactgacacagatagaagacaaagagattgccttttatcctaggctttcgtacagaaaaaaagttttcccagaaaattcttaaccataggcattcactcatacagatacccaaatggcctagaaactccaagccaagaagttgataataaaaaccacctcaggctggtaatacccctggatgcttggcaaaaacaaatgcaaaaccgctctgctccaagatacatacttgatacaggccacatagaattcccacagggtctggagttaatgaaattctcatttgttaaacaagaatgtatattgcttgctttgtgctattgagagcatatgttattcttgtataaagaaacatttgaatatatctgtgcccccccacctttgctctccagaagtgaaatgatgaagcagaatttatatgcaggccagcatctgggtatggacacacattaagcttccttctatccttgcagaggtcatggaagaagtgacaacatgctccttcaacagccctctgttccggcaggaagatgacagagggattacctaccggatcccagccctgctctacataccccccacccacaccttcctggcctttgcagagaagcgttccacgaggagagatgaggatgctctccacctggtgctgaggcgagggttgaggattgggcagttggtacaggtgactcttcatcccagatctgagtctgggcctcagtttctcttcacaaagctcagagctcttcaggatctgtgccttttctcatcagtacaggaaagccctgtgtggggagcagaggcagaaaaaacagcaaaaacaatggctctcactgagtgcttattgtgtgccaggggcacattgggtcctcacagccattctgtgtcgtaggtactgttttcagtcatattttacagacaaggaaactgagactcagagaggttgccatttgctcaaggttatacagctataataaagcagtagaagctggtttcaaactcagtcgctgactccagagacctccacagttatttagattcagctaacgtatgatgtgcctttcatttatattccatttaatcctcataaatcacccagggaagtaagcattggtagtccagttttgctgatgagagatcctagtgctccaagaggtaagtaacttgctcaggaccacatttagcaggtgacagggggataccagtaataaccacgcttctactactaaatgctgtatgtgaggtatattttattatccccattttgcaggaggcaaccaggcctgagaattaaggtcatttgctttggtcacgcgtctaataagtgggagaactggagttagagcccttcctcttcagtagaacattttgactgtatttttagtgaggaaagaagggttactgctctttggcctggaagctacagggttatttcagatcccaaataggcatacgtcggagatattgtggatttggttccagaccaccacactaaagtgactatcacaataaaacaagacacataaattttttggtttcccagtgcatataaaagttatgtttacactatactgtagtctgttaagtgtgtagtagcattatgtctaacaaaaagtacacaccttaaaatactgctgaaaagtgctaatgattatttgaacctttggctagtcaatctttttgctggagtgggtcttgccctgatgttggtgactgctgacttatcagggtggtggttgctgaagatttagtgtattattattattattattattattatttttctagaagcatttcttacttacatagataatttcttaaaataagacaatgggctgggcacagtggctcatgcctgtaatcccagaactttgcgaggccaaagtgggaggattgcttgagctcaggagttcaagactggcctgggcaacatagcaagaccttatctctaataaaaataaaaaacattgggtgggtttagtggcacacatctgtagtggcagctactcgggaggctgagggggaggattgcttgagcccagaagttcaaggctccagtgagctgcgattgtgccactgccctcccgcctgggggacagagcaataccctgtctacccccaacaagaaataagacaacaatgaagtttgctgaaacagttgacacttcctttcacaaaagatttctctgtagcatgcaatgctacagaatttgatagcatttttcccatagtagaacttataaatgaatcctctcaaaccctgctgctgctttatcaactaagttgatgtaatattttaaatcctttgttgccattttgacaatgtttacagcatcttcaccagaagtagatcccatctcaaaaaactactttatttgctcatctataagaagcaactcatttattcaagttttatcatgagattgcagcaatttagtcacatcttcaggctccacttctaattctcttgctatttccaccatatctgcagttacttcctctactgaagttttgaacccctcaaaatcatgagtatgggaatcaacttctcaatgtctcttaatgttaatattatgacctcccatgaatcatgaatgttctgaatggcatctagactagtggaatttttccagaaggttttcagtttactttgaccagattcatcagagtaatcactatctatggcaactatagtcttatgaaatatttcttaaataatgaaacttggaagttgaaatgactccttgatccgtgggctacagaatggatgttgtattagtggccgtgaaaacaacattaatctcctcatacatctccatcagagctcctggatgacaaggtacgttgtcaatgaccagtaatattttgaaaggaatcttttttcctgagcagtaggtctcaacagggggctgtaaacagaagtgcttcatccaggctttgtttttagagcactggcagagtagatttaggataattcttaagagccctaggattttctgagtgataaatgagcattgacctcaacttaaagtcaccagcccgtcctttgaaggtttgaagccagacattgacttctctctagccatgaaagtcctagatggcatctttcagtagaaggctgttttgtctacagggaaaatctgttgtttggtgtagccacctttgtcagttaccttaactagatcttctggataactggctatagcttctcccatcagcacttgctgcttcaccttgcccttttaagttacggagacagcttcttgccttaaacctcatgaaccatcctctgctactttccaacttttcttgtgcagcttccatacctctctcagcctttgtagaactgaagagagttagaactttgccctggtttaggctttgtcttaagggaatgctatggctggtctgatcttttatccagacctctaaagctttctccctatcagcaataaggctgttttgctttcttatcattcctgtattcactggagtagcacttttaatttccttcaagaacttttcagcctggtgtggtggctcacgcctgtaatcccagcactttgggaggccaaggtaggcggatcacgaggtcaggagttcgagaccagcctgaccaacatgctgaaatcccgtctctactaaaaataccaaaaaaaaaaaaaaaaaaaaaaaattagccgggcatggtggtgcatgcctgtaatcccagctactcaggaggctgaggcaggagaatcgcttgaacacaggaggcgggggttgcagtgagcagagatcgagccactgcactccagcctgggtgacaaagggagactctgtttcaaaaaaaaaaagaactttttctttgcatttacagcttggctgtttggcacaagaggcctagctatcggcctgtcttggctttcaacatgccttcctcgtaagtttaatcatttctagctttgatttaaagtgaaagatgggggactcttcctttcacttgaacacttagaggccattgtagggttactaattggcctaatttcaatattgttgcatttcagggaataggctgaaggaaaggaagagagatgagggaacagttggttggtgaagcagtcaggacacatatagcatttatcaagttcaccatgtaatatgggcacagttgtcatactccaaaacaattacagtaataacatcaaagatcactgatgaaagatcaccataacagatttaataataatgacaatgtttgagatattgtgagaattaaccgaaacatgacaaagacatgaagtgagcacatgctcagttcagggttgccacaaaccttcagttttgtggcaatatctgacaaatgcagtagagcaaagtgcaataaaatcacataggcctatatttcttattgttgctttcctctctcccagggctagcttaagtgagacaaatgagacaatggttttgagagtcttttgtaaaaaaaatatatagttgtgtcatctctctatatctacatagtaggcactttaatactcctaacctaccctgcttttttacctacagatgtctcaaatctgaccattaaatcttcatatccacagcagataaccttcttctgctgttaaagtacacagtgcaaatgctattctgctgaacatgggccttgccatcaatccctgtctttgcttttgataacattggctcacatttctcttggtgaagttttttactttgtgggattttcagttcctgctctttcaccttatcttctcatgagtctttctcatggcctcccaggaccagacttctgcatgtataactagcctccacagaggcccagccctacagcccagtagtacttgggattctagctctttcctttcttctaggacaagcattgcctgtggtcatcgtcatgttgcactgtttttgatcacagacagtaggctgttaagcattttttttaatcctattttttagagacaacttctatgttgcctaggctggtcttgaactcctggctcaagcaattttcctatctcagcctcctgagtagctacgactacaggtgtacaccactgtgcccagccttttaaattttaactgtctgtttgtctgtctgtctgtctagagacgagccctctctgcgttgcccaggcgggagtgcagtggctattcacaggcttgatcattgcatactatagcctcaaactcctggcctcaagcaatcttctcacctaagcctcctgagtagccgccactacaggcaggtgccactgagcccagcaagcattttttatcagaccacacctgttgcataacttcactactcagtagtcacacacatccacaaacttgtccactttaactcattctctctttatttcattctctgacttatttaattgtacaatcttgaagttagaagaatcatgagcccaattctttcccaatatagaaatctgtattctattggtagttactgaaatcttagtgattaagagcatggctttggagtcagtcaagacctatcatttattggctttttggccttggatacttgactcttctctgtttcatcagctgcaacatataattaataatagatactacatagtaagaactaaacatttgtcattttccattaagggtctccttgcacaactcttcaggtgagcacctgattgctgtggcagctggtttttatgtgtgaatgagatgatctctacttctctataattacccattggtttgttctgccttctggggcagtcaatctatacaaaatgtagataaaatctctttttcagagaactactctctgaagtacctgaaagctgtattcatgccctctgagtagtctgttttctgggctaaacagcttcagttctttctgtaacttcttagggcacagtcctgatttggtttctggccccttgaaaattgtgattactgtcgttgggatctggtctgagatagcagtgtccttttttaaagtaggatactcagaattgaacttgggactccaagggtagacaggccagctcagcaatgaggtgagctctcctatcttgtattccctttaatgcaattgaaagtaaaatagcactttcttggtagctacatagcacaattgactaatgttgagtagatggtcagccaaaacctccaagtctttttcacatttgttattcttttaaaaaaaaaattaattgtagtaaaatacatctaacataaattttaccatcctaaccatttttaagtgtatagttcagtagtgccaggtatattcaaattgtgcacccaatcttcagaacttttgatttttcaaaactgaaagtctacacccattaaacagctccccatttctccctcctcagtccctggcaaccactaatctactttctgtttctataattttgactactctagatatctcatataagtggaattgtatagtgtttgtctttttgtgatggcttatttcacttatataatgtcctcaagtttcatccatgttgtagcatgtatcagaatttccttcctatttaaggctgaataatatatcattgtatgtatataccatattttgtttatacattttttttttttttgaggcagggtctcactttgttgcccaggctggagtgcagtggcatgatcatggctctgcaacctcgaactcctgggctcaagcaatcctctgcctcctgagtagctgggactacaagtgtgtgccaccatacccagctaatttatttatttatttatttatttatttatttatttatttatttattgtagaaatggggtttcagtatgttgcccgggctccattcatctcttgatggatactttggttgcttttgcctgttgggtattgtgaataacattgctatgaataagggtgtgaaaatatctctttgggaccttgcttttaattcttttggacataaacacagaagtggaattgctggatcacttggtaattttatatgtaatgagaaactggcatgccattttccatagtggctacaccattttatattcctaccaacagtacacagtggttctagttttccacatccccaccgacatttgtcattttctggtgtgtgtgtgtggtagctgtccaaatagttgtcagggtgatacctcattgtgttttttagttgtatttccccattaattagtgatgctgaacatgttttcatatgcttgttggccattacgtttgttcttgtttttctttttcttttttttttcttttttttttttttgagatggagtcttactctgtcacccaggctggagtacagtggtcaactcggctcactgcaacctctccctcctgggttaaagcaattctcctgccacagcctcccaagtagctgggactacaggtgtgtgccaccatgcctggctaattttttttgcatttttagtagagacagggtttcaccatgttggccaggctggtctcaaactcctgacctcaagtaatccacccgccttgacctcccaaagtactaggattacaggcataagccacagcacctggcctacatttgttctttaatcagtttaccccatgcaaatttttaagccacaacctgttttatctctgtcaagcctcagcttgttttatatgtcccattgctccagctagttgagagcatcttagattccaagactttcatgctatgtttactcttttttccatcttcatgtcaactgtatgttagatatacctggctcaaataattttcttctctcagccactaaggatgactaaacttctgacttctcaaaaactagactgcttaataagtaagctgacttgatcacatatctctggcatgtttagtgtgctcagggcactcaggtatagaatgggctgtcccagagatcttgaattccctgttgaactagcttagttcaaggacggaatggtcttttatccagaagactgcgaggggactcttccgtgggatgggagttagcactagataacccttatggtccataatggcttagatttcttttttgtttttgaaacagggtcttgatctgtcacctagggtggagtgcagtgattgatcatagctcactgctgcctcaaactcctggacttaagtgattctcctgcctcagacttccaagtagataatgtaaaaattatctagacccagatcatgtaaaaaaaaatgttttgtagagataaggacccactatgttgcccaagttgatctcaaactcctggcctcaggcaaatggctctgagagtctatgatctgcgcctgcttaatctgttttgtccatttatacagaaattaattttttaaatttattttttgttttaggtagttaatacatttcatatagctgaaaaataaaaaaagtataaaaagatatatatctcatttccattcccctacctcttataggcaatcactattgtttcttgttatctcttcagtgctgcttcatgcagtagcaaagcaaagaagtatgtactcttaatagcccttttaaaaacttttaaaaatgtgaagtgataacatatacagaaaacataaaacataaatgtcaaatgcacaaaacataaatgtcagctcaatgagcccttatgacaaagccaacacttgtggactcatatatagaactcacaactaatattccaagaaatagaatgtcgtcagcatctgagaagcttctcttatggccccaccctccttcccaaaggagaagttgattatattaagttgatttatagccctagagtttagttttgcttatttttaatctacgtattcttttggtctggcttttgttcagtattcttgagatttatccaaattgttgtgtgtaaccctaatttgtttttcattgttacatagtattctatcgtatgaacataccacaattaagtgatccattttactgttgttggatacttgggttagttattataagtatagattatactgctgtgaatattcttatacatgtttttggtactgcgggcatacattttgttgggtatgtagctaggagtggaattactggctcatgtggtatgtgtatgttctacctcaatagataatgtcaaccagttttctagagtgatggttttaagggttgttctgcctcagttccatccttattccttggatttggccctttaaggttccatctcaaattacatgacagtttaccaggccttcaagttttgtccttctgctccataaggttgtcaaatgacttgctcagcttctcagcctttcagttacttctttgagaattagtaggataccctaagggaaaaagggaccagccaacctctctgaaagaacttagcctgtcattcttcattctcttgtttgctctctggtgctttcagatattttgtttttgtttaaatattttatctatcttttcaagttctcagtggaaggattggtctaattatttagtttgctgtaaccagaagtccctttcctccacatttctgatgcaaaaggtagcatactacatacactattctgtattttgctttctttatttaagaataaattatgaaaatcaggccaggctcggtggctcacgcctgtaatcccagcattttgagaggctgaggcaggcggatcacctgaggtgaggagtttcagaccagcctggccaacatggtgaaaccccgtctctactaaaaataaaaaaattagctggacgtggtggtgcaagcctgtaatcccagctactgaggagattgaggcgtgagaaccacttgaactcgggaggcagagattgcagtgagctgagatgacaccactgcactgcagcctggttgacagagagactccatctcaaaaaaaaaaaaattatggaaatctttccatatcactatatatggaaaaaaggtcttcccccatgtattgcatgttcatttcacccattctgtattgacgaatatttgagttgtttgtagtattctgctacttcaagcaatgctacatttgaataatcttatacatacttaatttgatgagcagatatatcttaggatgaattcccagaattgggcatgatgggaaaggataaatgtatttgtaattttgatatatgtcctacatacaggttgaaccatttgcacttcaatccatatatgaaagtgccagtttcttcacatttgccaacacagtattgtcaagctttatgattttgctaatttgatagatgtaaagtgttatgtcaatttagttattttgttttatttttatttttagagatggggttttgccatgttgcccagactggtctcaaactcctggactcaagctattctaaagtgctgggattacagcatgagccactgtgcctggccattgtcagtttcgttttaatttgcatttctctcttatgagtgaagctgaacttttttttctctttctgtgagttgtctgatcttgccctttgcccatttctgttggattcctggaaattttcttaccaatttctactattgttttgaaaatatgttagggagattagacctttctttatttgcaatatgtctgattaggcattatctcattgtatccttataataactcctctgtgaggatgttattaaattttccatttaactgataaagaaattgaggtaaagtaagattaagtaacttgcccatagtcacaaaataagtgatgaaagcatggtttgaactaggtgtctctgaatctatgcttgagctttcaacaaaagttatgaattgccttcccagtgtagtacaggagggaaaaaaatttgtcttaaatttccttttatttgcttaaaatttgtgtatttgtttgccttgcttttcttttcttccttttcttttttctttctttcctttcctttcttttttttttctttctttctttctttgtaaaaatatttagcacctattatgtaccaggggctggagaatcaatattagtaaccaatagtataagccctgaaaaggctcatagtctagaaaaggaagacagtcataaaaagttacaatgttatacaataaatgtattaggggaggagagtgagtttcatggaaggctttataaaggaggtgacttttgagttgggtatggaggatgatttggaagtctagatgaaatgaggaatagcattccagacagaggagacagcttgtacaacatttagcattgtctctttccagctttgtaagttatcctgtaatatccgagaatttagtgagtagttaggccttcgtgattttatagatttcaatatcatttatttcttatttatgaaaaatactaatacttttaatgagcttcatgttttcctattagtatctcactcctactttctcccttctccttgtctagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatagtgcctgcatgcttcatgatcagtaagtcctggctgcataaaggactctgatgtcaaaatggaaaccaggggacttaccttttcacatgacttacccctcatccgagtgtgaggttacaagcaggtgtcatggcaggaaggaagaccagatctgtatgatttgttccatttttaataacaaaaatatccacacccttttaataatgctcagagttctgtaggctctctatcctagaggaattgagcaaaacagaagaatcatgaagtctcctaccttctacagccttgtagttctgcttaccttctcttcctcatccagaaagcatcattttctagggagaacaatgagaatctcaatgccagtagtactggataatagtgcgtattgcttctggtggcattaccctgatgatgggctgaagttcatttattagggtggttcctgatgggaaaaggacatggattaggactttaaaacactggacagaatttcccacagtctttgccctcaaggagttcaccagtttatggggctagaagagcgagaaaattcaagaaaataaatgtagctggtgggagactttgtagatgttgggctatatgttggggtgatggtagctcctgatgtaattttcttagttgcatcttcaatatgcctggagtcgtctgtccaaggcttgtccaggcttctgggtttctctcaagtttgtttttctcaggatattgtcctggcccagctactcctttacctgtgagaagatcttcaccattaggaagatctctagacccccagatctcagaatcaggcctatttgtgtaggcccatggaaatcactacttgtgaagtagagatgcctttttgtctaatggttttcgtgctgaacttagttcatgctgagtctctcagatgataccacgttggttgttcctatcttagattgtttctcccatagcctgttattgcaacagaaattctatcatgagagatttatttttttgtccctattttaggagtctaatgcttaaactggtatcaactaaatatatttggtgttgtacaatgaccacagagaacaagtcttagtcatgaaatatagcctaggagactaggggttacagttgcactagttgggtagagagagtcctacaggataaaagtggagattaactttacctactttagcagattgcttaagccatggcttagagtggcttttaaaaatccccttagcctctcctacatttgccaaggtaatcttcccaatacacaattattcactcatgtatacatttatctaaatatttcttgagtgcctaatacaaggtactttctactgccattccttggctctaaatcatttgtggttctccattgcctattataatgtaaagatgtttacatttagcctggcatgtaggaccttccagctgttgggtgaaataatgcacactttcctctacttccttatatgaggcccactgtcagggaaaacctctgtcaagttggcaggtggagggtggtggaggtctagggatgggcaggattggtgcagggaggaattggggaaggggagaggattaaaagggcagccccctcctgagtggtagaaactccttgtttagcaaagctttcctgaacactgtactgcaagtggataggaatagggaggatggccaagtcgtacaaccagggctaaaggatgaaaagaatgagaatatcaacttcttttttttttttttgagacagaatctcactctgtcgcccaggctggagtacagtggcacaatctcagctcactgcagtctccgcctcctgggttcaagcaattctcctgcctcagcctcccaagtagctgggattacaggtgcctgccactacgcccagctaattttttgtatttttagtagagacggggtttcaccatgttggccaggcttgtctcgaactcctagccttgtgattcgcctgcctcggcctcccaaagtgctgggaatacaggcatgagctactgcgcccagccgagaatatcaacttctttaggactactcaagaagggagtcaaggcagggaccttggtctgtgccactgtgacgcagagatgtataataccagtactcataagaggtccatctctaaattgccctcctcttacttcttccccctgcctcatgttttttctctttaatgactagcatcgaaactctttaaatggggcaggcctgtgttcttatctcaggaatagtaagaaaaggg

SEQ ID NO: 15312 - DNA, 23704 bp, Human; identical to SEQ ID NO: 12104

SEQ ID NO: 15313 - DNA, 7571 bp, Human
tcagccacccacacagtgaatcatgtctgcatggcacgcccctctgctccttctcgctgaccttcctttcctacctgatggtctaccataagccacctaggcagaactacttatctccacttcccatgttaaacagtgtctggtgaaatcagaggcagcaatcctagtaacacagctgggtctgtaggcccaaacaactactctctctcacccataaaaccctaaagcacagctagaactcttctgcttcccacatagagaagaattgctaactcataatatatttcaccttcaaaatatgtccataattatgccagagaaaatatttattttttggtcactttgccaaagtaaagttatccataacaaacaccattgattagaaaatcttcctgtaatattacctccaacccttcagaattgccagaccagaccttcatctgcacagcacaggatccacttatccacaatggtcaagaggcctgtctttaagatttccagtcacattcccccgaccctgtcatacttccaaccaagctatcctcaaattatcaccagccctgtacaaaaatgtaacaataatacgagacctatacaatgcctgtaatgaaaagtggcagctggtgatactgattgatctaggggttccatgaaaatataagcagaaaactactagataggacagaaaaatcagcaggtgaagattaagctaccaactcaggaccctaccaaacttttcagaaacacaaaaccttggtgccaaattttaaaaacaaaaaagaagaaagcaagcaaagagaagtacagaaccttgtttagaaaatcaaataaagatttctcccagaacgcatgaagaaagcagtaagatataaaacatagacatagggaggattgattcacaatataacatatcaacaagtaaggttcagcacaagagtgaagaagaatgagtataagaatattgcagagaaaataatctttggtaaaggcaatctgagaagcaaatagaatggaaactaattaaaaaatagaaaatcaatgtaatacttgaggctttcaacaggctatcatactatctaattagattgtattattgtgtccactcaataaccagtgtgattaaaatatttggtacaagaagtaagacctaaactgaatcatatagaacattctagaaaagagaaagatcatggaagaagtcttagggacataaaatagcatggcttgttcaaggaactgtgtattcacactgttctgatgcagaaatctaatggtgctttctgtggccaattttgccttactaacctccaggatattaataaagatagaatgttttaatacctgtgttctacaacaataaagtatctctggttaatgctagattaggagaatcttaatctctttgggccagagtagcctgagggtaaaacttctgtcatccacgtgtgcccaagtgtgtgttgtcctcacacaactcaacattaaacagaaatgatctctatattattatgaaattaagctacatatcatccatataggtatatacgctataaaaatggaatttatgctacactaatagctagagatattaatcattttcacttctggctataagatcactgctgacaaacatatacaaacgtaagcacgtgtgcacacagacaaccaatgaaggggaaagactaactgtctaacccaattgaaaatcaaatgatgaccaaacttcaattgtagtatttgtgctgattgcttggatactgtttcttcagaaactatgctcaagtcacagtttgtacctaaccacatcctaccaccacatcctgctgggctaaaatcccaaaaagtaataagagacgcattcaactttatgagaggaaagcaaaacctaatctttcaggtggtgaggtccacccagtatggagctcaaaggtgccattgttctgctcatgtttataaagggagctgccatgtttctctcaacgcagagttgggagcaactccagagcctccttcaagatgctgctggtcctgctctcagtggtccttctggctctgagctcagctcagagcacagataatggtaaaaaaattatttttttaaaaaaggagatggggagtgggatgaggggccatgactcttctagggcctcaggggttcaccctacaccactgcagcggaagagcaggaggggaggaaggaggttgagaagaagggtagggctttggagctctcattccaaggatgacatctgttgtgccctcattccatgccaaggccttatactttatttgatatacacttggaacccaatagagaatttcaattagaggaatgacaaagtaagatttgtatttttagaaagacctggctgtgctgtgaaggatgcagtggagaatgcaagactgatccagggaagtccagctatgaagatgctacagtaatctcagtggacagcgatgatggtgtccttgctgtacaggggatgcagaatcaatgaaagagataaacaaacatcagagtactgtcagacatagaggactggataatacatttgtgtctttctacatagtggtatagaaatatcaggtccccaaattcccatttttcttccaatcacatttaaaatttcaatatgttgcaggcagtatgtgtaagattatatccaaatatttactcctggttgctcctcttgggcaagcttgtgaatatgatcaaaatatttaaagaaggaagaaggtaaagatctaaaatatgacatgaaaatacccagagaagtgtgcctaaattagcattagggtttgagggatcctaaggatgacaaaaagggactcttctattgaattcgtggttgatgctcagcgatagtaacaatcctgcctcccctaacatcttcctccccttccagcagcttcacagaacatggttgatgaggtaacttaggggatgcacagggtgtggccagaagacccctttccctatagaccactatgagccctgaaagatttatgaggtaatgttcacttcatcctgtgcttcttttcctagatgtgaactatgaagactttactttcaccataccaggtaaatcccaatgatcctcaatccaattcttttctttctttttccactagaatttctttttagtttccttcagtgtcttcttctcatcatttttttgggaggaggtggtaagaggggtcaggcattgattaatattagtgcccctaaatatataggcaattcttacccatctttgattctggggaccatgagccaggccaccaacttgaatacagagatgcctggctttgaggacaataggagtgggcaggcttttttcccaggctggaatgactgctgagagatgatgaacaaatgagaagtgttctcattctgactcctccatccttaactgcttctttcttcccccagtgttcccttgcacggttatgtggcttcagggagtaacacaaaacaaaacaaaaaaatcagtgcatgaatgtcttttctctgtgttgacccactcagctgtgtcactacagatgataaatagttgccacagctgtttagtgatcatgtgcaggctttcacattgtctttctcttctgtctcttagtatttctctacttggttccaggagcctgggaaatcagctctagtttccacatagggcttaggtgcccagagatggagtcacagtttgtaagtcattacagcaaccaaaaaataaaaataaaaaataaccagtaacataactgaaagctataatgcttttgcttttttttttttttctgtccttggagacatcctctggcaactctaagatatgcaagaacccctcttttcatttaaggaaacatacttgtcacaggagcaaataaatgagactttccatatcactcttacatggattaagttgagagctgcataaaaagaaaaaaaaaacagtgggcacaaaagaagttgacagtcaagcagcaggtttggggagaacagggctgtgtggtaaggtgagagaagtataaagagaggagagtttttcttcactgagctcatgcattcttgtccattaattactcacacagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccgacgaggacaccgtcaactctctctaccccgatttccttctgtcagcctgcaggaagcatcatcattcttccggagggacagaccagcaagacatccccaggagcaaccactctggtaatctagaattcagtggcaggtatgattccagttcattctccattaaatgcccaaactgctaccattcccaaactttatcgtgttcacaaatcaattggaaatatgttgaaattacataatcctggaccccatttctaaagatttgtattcagatattcttggataaggttgcaagtccttgtatttttaacaagtggttcaaagaattcttatcttttgaaatactgacctccccaacttttttcttaagatgacttgtctcattaaaatgagttggtaatgaggaagtggggtgtgctctccctttggtgctctgcctcctgtctttgagtctgccttctcaaacccaaggactctccatctcaggtttctctcaggtttccgccagaggactctttgctcagtcctgcctcacactagcctctcaggtccagtgtccctgctaaatgatacttgaacttgatgctcttatatcttatttaatttttaaaatacttattttgaaattagtacatgctcaaggaaaaaaaaatctaactgaacagaatggtatgaagctaaatcttaaagtgacgccttatcctacttacccacacccttcaccaaaagtcaccacccttaattttttgaacatcctcctggaaatatttatatgtatataagcatacgtcattatttttcccacaaatgacatattattttatatgcagatctgtatttgcttatttcaaataatacatgtcttagacaactttatcatttcacggagacctatagatcttcttggtgatttatttgtacatttttcttttgttgttacaattgtatactattctcttgtgtgactgtaccatgatttcctcagtcaaccactgttaattgatatgtaggcttgtattagtttttcactactacaggttcaagttgcagtcattttcataaatataaccttgaatgttttgaacagtaaccaaaacataaacaccataaaaaaatctgttttcttaatcttgaaagcaataatttacttcagtaatatcatcaaggaattagataagttttgccatgttgtatgttgtgtataaatttccttggtttttttttttgtttcagaaaataaataagaagataacttccttcagaaagccatgacattgaaataatgtggtcataactctttcttcagtataccaataaaatattaatagcatgcaatttctgattgttgcttctctttgtgggtgtttctgagtctagaatttgagggccattaatacaatctaagaatatctgggactcttgctcattgatgcttccagcaggcttccctcctcctttatcttaataaagccagctgccaaggagaaagagttccattgttccccttctgtcctagattgcatagcacaaatgcaaattcttaaaattatttttacatctttcattgatattcttgtaactctaggaaaacaaggaatatataacaaatgagagggagttgcaagtgctggggaattcttaaaatttccaaaactattaatcctggtttctaggggcataaatgtagttctagatctcttctctataaaactcactatgctcttttctcctcttttttcattgctcagctctcttcctccctaagtcgttcaccattctttttaaaaacttgagtggatttcataaagggtgcagcataatgtactttaaagggcaagaaatttgagtaaaactctgttctgattgtaaaaattccagcaatatcagtattattgtcagataatatagactaccaaatttaactcaagttgctgaggcaaagttgaatagaaaataaccctaagaagcaaaagaatttgatatgtaactgtctccagctacctctcattatcacctccaatgtcgctgaatacagaaaattttaatatctaatctttatcattaaaaagcacataattcttttttagattttttaagtacaggaaacaacaagtttctgaattcattctgagtttcattaaacaaaatatataggacagcaaggatactctgttagggaaactattcaatagtacataaacaaacgaacagtatgctaaaagaataataaaccacgttgaaagaggatgaggatgttaaagatggttcaatattagaaaattggccacaccatatctgattttgatgatatttagataagactttggatttagattttaaagtggatgctggaatgagttaagactttgggatttgggagatgaaataaatgtacttagtatgtgagaagaccatatatttcgggggatgaccagggacagaatgctatagtttgaatgtttatgtctctacaaaataaatttatgttgaaacttaattccctatgcaatagtattaagagatggagtctttgggggaagtgactaagtcgtgtggactctgctttcatgaatgggatcaatttccctacaaaaagaagctcccaaaggctgctgagctgttccatctcttttgacatgtagggactcaatgttcatctttctttcatacttctgcctcatgagagagaagccaggagaaattgtctgtttggaatgggctctcactcaaccccaaatctggtaccatctcaatcttcaactttccagcctccagagctatgacaaatccatttatattatttataaattacccaagataagatattttgttaatagcagctcgaactggctaaggcagagggctacttacaagaattaaatgcataatatatataaaattaccttataaaatgtatataaaattaccctacaagatgtatataaaattacacgatttaagtcttgtaaaatgcaacatgtatacaaaattaccctacatgacatacaacaataaaagttcaatacatttaaatttatttattcttttattaaaaaagactcgttttgttctttctaataatgaattaccttctaataataaattatctttctaataatgaattaacttctaataatgaattatctaaaaaatagattatttgataaacacttgctttctttagcattaaagccattcaaaaaagaagcagaaaggccatctaaaaggtatgttgatgaacaaacgcactgttgcatgtcatcaggtggctggttaacgtgaataaaaactaagtctcctt

SEQ ID NO: 15314 - DNA, 27970 bp, Human
caataccaacaacttccagctgctcactgctttgtttggatgacaatgatgagtagttttggaagccagtccagcacaaattctaggaaatcccagggtgcatctgtaattattttagggtcttccagaggttggagatcacacctgttagttatgaattacttccaaggatgaatttttttaaaaggctttactgttggatcggtttgaagagttcaatctccttacttttttttcttgtaatgtaattctgaaaggtaaatagcaatgataatcattttgctgaataagaaagtcaatggtcagtcctcaccagaataaatcatgtttataatttaattgtaattaagaccataatctttcacatgaagaaataatttaatcattcttagaattagaccagcattttaaaagcatctacatttatataacatcactgtatgctccatactgaagtcaaactaaaatatgaatctaacatttaagagtttgtaattttttaaatattgatgaattacatagaaaagctcaaaattacataatttgctattttttcaaataacttattttctttgtgttttttgtggatgaaataagaaagtaagaattcaggaaagtttcataataattgatagcaaatgtgcagataagtaattgagtttggaagaatttggtctgttttcattttgtaaacattcactatgtccaaactctgtgctacgtactgtactaaccagtggagatacaaagatgaattacacttgatagttaccctactgatgttaaggtagacatcgacattacagacatattcctggaaaaaaatttggtaaattgtttgagggaacaggcaataacttaaaaaacaaacaaaacaaaggagctttaggtggaccggacactggagtgacacatgataatctcatctacttttcatgtcacctttgagaacctctcataaagcaggaaaccgactctgggacattgaatctctgtcccaagttaacctggttaataaaaaacaaagccagaatttatacctagtctgtctgaaccctaggggccaaatagtcctgtattccagacagtctttgggtacagatcccagaccctctggccctgtgtttactaccatccagcccattctcaaagggcatgtgggctcttcaacttgggaataatgtttattgggtgatctgtttctctatacctctcatcctcgaggctaagagggctcagttccttaagctttcaccagctggcagaggcaactggagcagaaggtaggaagtggatttattcagctttttttttgtgtgttccttattaaatatatattgacagctccttatttgttgcggttaaattggtgtaaactctgaatttacattaaatctgtgaggtcaatttcctcatctgcgtgttacagatgaaattatccgtatattacctttcaggagtaagttgccaaatagtcttaaggttttattattccaggtcttaacagctgtgctacgaatagctgctggtgcttgatacatgttgaatgactgactagatgcaaaggatttaaaaacaagtgtttgagagggtaaagcgcagagtagtttgggtgccctattttacctctccttgtcagctgcgggtgtcaagacgggttgagggaggagagccaatgcaccccgctccaacaaagggtcagcagcgcgggctcctcggaacgctccagaagacaacccgggcgccccgttcaccctggctttccttggttctgcaacgcgacccgcgcgctcgcgtcccggcggattggagccatagaaagcgcaccgggcgcctttaaatgctaatgagagtccagggcccgactcccgagccaagtttccccaccctctcccctcgcccgcccttccctcccgggccggtgcgccgcctagaaaaacttgtgcggggccatttttggggcagtaagatcgagcgaggagcccaagagagagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcggtgagtcaggccagggagggcaggggctgccgtagtggggcgggcccagccggccgcggagcacgtgtgggcagctcgcgctacatctcccacccgggctggagacgctgacagcacagggtccccagggatctccgggtccccaggggtctccgggtccccagcgctggccgcctcccttgccggcgctcccaggtgagcgcgctgcgccctgcgctcctggcggccgtgtgcatctcccttctggttccgggccagaaagtttaggtcttaacttctgtctcccagacgggcactgttgcggattcgcgtggtggaaaatgcctgcgtttggagaagaaaggagaggcagtctgggagaggggaccttgggtagggatggatgtaggggaaggaccgacacgtgggcctggcgctttggggtccttgcttgggatctgggaaaggagagcatttcctttggggaagaggagggcgctagaaggagacggggagggaaagatagaaaagcttcttgccaggaagggtcaggtgtctgtccctgacgcccttcccacatgggcatgggaaagacgccatgctcctgttggccacatgccagcaaagagatgttgcaatcgtctccgggaaacttgggtcttagtcccacgtcttcctccccctctctgtgcccacggctgcaaacagccattcagtgtccaccaatggctacacgcttccctcttcccggactgtgggaacgcacgtggtgtagcagctgaaaaaactttgtcggaagtgggggtatgacgttagttcaaaacattgttaccttggcacttgtaacgtaggaagggaaacaggaagatgaaatgttgagatttgggggggcagtggatggaaagggtttctgtgatggttgttggtttagtcacataacaagcgttcttttcgtaagtaacgcccctgtgtgagttcttaaacgcttgcaaagcaggtgggtggtgaataacctccctaaagggtgtgtgtccatatcgttcgctcttataaacaggaacgttaacagatggtgtaggatgcttcggagacctcttcactatttggggtggggcatgtttgtctcatctctctgagccctacttcccctttgggaagaaagttgagggagcaatgtgagagaagtgtattcaatattccccaccttgagaggactattttcttgttttttttttctagggcttttactaagtccctaccaaacaacatgctaattgtaacctgtgtaggttaagaaacaaaataggcctgattttgctggactaaaagttgcttaaatctagtcagtagtacattgtgatgttgtttctagcaaatatttcttggaacactttctgccagatgtctgagagagaaaaccttgtgttctccaaagcagtgttaggataacattgttaatgataccttattttgtagaaagcttttgcggtttttcacttaatcctgtactgttctgagattgggaaagcagatactatctttaaagatgaaggaaacagataaatgaaggttaatttcctcaagcaactgcctctgcagatccctggtgatgagtctgatgccttttatctttccactcttactgcgtctctctaaaaatgaaggacagccctttctacgtgacacctcaacactgtttgtctctgtctagtgtgtcctgccatcccctttcctttgccaagcaaacacatagatgcctaagatgtactaggcacaatgctgactaaaatggatatgttctagtatttgcaaatgggccttcacttgagtttataagcacataggccaggaaaaatagttttcatgagtgcaaaaaaattttccttctgataaatgttatggaaatctatggtcttcctccccaacccttccccttagtgtatatgaagtgggtttatggtttaaagcaagacgtgggaatgaatttgatcataagaagtccttggagaagtatttgcggaattacgaaacttttttaaactacattggagagtaaaaataaccttcagcttggattgaggttagacctgagaattatttatcatctttttcctttattattagtattgtcattttaatcaagattattccttcaacaatgctagatattaaaaacagttccagtctttatattttcccaggtaattaattttttgggcaaatgaaaagaggcactaaacgcatattatttggaatattgcctgacttaaatgcatataatgtatcaaaaacaggcctctactgtgtacatttgcatcgaaaacatcaactgtttttttctcctttgccttgctgctccaatcagagtggcctcaaacgtaagatggcctgggtttgatctctcctttggagagatgagagatctttggaattaaagctggagaatgcctcatcagtgtagactgcataactttggagatataaagacatgttttttttgttttggattttctttcccccaacaaagagagctaaagtattttcccaagtgtatcagtctagcaaacttcagaactacccctgcctacaacagagcaagtcttaattactattttagttttgaatttaaaagtgaagccttattgtttatccttggaaattataaactttgtatcttatgaaaagacagtatggattgatgttaataattactttcattctctactgaggcttttttctttattttttctttaaggtaatctattatcaggtttcctgtttcattgagtctttataattgctttttgcacttcctgaattgagacaggggcatttcctagaagtactgaatttgtcattcataattgattccaaagatcatatttgaaatagttgagataaatataaacctacaaaatacaagttacatgaagttttattttgtttagattccttctctcaattctgctaaaatcaggcattgtagagaagtggtcctgctcatgaggtagagacaaccattatggtaaagagggggattttatggaaaaatgcttaagtttgattcgcaaaactgtagagagcaaggtaaacaaagaaacaagcccaaattcatcatgtgatttgaaaagacctgttatatcacgtctcagagtggtaagtacagaactggattgagacagcagcagttctataattattcttgactcctctgatgagctcccacttggcgactggacaagttgctttacgtctttgtagattgcctgttaacaaggagccaccttgtttctcattaaagtttgcctaatatttccaagtatgaaagtgatgtgttaaggtctttcactcttttattgtagctcctattttgaacttataaaatttgtctaggttaaaacttggaacattcatcttgaacattctttttttccttcagtgtttctcgattttaatgattacagaattgtatagacttataaccactccttatcttgcgagtttcctgaaaagttgaataaggaagaaaggtttagtcttctgaaaagtatttccttatgagatcttggcttgctccattttctttttctaaagtattttggaattaagcttttaatggtttctttaggtatgtttaggctttgtctaatgttatcaagatcttagtgatatgagctatatctctctgtaggtcagatactaatttatctgcttaatcctattttagccaccaaagtccttggcactgtcaaatggttcaacgtcagaaatggatatggatttataaatcggtatgtgtgtgcgtatatttgcatgttttaagtttatacttacattgtggcaccaggagttataaatcccttagccttcattaatggcttatataaattttttaggtttctaagcactgtaaatattctcatttctaagctactggttgttaaatattacttaaaatacatttccaggacactaataaataacttatttcataaaatctagtcattaaggaagaaaaggagggggagataaaatcagaaatgggaagggccttaggataaatgagaccatatccataatttcacagatggagaaacggagtcttacactggttaagcagctttcctaaggtcacccaactagtgagtcattgagctggatctttaactcacttctggtccagtcctatgtagaaactgtaaactgtggtaacttttaaccgtacaggaatgagaacataactacaagatgctgggagtattatgaggttttcacatgatatcggcattttctttgctttcccaccccttcttaaagtcctccaatttcttgtctcctttggtggggtgggggtggggggctgttttaagtttcagtgtaaggagagcctagttcacagctgtgccctgtccttttaactgtcttgctttgcttttgctgggaggaaaatctgaggctctgattacacaccatgtgattcagaaagagacagaggaacgggatgtttctgtatgttgagtctgtgagcttggatctaagcactgtggcaatgtggaggaggaaggtgggtggcctgtggagttagaaatgtttaacaaggattttaggtgtctgaattgagtgtagaaaataagtgaaaatatatgttgtgttttgaggacttgggagttaaattcataacacataggttcttttaagtttttccacatacgtactacctttaattgtgagctttttgtctttcaacagaaatgacaccaaagaagatgtatttgtacatcaggtaagagggattataaatactacatttgctatgtgaggagagggtgtgtaatcttctgtcagccctttcccaaaagtaagtcctatggattattattttaatctaaactctttctgtgatttattttgcaacaggagttcagttccacattttaagattggcaaataagttcttctaccccatcatattaactgttttcaaatagttttatttttgcagttgtataaagtgatatttggttagaccactttctaatttttaaagcctttgagtccttagcaaaaaaaagaaaagtctgtttcccttttagcatcctgttctcctgatgtggttcctccttagtgtttgcctggagccaatctggcttctgcctgggtaggtattggttaaagctcctctgtcagagcagctctcaattgaagtaaatagcgcagagaagcagatagtaagatgagaaaacttccagttcccagggtagccctcactcttgttaaatgaggcatgttaggacgtgtccaggtcaaaagctgcaaattcccttagatttgcaggaaatagaggaaatgggtaagatatggagcttctctgctataggtgcctcagtttttctttgctttattagcctaggatgttatttattctgttattaatatgtcctagacttcctttataaaataggttaagagaaggaatactatccttagtgttctttttgtttatttagttttcagtgaattgtctgaaatatgcgttctcagagtataacaataaggaagatagagcagcaggtactaatgccagcccattctcttgcagtgcagaaatccagaatacatctgattttctgtgtttttgtttccttctgtttaggtttgtgtgtgtattggagtgaccgtaggagttggagatagtggtatctagctgtggtttctattgtttatatttctacttgactggatatatctcagttgcatttagataatttgagtagatttattttgttcagatacagtgacttttagggtcataatagtgttgtttataatacttggaggtttgaggttaatagaccttttagggtaagaattctgaagactgctagagtcaaggtcctcagaagttgctgtattggtggctggctttattagcctgtgagtatatgacccgattccagcccccgtgaggttgtgtggtgagtcacctcaatgtgttgaggcttgcccagtttaacaggaaaaagggagcgagccggcagggaggggctgtttttggaatggctgaatgttcatgctgcgtgcctgtcctgaactgccttttttcctctatgggtgaggtctctgctctgttggctcactatttcttttccctcctactcagagttaggggacgggctggattacacatgcttaatcgctttataaaataaggttgacctagttccatagaaacgcaagcccctttaactgtttagagataccagccaaagaaatggaaatgcatggcaggaattattttctgccttcattgatggaacaagagagagcagcacctattcataagcagatatttaggtgtagatgtttaatgaagaatagcatcttcactaaccttttaatgtattatcagggaatgtaggatttgttgacatgaattgtgtgatgggagaaaagttgaataaatatcatataggtagagtacagggatatgaattccccctcctccacttcccccatcatccctggggctgttacggttgtgacttcagataaatcactttaactgttagcctcgtgttaactcatctgcaaaatgggaggagaggggggaggccagattattactaatacgttctgattcttgagataattttgtttactcgtcagaaatatttatccccttggcattttaatttgtttttctttatcactgcctcctttcctcctccggagattcagagaatctctgaagcttaatggtttgaggtaattaatacatctgatatgatcaggtgatcagcctgtaacagtagtgtgtagtcactgcacacactgcagttatagaaaaaacatgttctgtttaatccacctgtcaagatgaatagcacaaatcaaggaagtaatgtggaatatagttttatagtgctttcttgttgttgtgttggagatccaacttagtgggagaatggtggaaaaataagaatcggtcaacagtttcttcaagttcactctggtgtacttgaaagcagtgaaatctgtggccaatattgaaatatacatcgaataaaattttctgttctctttccagactgccatcaagaagaataacccacggaaatatctgcgcagtgtaggagatggagaaactgtagagtttgatgtggttgaaggagagaaggtgagaggaaattgtggttgggtatcaaagtgctggcacatagtactgttgcacaataaattatctatcagccccttatgaattgacatgactttggaatttttgtacaatagcaggaagtgacttttaaacagaattttttttttttttaagatggggtctccctcttgcccaggctggagtgcagtggcgcgatcttggttcactgcaacttccaccatccaggttcaagtgattcctctgcctcagtctccctaatagctgggattacaggcatccaccaccacgcccggctaatttttgtatttttagtagagacggggtttcaccatgttggccaggctggtcttgaaactcctgaccttaggtgatccacctgtgtcagcctcccaaagtactgggattacaggtgtgagccaccacacccagctagcagaaatatttttgacattgtcattataaacattctgcaataaagatactttaatttcttatttaataaatgatcaactctgattatggaaagaaaagctgatttctcaatttaaaaataatttatatttttataccaaaggtatgtatttcgaaatgcagattaaaatttaactatcttatgtattaacaatatattaaaagtgctttgcagctgggcgtggtggcccacacctgtaatcccagtactttgggaggctgaggcaggcggatctcctgaggtcaggagttcaagaccagcctggccaacatggtgaaacccgtctctactaaaattacaaaaatatctgagtgtggtcgcactcctgtaattccggctactcaggaggctgaggcaggagaatcgtttgaacctgggaggtggagtttgcagtgaactgagacattgcactccagcctgggggacagagcaagattccgttttttaaaaaaaaaaaaagaaaagaaaaactgctttggggcaaaagatttcttttatcaaagtaaagttttcaggctgacttgtaagcacttctacctacaaataatacatggtaaagaatattttaatcccaataaaaggagatcgaaattgaatattaatcattttgttttctgtttggcttggattttgggaagctgaaggtaccctgatagaccctaagatagcttcgtccgggtgaactgaatccaagaagttaagggattttcctgaagactagctacagaagtttttaatactgttatatatttaattccgtgtctgtaatgccctttatgctttgtgtttagtctgttatagatactagtaaaacaatattgagtaagattaaaaacacgctaaaactacatatagcacaactgccatggcagctaatcatggcagctgaattataaattaactggatgagaggttaactccctgtatgtgctcctcccatatacacatataccattccataggtcatgttcctaatggctctcaaaccattgtgttttaaaagaaaaacaatttatttcattggatgcagaaatttaagtgattatctttaccggtgtgatccccagggtatcttgtaagtcttttagattttcaaatcactcaccagcacctgccactctgtgaggatctctgatatcccatccaatttttaaaaaattgttttgggttgatttttcttctgtatgttttcagaactcagggttttacaaagtgatgtagggtgtgaaatacactctctgaaatcttcttggtctacatttttttaacatttttgaaacattttccatttgtccatatgagaataagaattctaaatctgtttcaaggataataggaaaggctaaagaaggactacatgtgtggagaatattattcatcaaagaccctttcttcttgttgctgccaaaataggagaagtttcactcagtacctttgtgctggacagagaatcatatgagcccatgaatagggattgtcctcttggtacctcctagactaacataggtttcaacacattctaggaaaataacagtatctcaagtctttcccattgaggaatattcttcctggtctagcattgcttctactttgacagttgtatatttgctaatttatgttctttaaagaggttacacattgcttttgcgattgacattactagacaagaaagcaaaactcaggttgtatgagcaaacaagccatatatgtttaaatcaggatgtgaagtaccttgctcactttgtttaaaacctagatctgtttttaaaatcacagtgggaattcttagtatgttctgccagtcttatactctagcagtccaaggctgttttttgagttagtgtatattctttttaattttgaggccatctttttattttcttctcagggtgcagaagctgccaatgtgactggcccggatggagttcctgtggaagggagtcgttacgctgcagatcggcgccgttacagacgtggctactatggaaggcgccgtggccctccccggaatgtacgttgtctctgttacttaaccagtgattgagaaattgttcatgcatggaattaagtgtatgtacttggagcagataaatgccttgtcttctcctggagacaaatgatttaagtgatttttattttttctttagaggaaatttttatcttattttttaaaatgtgtattattgatttccataggtttttgggaaaccggtggtgattagttacatgaataagttctttagtggtgatttctgagattttggtgcacccatcactggagcagtatacacggtactcttaaggggaaattttagcgctcagaacttttccagagccgctggtctcattagacacttgccattcagaagttgtatcagttaggatatatttggctacaagtaatagacatttaattatcttttaacaggaagacttaagggagacagtgctgaggttttttttaacaaggtttctcttcatttggctcttttttctggccagaacctagtcacagacattcactggcaaaggggaatggatttccatcattgacttaaccttgttgttcattctttggtgccgacactgttgacctctaagaaaatcaaaatttggttggtgaaagagtgagaaataacttgtgaacaggcaataaaagtacaggccacagaactattaacgaatttgccttggttaagaggctgttttatttagcatagcatttttccattatttcaaagtaaagaagcaataagtgattctgtggatttttagttctttaggttggtttcaatgcaggggaaagagtttgtcacaaatctggctggagctttcttgggaggctcagtttataggagtattctcaaggcacccaaaacggacccagtatatttgtggtcatgagaaacttactagatttgaatcattcttggtgtttctagaattagaaccaggtattggcacattgaagaaaactccgaatgtttgtcagcacaggattgtgactgcctgtctcatccaaagaaaaactcatcagaattaaatatctgcagattgagaatgacctatctttatgttttgatagctttatatctttctgtttacctaaatgcttttcctctttattctgccatcatcacatcctgcccaaattaattctgtcagattccttaggacttcccacttgtttctttgtttttgcttatcttatttggtttttaataagctatgagggggatagctaggaatgagctgctgtagcatttcctacatcatgttctctttgaagttcatcagagtcacagagcgctaactgtgattattttgactcccaggttaattcaaaagcaaaagtggtagaaaaacattcagtgaaaaatttttcttaaagacttttcctgtccaaaacctgaaaattccaaagtcatgcatataaaagatatttagaaacaaaattgttaaaacgcttaagaaacaaaattgttaaaactcttaaagtatacataaatgagcttttttgttgtaatatctaagtcccaacaacttgttcagtatctctcaaaagagtgtgttcagcattgctggtgccattattatgctttgtaaaactcttaaagatttgattgtgtgaaatgcaaaagaggaagataagcccaagaagaaaaacagtttatgttgtctcacacttaatattttggtaagcattttctgtgcaaataaacgtttacataattgtgaatctcatctttggtagaggttttatgaagagtagaatgacttgattttttttgaagttagactagttgaggcttttttggagggggagtttggttgcacatgtggacttgttctggaagggtccaaagcttaaatacactcctgtaaaaaaaagtaatgggtcattattttgctttttttatttattcatttttaaaaactagttacttcccattaaagacatttgcatatcccctttaaagtaagacttgaaatcacagtctttgtaggatgtttggttttttaaaatgtaaaatggtagtatatgatataatttaaatagaagaaaaatataaaatgaatcggtaaattcctttgtgaatattaataagatctattatttagaaacctccaggattagggcttactaccatcaaagtatgattaaagctttactcctaaacatataaagggagtcatgccttaggtcagtggttctcaaacttcctgattttgggatctgtttatatgcttacatgttattgaggattctagagtttttgtcaatgtttatttatattaatattatattagaaagtaaaataaacttaaaatgttaattgattaaaaataactatatgttcatgaaaataacagtttttatggaaaaaaaatatttaaattgaaaagagtggtattgctttatacttttgcagatctctgatgtatggtttaatagaagatagctggattctcacatctgtttctgcattcagtctgctgagagaccacatgtcattgtagcctttgggagaccccaccatatacttctgagagaatgcctgggaaaggcaaatagcatcttagtaatattatggcaatagtttgacctcgctgaccccctggaagttttcagaaatcccatccacactttacagacttgtaggaagaataccacttgggtcaaatatgttggtaacatcataaaatgtattcttttttggcttttccctgacattgcctcagtggatggtaaatgctgggagacacgcatttgatggagcaaaaattataaaccttgcagatactcttcgggtggttggttagctgatacgagttctaatgagatgactattaaattgattgtagattgattgctcttgcttttctgcttcttggtattttatctgcacagatctactctaatcttaatgtagtttatcccaggcaatcacatgataatctgggttaaatgcattttgtctgtataatggaaaggattatattgctttggggagattttattttggtgatattcatcctaaatggtgttctttggttctttccttgctaaaacttcttctgaatctctgtttctttgcttcgctagtacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggtaaaattgcaactgagacttctcttcagcaatcctcacccttccgtccttctctgcctcctcttcctcctcctcctccaacatcagctgccagaaaccttgcttatggcttcctgatgctacaaaagctgaggcaaggccttcagtctgttttttcaaagcagtcattccggtaacacttctaaaagcaaaaccacgtgatccatgcctataatagggaacccttatggccaaagtttctagttgatagaagaacaaaagaattaaggtaacaagacaggtggaatgtgtaagagcttggactctgaagtcaggctggatttgaatcctgtttctgctacttatttgtgaggttttgagaaaaccaagttttagattaagttcatccattaagtgggggcattaaatgcctgcaccatagggttatgatgattaaatataaaggatttagcaaaagagatgcctgcagcataaataacatttataaagtattggttttaaatgagacagtgctgatttttaaaggcaacctaccagaatggaggttgttgattattgattctcctttttcactgcagaatattagtacagctgttttgagtttgttttgtgcttaataaaccttacatcaattttgcagttcctagggaacttggaaaactagggatagatcatcatttttgttatcagtagccacaacttttttctcctcagtgtcgttggggtttcttttttttcccctcaccgctagatgttttgaccgaacattatgttcagtctgttctttgctacccttctcctgtcccatcatgcatgactgtgttctttcttgtttttttccttctactcttcaacagctgcccctgacaaatgtgctaaaaataacaagtagacttacatatatggagagattgggtacatgagacatagtagctttagggcagcactctgggcttctaggaaacaaggacaggaaaagtcagtgagattgtaatatgcacttatttttagcgtcttaatagtgctttcctgaaatactcctccttagtgtttggcttatacaacatatatcacgtttgctgaaagcatgatgattctttttcatatcttttgaaataaaatgtatttcaccttaggaattgaagtttcagagcaaagtcgttccttagtgccacgtaaaacatcatatgcagaagctaatcgaaagctgcttttgaacatgtacgcttattcctgtaacttaactgcatttagttaattgactgaatggctgactttcctacctattccatgtcagaagtaaaagttgtcttgatcctttaaaccatattttttaataatctttataatatctactagctctctgactaagtagtctggttaagccagtcaagagcatcaaaagaaaattcctaaagctctcatccatataactaagctacttcaaggttgtcagtgtgttctcttaaaaatatatagatggatctctaggatagtaaaaattattgagatcaaatataaaagtcttcgccaacgttttctactattacaacgctatgaaatttattgggcataatagaaaaaaaaaataggaatatataggccagtggtatttgccttatgcactaaggacataatatagcatgatttattagtgactgaataacttccatttttaaagaaaatagttctatagatttgaaaattaagtagaatcattcactgagctactatgtgcttgttgtctttgagaaaataattatatgatggagggaagggagcaacattgtggcatctaccaggtgacagatatttggaatcggttcttactttagttgtctctagagcctgagggaagcagtggtttccatattttttgttgttgtcacaaatgaaggaatttgattacttttaaaaatcagcaacttttattttacatggacaagaagtggtagaacttaattttaattcattttgttcttgtcatccagtctttctggcagactctcatcctttatacacgttaattgctgtttctgtcagtctttttttgtgactcaacagtttctgaggaagaaatggccgagcttacttaggaaactaaagagaggctcatgtgatggggatgatgtgaatgaagggggagagggtatgaggtgagatctcaggggaggtcagacatgctggtagaccactgtaaagacttgacctactgtaaatgtgatgagaagccagtaaagggatctcaacagaaaagaaacattgaagagattattggactgttttgttgggactagaccacaggaggtaagagtataaaagcagggagaacagctgctataatcttttcagtagagaaatgaacatgggttgtattagagaagctggcagtggaaggtctgattaaatggttagatttggaaaatgttttaagcatatagaggtgttggcatttcatgatggattgagtgaagagtatgaggaatggtaatatattgtatgaggagtaaataatacctctgcagttttgatttaaacaaatacgggaatactgaagaaagattgggtttggagggaaaggcgaaaattctttggaggtctttttctcatattaaattcacgtacaagtggaggtgttaagtaggcagaagaaataaagcagagggaagaggtagaaagtggctggaggatggaaggtgtagtcttagatacagtggttgacaacatttttgggagttcattaagttgtatttgagaagagacctaaatggagcaagggatcaagtccatcaggtcccaggaaaggcgtgaatgggagtctgaaggggagaaatggaactgcaaataattatttggaattatttatttatttatttatttatttattttttgagatggagtctcactctgtcacccaggctggagtgcagtgacacgatctcggctcactgcaagctccatctcctgggttcatgccattctcctgcctcagcctcctgagtagctgggactacaggcacccgccaccacgcctggctaattttttgtatttttagtagaaacgaggtttcactgtgttagccaggatggtctcaatctcctgactttgtgatccacctgccttggcctcccaaagtgctgggattacaggcgtgagccaccgctcctggctgatttggagttataaaacaggatgtttaaagccgtaggggcaggatgatattaactataaagtgagtgtaggtggaaatagggtcctaggatcaagttctgggacacaccaacgattaaagattaggaagatgaggattgtctagcaaaggacagtgagaaggagcagccaaggagaatgtatttcaagaaagaaatgtgttaaatgcttgttgataagtagagattaagctgagaattgattattagatttggtaacttggaggtcagtggtttggtgaagacaaaagtttaaatagaatgaacttaagaaacagcaaagggcgggaagaggagacatattccccattgaggtttctgtagtggtggtcatggtgtttggtttttctttagtatgtatgtctgtaaagaaatggggtagtagctggaagaagataagggatcagagcaagatttttgcttgatttgatttgctttttacaatgcagagttacccctggtctctcccttacccgttacctcaccaacaacttctaaagccattaaatgggcagatcaaggtaggcacgtgtgtttgccataaacccacatatatatatacacacatacatagacacacatatatgtgtaacattgtgtgtgtgtgttccatggttctgtctactgaaaggtcctgaaagccgtgatatcttagtaacagcattgagcatacctgtcccccaattttttgtttttaaataacattctcaaacaaaaagaattccctttggagaaatggctgatttcagagctgggacagagaaagtataatatgagcctggaacatcttgttgtgccagaaagcgaagaagtactcaaagaatgttggaaacacatcaataggatatgagccagcttgaaggggttcccattggccagtaatgatagtaacagattacaactcattgaaaaaaatagaaaaccatgagtccatacaaatataaataaataaaccaatatattgaaaaatttgataaggaatagtatatttatgcactttgtaagtacttcctcacaaagtactcattaattacaaagaaggaaagagtcaacttacagtggaggactctggtggcagataccaccttaaccacttatcaaagtgaacattatcagtaatggcacaaattgaaactatatgccacctgacaggatgcagtgaggagaatgcagtgtcacttttgtgacatccccctggggatgcaaaaacaatatctaatcattagtgaacaccaataacccaagttgagggatattttacaaaataactggtttgtaatctttaaagaagtatcagggtcatgaaaaccaacgtggtggctcatgcctgtaatcccagcactttggaagtctgaggtgggtagatcacgaggtcaagagattgagaccatcctggccaacatgatgaaaccccgtctgtactaaaaatacaaaacattagctgggagtggtggcacatgcctgtagtcccagctacttgcgaggctgaggcaggagaatcgcttgaaccagggaggcagaggttgcagtgagctgagatcgcgccactgcactccagcctggcgacagagtgagactccatctcaaataaataaattaaaaaaaactgctccaaacaaaaagatataacttactttagtgcataattctaaacggtgtttttgctataaagggcatcattgggataaatggtgaaacttgaatgggatctgagaattacatttaacttttctgtaactttgtgcttatttcaaaattttaaaaaattgaaaaggatgggtgctatttcactgggtatatatgcttggatggaaatgatagaaaaggtgaaaacatagtgaagggatagcgttaacatgctgtgtctagttgatgagaatagagaggctgttggtttcagatatgaacttggaccacttacccagggtaatgggagagaagaaaattctaatgtaaatacagggagctgggtagatttgctaatgagaacgtggaaattgtcttctgactgtttctctttcttgatgaaataatgaaggacagtatttggctcttagggggaggaagggatgttttgagaaaagaaaagaaagttgagttatggctgtatggtcaagaattgcagacattgttggtgggtttttttgtttttttaagttgttctttctttcccctggaagttgtacaataagttaattttattccactggcttaaagtaagtttgttgtaaagaaaaataaaagagtattttatttaaagagatgaatgaaatgtatccgatttcaaaatgttaaattgataggcgaaaataaagttaggtgctctgggactaagcaaatgagtattctagtcagactaggtttgtcttccttttcagtcgttcacgaagatttactcataaatagtttgtgttgcaactgagagtgcctaattttgtaatgaagcattttgttttttacttctaaaaaaaattctgaacatagctgtatgcactgtatcttatcccctgtgctgtgacactcactgtcagctctcattgcctctccaggctggtgagattggagagatgaaggatggagtcccagagggagcacaacttcagggaccggttcatcgaaatccaacttaccgcccaaggtaccgtaggtatgtcgcattttccactaatggccagttaaaggacttgtgtgcacaatggtagaatgaggactgtgtggttccgttttgtggatttattatatatctagaagatgtgaatgctttgactacatgccagagttttcaggtggtggtgtgacatttcccacctacttaatactagaatttttagttatctctgcgccaaagcgtcattttgtattctggaattataataagatgtaaattaatacttaatttttatcaaaataaatcagataaattattggtgggcaattctgtggtaatgctgcagatggaggaagaattgagtgtcagaggatatttgggatagtgactgttaatcactgaggcagtccagtagaggggttaaatcagggtatgatcaaatcgcctgaatttatcttcctactctacagttcattagatgtatgttcttggactgcattccagcctgcgcaacagagtgagaccctgtctgaaaacaaagagatattctatagttggggattaaaggtactaatgcagctaagataattagtgtggtacctgataaagtaaaggcctcactatgtattagatattattaccaccattgaggttaatattagtgaacgctgggttattctatttgtgctttattcctttggaagactgaattaggctagactccttccataagatccctttgaagcattttataatataagcctgcccattcttttatcttaccctttgtggtaagtggaaaagctacaacttcttcctgaatgatgtttatgctaccttgaaatttgtcagtatggctttattgaaggataaaaagtatattatattgggaaaggattccaccaatataattgtaaaaggatcgtatcctttttcttcacaaggttccctccagctttaggcataatcactaatgattaagtactagggactttgaaaataaaagagacggcatagaaatgtcttactggaacaaaaaggattcagtagcgtgtgaggctcagctttgtcagtccctggatatgtgatcttggaaagtcatatttgaccttttttaacctataaaagcagcacttttatatagctcagccgtatactttatcatgtaaacctcttggttttcttgttataaatctcatccacagaattaccattcaaattaaatatttaattttaaaaccgactagcacaggctctggcacataataatgtttcttctcatgtttaattcccttagtctctgctaaattctgttcatggaaggcagataccagactactcttcttttcttttttaattttcctattcttagtgcttatcaaagggcctgataggaacagagtatgtgttcagtatatgtatgttccttacaaatatgtattcaaatgaaaggggaaaatgatggaaaattaagatttttttttcgtgaaacctctattccatttgttgcattgacctgcgaataattctagcaataagtactcatcacttgacttttttttttttttaattttgagatggagtctccctctgtcacccaggctggagtgtgccaatctcgggttgctgcaacctctgcctcatggattcaagcaattcttatgcctcagcctcccaggtagctgggattacaggcatgtgccaccacgcccggctaatttttgtatttttagtagagatggagtttcaccatgttggccaggctggtctcaaactcctgacctcaagtgatccgcctgcctcagcctcctgaagtgctgggattacaggggtgagccatcatgcctggccctgatcacttgactttttaatttttaaaaataaataaaaccttattttctggagaagccctgtcctgttggcacctgttctattttcttctgtgttccctacagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggtaaatccaaccagtcagggcggatgttgccagatagtctttaatcatgtcagactttagcattctaaaagtggttttatcacatgaaacctgacacttaacaaatataaaaacattttgctcaagatccatatatatagggtatgccttgtacataacacagaccacatatttgaatccagttaacattctctgaaagaatgacccatattaatggggattcagagctaaaacatttggggttcttcaaagaagagaggcatttatcaagaggaagctgcctctaagcatgagttgaaagcagttgtatatcagactttatggagagtagtggtatttagttgccgttttgtaagctgttcttatatggtactaattttgttttgttttgttttttgtttttgtgaggttttggtttcgttttgttttggtagagatgccagggactgaatatggtactaatttgtgactcatacttaagagtagttaaatttttgcatgctaattttccttcacaggaaaattcaaacttttaagaactttcagtcttgaactttccactgtcatctgactttatctgatttatggctttgttttgcattttaggccaaggcaggtgaagcaccaactgagaaccctgctccacccacccagcagagcagtgctgagtaacaccaggctcctcaggcaccttcaccatcggcaggtaagagctggggcagcccagtcttgagttggtattttctttttagtatcactggtttctcaacaagagtacaaattagtctaaactagttctgcagttcatctgtgccaaccccttgtctctattgggactctgtggaaaaagtgatttggtggttaaatatttctgggattgacctcattttgataagctttggtgagggtataagcattcagacagagttgatgatactcaacttcttttttctagacaggcagttttttaactactagtaccacttaggaaaactgatgctaaaagtccctaacaaaggcctggttttagtaatcagaaacagtttcagaacctgtttagtaatcagaaacagtagaataaactaaaggattttttttccttccctttttctttgataatcaactttatttattttgaggcggtgcagcatagtgtataagagccaaggtttatctacccattgcaggctctactgtacctctcatttgctgggtgatcttgagcagtttatcctctgtctcagtactatctgctactggtaaaaattaggatactaattatatttactagggtcgttgcaaggattattaagtgaaataacagggagtgtttacaatagggtatggtaaagaataacctctcgtaaaaggatagcttgttattttcttgtcattttctacttttttctgtcttttaaaggtcttggacattttatttacatagaattatagccagaaagatcaactcaattataaattctgggtttgtttttttttaacctataacccttttaactgagactttagttcttatacttcttggttatcaccctttccattagcttttagttaagagagaggttgtaaactcagtgtcaatgctatttttcaaaaattgttaaaatttcatcaatgaagttttgggattattataagttcttgtgtcttaaggccatctgcttttatatccagtgatgtgggattttaatcagccattaattaggtaagcattcactttgaggacaatattctgttttatcttgggtagcatggacagtttgtcacagaaataagttccctattcaaacttggaattagctgattcagagtaacatattaataatataaaaatggccatacccttttatggcgtaacattatttctaggtattgtttctaaggaaataattttaaatattgggaaaaaatatttttacaatttacagtctgtctgacatttggtaaatagctaattgtgatatattcatattaggagatagggtgcagccactaaaatgattttgagtattgttcattagtaatggtaattttcttttatacaattttataaaatttttgctcttatgtactgacttttctggtttataaaaatactttattaaaaagtgagagtttccatttaattaacatatagcttacagatctatacaagatgtgattgtatttagagcatttgaagtactctttttctaattatatgaaaagcatataatttctgcctttttattctttaactcatggttactttgtcactctttataagtttgattttaatttttcccaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagaggacagaatgtttaatgggagtgtatttttgccgaccttagcgtgtgtttgtcttctccaccacttgatttacttgacttgattaatagtaaattcaaagccaaatgtaaagttaagttaatgctgtttcacaaatttaggcatataagcttgagatgataaaaaattggattcctgttgaaatgtacagctggaaattgacaagttcatgtctgagttcagtagtaggcatgaattatttggtactgtctctttttgagtaatcttcattcagtgaggtgacgtgatgacctttagattaacgaaggagttaatagttctaacatccttcaacttccagcctgaggtttttaccagtaactgctgtgttgtaggtatacaagggagctctttacaactacatttctccccctcccagccatggtgcccctaagttgagaaaaactatcgcagctgtcagtgccgtatagttacttttcagaactgctgcagcagtacatatccagtgtaggtttgtgctaaacattattctagtggctaggatggaacaaaccaacaaaataccattgtttcaatgaccaggtacatacagaaaataaacaagtatggaatttaatttagatggcaataagtgctgttaagaaacataaaacatggtaggaggacagggactggcataatcataggggatatgttgattttaaatagtggggagggtctcctatttaaatggagtcctaaggtgaaggggcattaaacatttgagtatctgcagggaagagcattgcaggtggagggagcattcttggcctaataaatggcaagcaggtgaatgtgaactgttcaagaaccttgtattatcttgcaagttaaaagggttggtaaaaattggtaataggccaaggcaaaaaaaaaatcaactattttattctattaaaaaaggctcccatcttggttccagtttcctccaggcaaccagttagcatatcttaaaaatagacccatttcacatatttcatgtgtgtgagtctctgtgtgtgtgtgtgtgtgtgtgtatgtgtgtgtgtgattggccgactaatgcaaatttgagaagaggaaatgagcttaaattgtgcttatgttaacaacttaaaaacaatcattagacatatccatgtttaaaattctatggatagttcaactatactatttagccagtcttctttttcctaacttccccttctctcttcctgctcactttaaagctattctagtatagaatatttcaaacatactttttaaaatgtttttaaaatgtacgtatactttttggcactgattttctttttcacctaatatttttcctatagagtcctctcatcatttgtactgactatataacattccattacatagctatccataattgtactagccttctatcatgggatattgagggtatcttaattgccattgcaaacattttgcttgatataatcccaacatccttacttctaaatactgtcatctgtttcaggatggtagctattctatttctgggaaaaaataaaataaaatggaatgatgaatgcagagttggggaaaacacactggttgtaggtacagaaataacacaaattggatgtgatgtgaggatgggccaaaagtatgttattttactggtgagggaccttggattgctttatcaagaaatacaggctaccggggtgagaccacagccagaaattaactagaaggctatctgtcatacggcaatcacaacttaactctgt

SEQ ID NO: 15315 - DNA, 25552 bp, Human
ttcttactgtgttaatcaggctggtcttgaactcctggcctccagtgatcctcttgccttggcttccggaatgttgggattgtaggcatgagccactttgtctggcccagcataatacaactatttacataacgtttacatggtatatagtattattataagtaatctagaggtgatttaaagtatgcaggaggatgtgcataggttagttgtaattactgtgccattttatataagggacttgaacatcccaggattttggtagggaggtttcctggaaccagtccaccatagactctgagggatgactgtactcaactctgctgatgtagtgtgaaagcagacaatacataaatgtagtgcatctgtgttccaataaaattttatttacaataatagggtgggctggatttggccacatgggcatagtttgtggacagctgttttaaagcctttggatatagatgttcaattgattaaagacacgagaggaggagatgctccagttatctgtaaccagtgaccgttaagtgtgtacacttatcaaacacttaaagtttatactaaatcaaagttcttccagaaataggctgggcgtggtggcttatgcctgtaatcccaggattttggaaggcggacgtgggaggatcacctgaggccaggagtttgagaccagcccagcctgtctctactaaaaatacagaaattagccaggtgcagtggcgcactcctgtagtcccagctattcaggaggctgaggcacgagaattgcttgagcttggggggcagaggttgcagtgagctgagattgtgccattgcactccaggcagcctgggtgacagagcaagacactgtctcccaaaaaaaaaaagctttcagaaattgtatgtatcatttctgaagactgaattatgctggcagagtacagttgatttttttctgtacttgcatgaaaattaagtcattatttgtccctgtggaaaattaatttttcaaatgctgtttagacacaaaagcaactacatttctaatccaaatgttaaaataaaaaatttacacaggaattatacaatgatgttttacattgacttaggaatccttattttcctttctaatgctagatgtaatctcatgttcaataattagatttttggtgattttttttttttaagatgaaatgggaaggatgctatcttattaatttttaaccttctctttgaatggtgctatcatcttggctttgttctaaacaagagctagactcagaagtcttcactttattctttctcacctccactgtgaagtaaagaaaaggaaactccaaagatagtataggctagtattgttgctccacagccataagggatccaggactcttctgttttcctaactcctttttctttagctggtggctttcattctctaggatgcctcctggtccagtgtggctgctggagcttgagccatcacattcatattctaagtgggagggggagagggattaagataaaggcttcccagctatctaccatcctgttaaggatacttcctcaaagaaatacagcatttctgcttttttatcttgctgtcaaaatagtgtagctaaaggtaggctaggaaatgtagacttttagcttggtgtgttgccatctcatataaaatgagaatgttgttactaagaaggaaaagtaaaatcagtagatattcggttgaatgcacgtacttgttgacatcacattccccaaaaacctgcaaaaccaattttataaagcttcaaaagtataaactttacatttgaccagatgcttttaatgaaagtgtaagcacttccagtgtgtacttgtttacatatgaagttagaaaacggaattaccttttgaatttcctatttcatgtctttgaaagagatactaattttgaaaatgaattttaagtttttctgtaactttttttggtaattggtacatttgaaccttggtgtgatactatgatattatagcaaagaacagtctgaacttgatcaagatttggatgatgttgaagaagtagaagaagaggaaactggtgaagaaacaaaactcaaaggtattactttaaattacttcaggagccagtgattgctggcacatgtctactagagggtagttataagtaccagtctatttttttggacccttgctcattgtcccatttatctactggtccatacttctagtgtgtgtgtgtgtgtgtgtgtgtgtgtgtgtgtgtgtgtgtgtaaggggcgggtaggtatagatacagcaactcaattagaagtcattgtttgcatcctgcactgttggagtgacttggtgtacttgtgtcaaacagctgcccatgagttttgtctgaatttagaaatgttacaggttgtgatgtggtgcttataacagtatgtttagtgtttaatatatggagaacatgtagtgtgtgtctttttaaagatccactccttcaagcagaagagccatttattaaatgtaggtaatattcacaatttattttagcagatatttttaaaaggagtggtggtgggggattgtactacttagggtatgtcttgtagatctgcgccaagaatattaaggtaccagatgactcagcttttcatttttaagccggatggaagttaattgtgaaaagacttcagaacttgtattaatagcttcagcttttgtttagtaacattttcttaacagatacagaactgtatcctcagtgaccaatattgatatttaaaaatctgtattggttatcctggctgtgtgtacatcatctagtaattgaattattatcagaagtaaattgacctcaaaaaaagtaattgggaaaattaagtttatggcactttgtgtaataactgtattgatgatgaagagaaggttagtactgtaatttgttttgtataagtctagtgcatatttggattgagtatgtttttaaaaagccattgaaaaccacattttgtttggctttagttacagtctttgactgtcccaactattaactttattaactttattcatacacatagaaatacattacacaagcatcaaacataaacattcagatcactcacttcatctttctcctgggcctaaaactgtcagtatatttgcagttttctgatatgtgttgtctgcattcagaggactgtcaagagtcatagataggcatctgaatgaagctttgagcttcttaaaatgcaaggtgggtgaaacacaggataccaggaagagaaaggatattgttcatatagttgtggcagtggccttgagaactgtcttgactagagatagattaggaatctgaattattcctgaacattgggttttcctttagtgtattctctttagctttccctgcccgtctctactcattagatataccagcaatttatgggccagttaggaaaacttcatgagattggattgtcctattaaaaaagcataatacattttcataaaatccttctttcgatgcccttttttttttaaagcacgtcagctaactgttcagatgatgcaaaatcctcagattcttgcagcccttcaagaaagacttgatggtctggtagaaacaccaacaggatacattgaaaggtacaacttttccatagtccttatttatctttctataatcaacgttgcaggcgtatctatttttaagaccatctaggatttagatatgcaatagtggaaacctattgtctgttagtatccagtataggattattagaagtttaaaattgtgcttagtaccacctgtttgcattggtcttttaaagtttatttattgtggttcaagtttataggaagtgtactgatcttgagcatttcagagatttgtttagaggtatgttagaaatgcacagaattagaagaaatacagatttcttatttcactgatgacataaatcattattaatagcatgaatatcttactcagcttacacatttaaaaaacttttttgtgattttaagatccattcagttactgtctatatgttaattatagttagtagcttctaaatgttgcctagttctctgtggtatgtgttcgctgtgttttattatctgcttttcctatgatggacttatttatcaacacaaattctattgttatagacatctttgtacatgtcctgtaaaggaactgtgtgagaatttctttgagatgtgtgctcagcagtgggattgccacctacatagagtgtggaagcctttaagtattaaacttctagcatgatttccagaaatactgtactcaatgcaagaagatagattcatcttcatgtctgccaacaattggcaccatccagcttcatagtgtttttgtttttatttttaaatcagtctaagaggtgtggactcattttgtcttatttgtattttatgatttctaatgagtttttagcttttctacataatgcttgaacctttttcgttgcccattggtaccctttttccactttcttgttgggattgcaacttttttttaatgctttgcaaaagtctttgtattccaaatgttattcccttgtcagtttttagacattctaaataatgtgtcatttctacaaatttatccatggagtcctctggtaaacagttaagttttattttagtaaaatattttgccctagggcttgtacttttgaaactttttaagaagtccctcctggtttctgctacatttcgtattgaatagtttcaccttttacatttaggtcttaaatccctttagagtctacctttgtattagttgtacgtaggcttccagttccttttttttctgcctcattttttgagccaggtttgtttgtttatttatttatttatttatttatttatttatttatttatttatttattttgggtcctcctccagtgacatgagctagttttttttttttttttaaacactattcactaatcaatccattgttcccccatttaggtgtaccacctaccttcattgcatatcaagttgtaaacacccgtgtttgtctttgagcagcactcttatgttttattggtctttgtctcttgtcattgtcatacttaattactatgactttatagttgtcttaatatttggcagggcaggttgcatcctttcatacttctcccccaatcatccacatttttgacagttaagtttaccagggttgtcaacaagcaaaaaaaccttaaaacgttgataggaattatattgcatttgtagatttacagaattatatcttttaatattgtctcatccacatacttctaattattcaggtcacattctgtgtctttagtttcaaagttatcctcatagagtctattggttaagttaatttctgtatattttgtgtggctgttgtgaatagcatcttttttgtattttctgtttggctgttcttgatttacagaggattgctgtttttttttttttaagttgctcttgtatccagtaactttgctaaatttattgtagtaatgtgttctgttttgccccccagtcacaagattttatctgcaaataatggcagttttagctctgttcttccacattacattataccacatacttttctttacaacattaccaggactttcactactgtgttaaacattagtattctttgtcttatttctattcatactgggaatgaatataaaatctccattaaattcagtgcctatttactgttttttaatctgacctttggtttttttttttaactgtatcaattaagatgctctattgaacttttcccttcagtatattaagtaaatagtaaatacatgttttggaaatacttattttggatatcaaactagccttgcattcctgtagtaaattgaatcatgatgtgttattgttacattgttgagtaattgaattttacagttcttacttgttagtgaaatgagcttgtgttgtgtgcatgcatgtatgtatgtgcataaagaaagtttcaggaagtggtaatatttaactggtttttggagtcaagatttcaattgcctaaggaatggagcagcttttaaaatttttcgtttcctgaaacaacttgcataagatagcaattagcagttcttagggtagaactcttctaaaaatttactttgggactttggagttggggaagtagaggtccaggggagttttggagaatttttttttttttaaacatactaatttattcaagttctctcatcagttttggagtttcatattttaaacatgtacatatttaggtttaaaattgattagtacatagtttacaatagttttaaaaatctggttttcatattctgtattttgcatcttaattctgctggttgtcttgatcttattaagtttttagaatattaattttgcttttggttttccttttccatactgtcttttgttactgctgctgttatctcttttttaggattgctctatgttattctttccagttttttaaattgaatgcttaattcatttgatttttattttttaatttgtgttttttatggccttaatactcttacttttgtaaatgttgagtgtgaagatctgtatgctgaaattaatagctcaagcttattgtattgttcagcttctctttatttctgcttattggttgtctgtttgacctgacagttttttctgtcatttgtagattgaaatattttggagccatattaggtgtatgatatttgtgatgaacatttcttgttctcttgtttcattttactgatatgtgtcttcctttgtgttttataatgttttttgggggggtcataatttttatttgtctgatattacaataataacccccagcttttatgacaaggccttactctgtgatccactctggagtacagtggcacactcatggctcactgtgatcctcccacctcagcctcccaagtagctgggagccacaggtacatatcatcatgcctggctgttatttttgtagagatgggggtctccctatgttgcccagactggtctcgaactgttgggcccaccttggtcttccaaagcgctgggaatacaggcataagccatcacccccagcctctttttttttttttttttttttttaaacttttaacctagtatgtcttttttttccatcttttcatctgtgtgtcttcctctagtatcagtgtttgctgcttttattttttggatacagtgtctcgctttgtcatccaggctggagtgccatggcacaatgacggctcactgcagcctcatccttcggctcaagtgattctcctgcctcagcctcccaagtagctgggactataggcatgcacaaccatgcctggctaatttttgtatttttgtagagatggggttttgccatgttgcctgggctagtctcgaactcccgagttaaagtgattcacctgcctgggctccccagagtgctgggattacaggcatgagccaccacactcggcctcaatgtttgcttctttattattagttgcatttcttagaagttgtattgtttttggatttattgctgccatctttctctattttttaatttattttactttgggtctttcttccttcttttctgcttcccattggatagatcaagtcgccttctggttccaaagttaatggcattgatttttgttactatggtagtggcttataacctaatatctaagtttatttacccctgttgatttcttaaatttaccaatatttatattgttcataaatgtgctttctctggccctctatttttcccttcaaggaaagaaatttaccaagatatttgaccacacccataccttaaatagaatctgctggatttttaaaaaattttcctcaaaagttgcttttagtaatatatagtgagtatctgtggcaaacctgaagcctggtatacctgatataatttttgtcctgcttttatatctgaataatagtttggttatgaaatagtaaattcagagttcttaaaaactacaatttatttttttctttatttcagtgtttcttttaatgcctgttgttagtctgattcctttttctttgtaggttattctttctcactggacacctttagaattttcttttgtctgtgatattcataaatctcattaacatgtctaggaagcagagtaaggatttttatattgctttaatgctgagaaatgtatcattctcatatgtgaagagatcgtaccccttctctgtcagctattgctacttttgtcgtccatatctcagagcttttctattttccatctgtctttcatgctgccttctggtagaacttttcaacatcatggactttatcttcagtcgaatctatcctgtttctcttatttgttgcctattttagttattgtatttttcatacttaacattcccagtctgttgtagatttcttggtcttgttgcatgtcaatcttcctcatctctaagtatatttacattcttgtttaaattctctaattatgctgcttcagatgataatcatttcattcactctttcatagaaattgtacccttgaagtttctagttattctctgagctccagcacattaggcaataccagttaccctaataatgaatatttggggagaaatgaaggtctgtgacaaggagaagggcgcagggtgagcctaagtagtagagcactagttgccttacactgaaagtttgctgccagtccaggcaatttttatggtgtgctttgtagggtgggggactagtctcctttggttgtcaattcatcattcctagattggatcaaatacatgtttgaaggctttgaaccgtgcagctttcatcaaccctcgcattgggctcttgtgaagggtgaagatgacagacaacgattgttgcaaggcaggagcagaacttaaaaagctttcttgcggaactgctatcttccagtttgtccgcactgctacctactgtggccattccctccctaagttgttggttaccctgtacagttaaacacaacctccagtcttacctgaaattgcttatggtgtgtgtgtgcctcagtagttgcttcattcttgttctaaagtttctgggattagctttttgggggagcaagaaaagccagaagcccatgccagttcaccaccttggcagaatagtgcttttcacttaaaattaacagaaatagaaagttgatatcttcaagtgtttgttttttatttctaataatcttaagtaaactggtggctaagtaagtgaattatttgatttacaaaagtttgtggcaggaaagtttaacctggattttgtatctgttgcacagattccctgaagttatttaaattttaagtgtgaacatttattgttagagaggtttaatcattctttaggagactcataacctagtgtgtataaccttttaaaaatcagtgccccctgttcacattagcagacatggaatcaacctaaatgcccatcagtgacagatctgatacagaaaatgtatacaccacgtaatacttgcagccatacaaagaacgagatcatgtcttttgtgggaacgtggacggagctagaggctattatccttaacaaactaacacatgaacagagaaccaaatatcgtacattcttacttaccagtaggagctaaatgatgagaactcatgaacacaaagaaggaaacaacagacactggggttacttgagggtggagtgtgggaggagggagaggagcagaaaattaagtattgggtactgggcttaatacttgggtgataaaataatctgtatagcaaaccttcacatacacccctaaacctaaaataaaattttaacaaaatagtgcttcacagttcattgtatggtgtatgaactttatctcatcaaagctgttatttatttttgagacagggtctcattctgtcagccaggctggagtgcagtggtggtgcaatcttgctcaattcagcctcgacatcccaggctcaggtgatgctctcatcttagccttccaagtggctgggaccacaggcatgcaccaccacacccagctaatttttgtattttttgtaaggacagggttttgtcatgttgcccaggctggtcttgagtttttgggctaaaggaatccacctgcctcggcttcccaaggtgctgggactacagttgtgagccatagcacctggccctaaagctgttattttaaaaatacatgtctcctctttatagtatgttacacttgtatttaataatgtaattactaattcctaattaaatatggagactaaaaaaataatggtgtgtggaatcttgtcctttttcctgatatgtctatgctcccctcctttttcctaataacttgtatgggtgagatatatgtaaaagaaaaatccaagtaatcattgttctcagaattaagatggtctgtccatgacttcagcaatgacaagtccaacacttaacttgggtaaagatttagggttgacaatatgatttacattttgtttatcaatttacccagttacatttctacttttgaaatatagccagtggatcaatgtatttatatctatttgatttttatttactttgaatctaccttttgcttcagataaaaaacctgtcattcactaactccaatgcttcagtttcagtatgacaaaagaagtgtgacttccattttactctgatgctatataactgatttctaacctttcagcctgcctagggtagttaaaagacgagtgaatgctctcaaaaacctgcaagttaaatgtgcacagatagaagccaaattctatgaggaagttcatgatcttgaaaggaagtatgctgttctctatcagcctctatttgataaggtaatgctttctcctactttgtttaatttaacattctagaagacgaattctagaaatataagcagacttggaagaggttaatctttagaactctcattgaaattgttattagaggcagcacttggaggaactatcaataatagcagttaaagttgtggtatgcatttgttaaatttgtaagacttcttagtgagaaaccactggttttagcttggatgccagtgtttttatacagccttttttttttaaatcattttagcgatttgaaattattaatgcaatttatgaacctacggaagaagaatgtgaatggaaaccagatgaagaagatgagatttcggttagtaccaactttattttggtatgtttttaagatgataaaatcttaggacttgtcagaaatgttagcatttaatgatggagtacaatattatataaccagttgtattttttcattttttaattttacgtctttattacacgtttttctattactttatttttaaaaaacagtcattcaagattgtaatttgcatggcaataagcagcggtttcatgggttctaagtttcttaagtgtccacagcagtttaaaacaccacaagtcttatttccaatttgcagcacctgacttaaagttcgaattcatctgatggagcattaaaactgtcattttctcttgtgaaaagacataattgctatttccaggactgtatattgaacatggttgtacattatttttaattggttagtagaattttactcatgtaatttatatccagaataagaacctctagcatctctgaatggccttcctctcagaacgatgatgattaaatgtctaaaatgtatctggggtgcccccacttgacattaccaaacatgtttccaaataatcttagaaaatatgattctttaaacatatgcataccacatctttaaacataaacataccacacagtgcaccatcacttccttaaccattttccaattgttcacttataacatttgcaattttttattataaatcatattgtgatgaatactttcatccataagttttattgcaaggcttattgtttcttctaatgtcttctaatttcaaagaagtggcttactggttcaaacagtgcacatacgtggttttaaggcttttagtatactttaccaaataatctccagaatagctccaacaactcctaccaacagtatgttattgtgcccatagggtggacttgataacagcaaagcaaattcaaccacagatatattagattctcacccatctcaaaactatcacatcagagaagcaaggagacatattattgctgaggaagccaaattcaaattcttttaaaaaatcactcagctttagatcagtaaaataatcaacaaaaatggtcaccgcaaagtctaccgggtttttcaaaaaataaaaagagagaaagagaaaggccaggcgcagtggctcatgcctgtaatcccagcactttgggaggcctaggtgggccaatcactaggtcaggagttcgagaccagcctggccaacatggtgaaatcccatctctactaaaaatacaaaatattagctgggtgtggaggcgggtgcctctaatcccacctactcgggaggctcaggcaggagaatcacttgaactcgggaagtcgaggttgcagtgagccgagatcgcaccactgcgctccagcccaggcgacagtgtgagactccgtctcaaaaaaaaaaaaaaaaagtaccaaataaccaaaattttttatttgactaaattctgttcatgtatgagcatgacagtctctcctgtttatttgactttggcaataaaaaaataagcagccttgtacagaacagggaaaatgccaagaacgaaggcagtctacagttttactgtagaatacatatatatatatatatatatatatatatatgtaggcctctctccctttggccatatctactgtcagttcaggccattaactacagacaaattttcaaattcacttcttctccaagatcttcgatgctgtcatcatctacttctgtctgtttttcctgaatgacctcaattatgtcatctgtaaagtctccttgaatgataatttcatcctcctctgttactgaggcaccacaggagaatttttgagcaaaaaatctttgtgtgatttaagatcaatttcaaaagttacaaggccacaacccttgtcacgtatttctttgctctgggaattttggctatagtaaccttttgtggtaccgtctttgtttttttgttttatttgaccccttccacctctcttctgttttttcttctcctcttcttcccctgctgttccttgaccttgacagattccagcttcttgtttgggtgaattttccacagtaagttttgcatattcatttggaaaattcttctctaatcattgtctacatttagcaacatcaggcatatattcacagtactctattggtaatgaacagactccacaataaaggactcaaagtaggtaatcagcatctaacttggctctgttccttgggtctcctttgcagtcagccctattggaatcggaaacgtcagcagccatttcacaaacccaggcagttgcacaggccccgccagctctgctcccgccactgttgccagctgagccgacaaatgcaactcgtttccccggccagggcctccctagagcatcagttgtatttttatacctaggaaatatttttcctttttgtaagaatgataatgcagatgaactgttattcaacctggcaccaccatctgtactcaaaaagtcattatttccttacattttatagtttttttgtttaagagacagggacttgctgtgttgcccaggctggagtacactggcatgatcttggctcactgcagctcattcctgggcccaagctattctcccacctcagcctcccaagttgctaggactatctgaagctactatgcccagcttaatctacttttttttgtagaggcagagtcttcttgcctaggctggtcttagactcctggcttcaagcaatcttcgcacctcagcctcccaaactgttgggattatgggcttgaaccactgagccactgtgcccagcctatttttatagtttttttgagtctctgttgcccaggctggagtgcagtctcggcttattgcaacctccacctcctgggttcaagcaattcttctgcctccttctcccagtaactggataacaggcgtgcgccaccatgcctgactaattttttgtacttttagtaaagatggggtttcgccatgttggccaggctggtctccaactcctgaccttaaatgatccacccacctcacttcccaaagtgctgggattacaagcgtgagccactgcgcctggcttacagtttttagtttgtagattcattatattctttttttttttttaacttcatggtaggctgaggattgttgccattttcaagtgaagacatggaggcttctaagtgacttgcccacaatgaataatggcagagctgtgacacacattcagtgctgtgttaagtgttccacctctctagcattgctattttatgttgtttggtaaagagaatataatgttttgattaagaacaccatggggtgaggcaatggaccaaattagtatttctgttgcttttcttgtttattatgcttaagtcttcatttttaattagtttttacattttttttttactaaaatggtttttcctacacatcttggtcaccttagtggttctctttggaggggtgtggtagcagtaattttgatgggattaaggtttgttatgggcaacggcggtgtttacacagatagactagaactttgaaggtaatatctggtgactgtgctttttggtttttatacctttgctactttatcatgaggtctaatctatgtattaaataatgtttgctgtcacttaatcaaggaggaattgaaagaaaaggccaagattgaagatgagaaaaaggatgaagaaaaagaagaccccaaaggaattcctgaattttggttaactgtttttaagaatgttgacttgctcagtgatatggttcaggtaattttattcataaatgtaccagtttactttgaagggtaaacctttgaagtttaaatggctgtgatcactgttctcttcagtgttgatctttctagaatgattgcttacttttgaaatagctaatatctgtagaagagaaattacagctttgattaatgtaatcaaataaattagtttattttaaaaaatgagataatgaaatggtcccattgataatggctcattatcgactggtgttttcttataaccctgtgccttttgtctttacatacttagtatggaagtatgatgggaaagttaatcttatagctgcaattatgcaattcccttaactcttccaggagaaatttgcattttaaaagaataccataaagatgttaaactcattcacaatggttacattctctggcaaaccataactgttgtcacctttgggaaactgcctcaagcatttcttgagtgagcccctaccgtctacattgtagtagtacatgttgccctgtcttgtcattgttggaagttacatggagaaaaagaaatgatcttcacacaattactgcttattacaattctactttagcaaagtggaaaaggaacgaccaggaggaaggggacaagcagctggaaaaggcagcaattacaatcaggaaacattttaaaagtagatatgccttatttagacttgattttggatttttcaacctatataataattcagttgtctatttggacactttttctctaccagtggcagtagaactacagtataaattagctttagtataagccataacctggagagtaagtcttaaggttcataattgctatacaaaactactttgaaatatattatgtctcagtcagctggtgtttgtgtagtaacagaacacagtcctcgaatgccatgttattcatttttattatttttttaatttgaaggaacacgatgaacctattctgaagcacttgaaagatattaaagtgaagttctcagatgctggccagcctatggtaaaagaactttgaaatatttataattttgtaacatgcttacaggtagataaatagaagcttttaaaaagataacattcaagggtaaggttggtgctctttgttatagtgaataaatatttggatgctgctaattgtgaggcagtatttattccttttcctccttctgatcataaattgtgtttgaaacacagacaatccttgttcctggatatgtggataaaaataatgccaagggaacatgaataagtactttttctgcattaaaaggcatgagcttgggaattacacaaaactgatgttagaggatgcccactccctaatgaggaaagatcagccaacaagctgtccaccaaaccaccagaattaatgtcaactaagggcaaaactgctaagaatataggctgtagatgcttaaggttgggctttttctgtgtcaagttcacgtttagtctactatttaaaagcctgattcctccagtagttggggagtaagggaggcaacatggtcactttattcaggaatgcctagcctgttgtgtaaacatgttaattatttaatagatgtaaattgaaactaagttctattcagttcaatttgtacctcattattattttaacgtaatttttttgattttaacataatttggggctcatctgacagtctgtcccattcttaaatatttcatggctgggtgcagtggctcacacctgtaatcccagcactttgggaggccgaggtgggtggatcacttgaggtccggaggtcaataccagcctgtccaacgtggtgaaacactgtctgtactaaaaatacaaaaattaactgggtgtggtggcacacacctataatcccagataattggcaggctggcgcaccagaatcacttgaatctgggaggcaaaggttgcagtgagctgaaattgtgcccctgcactccggcctgggcaacaatgcaagactcagtctcaaaaagaagattgtatttcagagtagaaaaaaaaattatcatttagaatatttataaaaacagatgaagctgtgtttactaaagtactgaaatatgtgaggtaggtatttaactgatttttatgcttcctctccccagagttttgtcttagaatttcactttgaacccaatgaatattttacaaatgaagtgctgacaaagacatacaggatgaggtcagaaccagatgattctgatcccttttcttttgatggaccagaaattatgggttgtacagggtgagtttaattttactaccttaacaaaatgttttttctgtttttgttatacttgatttgtatactcggttattttcagttacatatgtacatagtctgtctctgaacattttggtaatatgttttctgaaaagtgcttatcaagtttcctgtaattctgcttggacccatgactgtctcacatatatttttgcagaggaatgcttctttaaattatactatgtgtttgtgctaattgtaaatgtgtttattttaaatatttgcttagaaataaaatttttccctttatactgctatagaaaacatttgaagcaattcacccttctaaaatttgaaatctaaatagaacatttacttctaaaagtttagcagttgaaagattgtcaattgtaatagatttttcttctttgttttgcaaggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaaggtaaataatgttttagcttgagtattaacggttgttttataaaaagcattgcttagcttcttattcattgtaatttcttttctcaattttgcagttcctgagagtggagatctggtaagttgaattgttatatatttattgaattgttaagtatatttgaaattaaagcactgaatttcaaaaatggagagtgggatggttgttacattgagttctgaggcctacaatgcatggggcagactttttggatatgaaaaataattccattcaaaattatatcagtgcttctgctgagaaacactgagataaaaagcttaaggttttcttttcttttgaaacttcacatattgctgtgagggatttaacttttcaaaactgttgtcttccttagtaaaaccagaatatattaagtcacttatactgttacattcctaactacattatggttcaaattcattcctgaatttgttactccaatgtaaatatggtttcatattgtgactaagtatgttcacatatatggcatatggcaaagaacatgaaatgttcctgccatatagactgaactgaggaacaaccttaaagaaagtctatacacacaaggtagggcaggtatgttttgaatttggttttcttttgggcatgtttttgaatttaaattaactgagatagtttaaatagtttgtacatatatggaattagaaattaacctaaactgaatacttttgaattggaatactcttggctaagacttagaacaaatttgtaaaaggcaaaagtaagtatttctggcttggcttataggacaaaaaaagagaacataaagcagtgtgaatttcaggtgagaaaaactactttaagtattaagatagagcatcacactattttcgtatcagtggatgggttggagtttgtgttcaagtttggggtttttttttgtttgtttgtttgtttgttactaaatattgatgatgacaaaacagtctagttaaggatagaaaacctccacctgtggtttgaattcctccccacccccttttggatttttctatttattagattatgttgttgactcaaacattcatggaattcacagagggtgtgctcattgtttagtatcatagaacttgtatcattgtttagtatcatagaagtgggattattttattttattattattattttttttttgagatgaagtattgctctgtcatccaggctggagtgcagtggtgcgatctccactcaccacaacctctgcctcccgggttcaagcaattctcctgcctcagcctcccgagtagctgggattacaggcacgtgccattgaactcgctaatttttgtatttttagtagagacggggtttcaccatgttggccaggctggtcttgaactcctgacctcaggtaatctgcctgccttggcctcccaaagtcctgggattacaggcatgagccaggccaaagtgggattattttaattgtgaataatgtcagacccacttttgccctgtgcttttctattaaatagaaatcctaagccaggtacagcttcaggcacctgtaatcccagctgctctggtggcggaggtggaaggatcacttgaggccagcctgggcaacatagcgagaccctgtctctaaaaaagaaaagtgctaggggcacctgatttagttagtatattgtctttctgaactaggactgtctcatttgggattagtagacttaaaactgtacagctgtttgggtactgtcttttaggaactataaagtgatcctctgtggttgtttattatgtccttctatttgctatgtacttaacaatattaacaataactatatattaacaataacccaagggtttttttttttatttttctatttggtgttttcaataatattttaaaaggaaaattgcggacatgtaacagttgcttttatgtatttatgtttaaaccagcaaaaactaagcagttctaatttttattcttcacaatttatcttagtatgcatactggcctgctagcttattttctttttgttaaaaacttggaaaagttattaaggaaatttaaaaatgacaaatcatttgttaacatggtgtgagaaaaatcatggaaagtaaaaagtaaagttgagcatttcttcccttcatcatataatttaaactgaagagtctgtctttttttttttttttttttcggttgcccaggctagagtacactggtgtgatcacagctcatttcagcctcaagctgctgggctccagcaatcttcccacctcagcctctcaagtagctgagactacaggcgtgtgccaccctgcccagttaattgtttattttttgtacaaacgcagggggcgtctcactatgttgcttaggttgctcttgaacttctgggctcaagtgatcctcctactttggcctcctgaagtgttgggactacagttgtgagccatcacacccagcctctaagagtcttacatgtgccaaattaagtaacacagttattcctaaattttctgcttttgttttcctttaaaaataggatgatgatgctgaagctatccttgctgcagacttcgaaattggtcactttttacgtgagcgtataatcccaagatcagtgttatattttactggagaagctattgaagatgatgatgatgatgtaagcgaatttgaatcctgcaaagaaataattggttgagggtatagtggtcagaattggtaatagattagtttagtttttaagaagcaggacataatataattcaaaattaggctaattactgatgttctgtatatagcttttctgggttttaagtatgtctccttaggatttttggattcatttatcttagcttttaattttctgctaataagattgttctgagtttatgaaacttttttatgtttggttagtgctatagatctattatgcccttgccttgacttcacagagctaggactttctttagtgcacaagaaaacatttactgggaggcatagaatttctattcaaggtagtattgaatgatggttaggttaagattaggttgcatatagatgttttgaatatgtttattgctcaacggcaattgttagagtaggctttaggtccttttcgtacagtgcattccacacttaagtgtaggtgagtaatatttacagtaatacttgtctgatcatccactttatccacatgattgtactctgttctttaattttataaattggcagtgagcagagtgattcttgcagctactatgtgttttaatttataatcagccccttgataggaaagtaggttttctctttttagacactagtttatacagtgataaatgttactgatgctactctgaaatgtgtgttacattcactcaacacttaacgctgtttttccttttcagtatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaaggtgagcaaaattagtgctgctttctattaaatttaagatagctaaagtaagagttggtgtttttgaatatcaagtttctctccgttaaagtctttaataaataaagcctattgactggataactttgttttttcagtcccactggcattgtgaacagtacacataatttcagtggacgtttttctaaaaaacattgttttttgtttggacttcgtgctttttatagtttcaggtacagtgaaccctaggattctattttaatgggacgatttgtaacagtttttaagcattagaaaataaaggtttttaaaagatctggttgtaggagtgttcgggaactggggagcagtgcagtttgttagatccttccaactactcttactcagtccctgagagtcctagtctattattcctgagaatttgttatattaggattagcaaaaacaaagctgattggtaatataactaacataaattgcttggtaactttatttttttaagattatggtttagcgtgtgtcacattttatggagttaattctacagtgtaaagtttgagcttgattttagcatttcagtgacttgctaataaaataaataatttaccaccattgtcctataccatttcttttgacaacagtgagctactgttataattaaggcagtaattactattgagaaattcactgaagcaggtagaagaagatagattgacttgttgttttcctttaacagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgggttattattctgagttatctacaaacatttttgagatttgtctttacactctgattgtagtttccagcagcccatgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaatt

SEQ ID NO: 15316 - DNA, 144322 bp, Human
  misc_feature (1)...(144322): n = A,T,C or G
gcttgaaggatatcaagattcatctggccatcttaaaatttaaaaagtttaggaattcacgtgttctgacagctcaatgaacctcaataaacttttcacaaagtgaaaacagagcggttgaattaagtgcagtctgctgcagaaacagggattttaatctttgtcactgctttctgatattccttcctgataactgataactttattctctgttacttacattaatttttcagactgtgagcatcaggtggcaaagctcaatcaggacaattctgaaacagcagaacaatgtggaacatcctcagaaaggaccaataaagatctttctcatactcttagttggggaggaaactgggagcaaggcctagaattagaagggcaacatggaacccttccaggagagggccagctggagtccttttcacaggagagggatttaaacaagctcctggatggatatgtaggagagaagcctatgtgtgcagaatgcgggaaaagctttaaccagagttcctatctcataagacacctaagaacccacactggcgagaggccctatacgtgcattgagtgtgggaaaggcttcaaacagagctcagaccttgtcacccatcgcagaacacacacaggagagaagccctaccaatgcaaggggtgtgagaagaaattcagcgacagctcaacactcatcaaacatcagagaacccacacaggggagagaccctatgagtgcccagagtgtggaaagacttttgggcggaagccacacctcataatgcaccaaagaacccacacaggcgagaagccctacgcgtgcctggaatgtcacaaaagcttcagtcgaagctcaaatttcatcactcaccagaggacccacacaggggtgaagccttacaggtgtaatgactgtggggagagttttagccagagctcggatttgattaagcaccaacgaacccacacgggagaacggcccttcaaatgcccggagtgcgggaagggcttcagagatagttctcattttgtagctcacatgagcactcattcaggagagaggcctttcagttgtcctgactgccacaaaagcttcagtcagagctcacatttggtcacgcaccaaagaacacacacaggtgagagaccttttaagtgcgaaaactgtgggaaaggattcgccgacagctccgccctcattaagcaccaacgaatccacaccggagaaagaccctacaaatgtggagagtgtgggaagagcttcaatcagagctcccactttattacccatcagcgaatccacttaggagacaggccctatcgatgtcctgagtgtggcaagaccttcaatcagcgttcccatttcctcacacaccagagaacgcatacaggagaaaaacctttccactgtagtaaatgtaacaagagcttccgtcagaaagcgcatcttttatgccatcaaaacacccatttgatttaggaagtagtctttggtgttcagctgctcccttgcacattttcattgctactgtcttcaagcaccccaaatagagaaaacctgggcgtcagtggctcaatttgggccctgatctattctccctctttcttgtctatgttataacagagaggataaacttaaagggtccaaataacggtccgaatacaaaaggcattccttcagtgtgtgactgactcttagggaaatgtgagtttaatagttgatgcccgccaggcgtggtggctcacccctgtaatcccagcacttttgggaggccaaggtgggtggatcacttgaggtcaggagttgagaccagcctggtgagcatggtgaaacctcatctctactaaaaatgcaaaaattagctgggcatggtggcacgtgcctgtagtcccagctactcgggaggccgaggcagaagaatcatttgaactcagaaggtgcaggttgcagtgagttgagatcatgccactgcactccagcctgggcaacagagagagactctgtctccaaaaaaattaaaaagttgatgcctagttactaaatgagaagtgagaaaaatgtggcctagagatcacatgttcaccacctagtacagtgcctggcacaacatagatgctcaataactaaatggtcccatcattattaatgattaatagttgaggtcttatataaaggctttaatgcagtacctggcccttaaaagacactcagtacaagattggtggcttttatcagtcttattactcaattagaaatttattagtgtagtccccccgccccaaactcagaacgtgaaagaaattagattggaactagaaggtttggggttggaatacacaaattgaataaaatggaaatgcactgccagttcagtgctgtgcaggcattagtcaccagaggtctcactgccatgacaaggccaaattatcgtagaggatgtttgcggtcttgtgacttggaggctgaaagaatttcagaagctcttttaaatggcagtgtatggcagtgtatctaccagaggtttgctgtcatctgacacagagaaaatatcctacaatgaacaagccagagggacctggtagaggactataaaattgtggaagcaaaattgctgagaatgtcaaatgatattacagggatcctccctggcatttagctgaaggaagcaactcttgttttctaatttgctgggtcattggccatttagttttaggttaatataattctctgatccttttagggccatccaggttatgcactagtacattcctacattcaattgaaataaattgagggacggcaagtgtgttggaaagaacaccgacttcattgagaaggtaaagtatttgagtcctggccctgacgcttaatttggccagactttcatcttctcccagcctcaagttttacctacctcacaaggttgttgtgaggatctaaaaatacacacacacacacacacacacacacacacacacacactttgttggttaactataaatgtaatatctctatgttataattctgttgctaatgtcttttttccaagaaaattttggctaatatttctttaggtattcctttttctctcatagtgagggattaaaaaaaaaaaaaactgttgaaaaattagggcgtaaaaatgctaaatgacatgactcatcatgggccacgtagttaacagaagagccagatttggctgcaagtcactagatttccagcctgcagtcctcctctgcaacaacagaccagctctgggatttgttacagtgcctgtgagacattacaggactggaggacccatattatatccattaaaccagtctgaatttggaaatgatggagggtgtagtctaagttgtagggagctttgcaagaacctgtgctggggtccttgatcctggtggaatgggggtggaggagtgagcgcaaatgcaaggggttaaggagggagctgggtagttatcactttttagagtgcaaagtggtggattaaaggtttcttttctttcattctcttccattatatggaatgccatctgagtgctgtggctcatgaaggatagaactcagctgataaccttacctcagtttttgaaagcatcattagataattgaccagaaaattttttttagttaatccagtgcagtggttctcaaactgtgagcccagtccagtagcatcagcattatctgggaactttttagaaatgcagattcaggccgggtgcagtggctcacacctgtaatcccagcactctaggaggccgaggcgggtggaccacctgaggtcaggagtttgagaccagcctggccaacatggcaaaaccccacctatactaaaaatacaaaaattatcccaggtgtggtggcatgtgcctgtaatcccaccaatttgggaggctgaggcaggagaatcacttgaacccaggaaaggaggctgcagtgagctgagatcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctggagtgcaatggcatgatcttggctcactgcaacctctgcctctcaggttcaagcgattctcctgcctcagctcccggagtagctgggattacagatgcatgtcaccatgcccagctaattttatatgttaagtagagacggggttttcaccatgttgggccaggcgggtcttgacctcctgacctcaggtgatccacctgccttggcctcccaaagtgctgggattacaggcgagagccacctcacctggccacctatcactttgattttcatgttgtttggctatggtaaaatgtgagctctcgaagggcaatgtgagatttgctttgtggccctgccaatcccctccctcctccctgtcttcctgcccacccccccccactcccccgccagccatgagcagggaatatttcaatgctattgctgagagtggaggtaaccctttctatagttttcttttgtttctacctcatgactagatgattcactgcttgaacatgctccacacatccgttctttctcactccaaaattgaggtcatcaccaagccccattaattttacctcccagattcctctcgaacctatctgtcaaatctgtccatcttcactgccacccttcagtaccaaatgaccagtctcttacctgaattcctgtagcagcctccaaactgatcttcctgatatgatttttgctctgaaaaaactggtttcactcacagaaaccagagtgaacttttaaaatcctaaatcgaatcacatcacttctcagcagctttccattgcttttagaatgaagacccaaatccttacccaggcctaagaggcccttgtggttttgtcccctccccctccatcctcttgtgatatccccttccctctcccttgcctcacctcagcactcttgagttctctgctccttggtcatgccaaggttgtgtgctctttagacccttggtactaactgttccctctgcccagaatgttcctcgcccagtcctttgtgttgcctcctatttgtcaaccaggtttcagcctaaacctatctccttaggaagactttccctaactatcccatctaaattagtcaccctccatcacattatcctcttttttcatcaaagtccttacacctgtctggcaatttcttattaattgatttgtttttggtaaactccacgaaaggtgggagtcatttctcttgtttccattctttccacagcacttagaacagtgcctggcacatggtaggtgctcaatatgtgtttactggatgaattaatgagtgcatgctcatgggcaaggatctcattgtgctggaaaagcagcagagtgagacaaaactggacaggtgagtgaaggtcacaccaagaaggttcttagctgccaaactaaagggtttggatcttactctctggagaaaagggtgtagctagtggttttataggagaggagaggcgcgatccgcacttgagaaggtcaatttggccgctgtgtgtaggtcatattacggagaaaaaaactaaaggctttgagacaatccatgatgtaaagggcttagcacagtgcccagcacgcagtaggtctccagcgagtcgttatcaccaagcaccagggcaggcaccacaacaaaaagataagatccctaacccttcttttacctcgaaataattcctcctagaccctatcatcgcattccttctcttccccttttgtcaaacttccactcacatgtagatattctcagggttatcatgcctaggcctttttaatagggccacttaccctagcatgcttctacaactggaccctcaaaggtcttttagggctgagtgtggtggctcacacctgtaatgccagcattttgggaggccgaagccagaggactgcttgagcccagaggttcaagaccagcctgggcaccatagccagaccctgtctctacaaaaaatagtttcaacaaattagccaggcatggtgatgtgcgcctgtcatcccaagtacttgggaggctgaggtgggaggattgcggattgcctgagcccaggagttcaaggctgcagtgagctgtgatcataccaccgtactccagattgcgtgacagagctagaacttgtctcttaaaaaaaaaaaaagacttaatttccacatctgaaggcctcttgttagtcttcttctgattcaacaactctttactgtttgatgccatttacatatgtttattattttttagagatggggtctcattcttttgctgaggctggagagcagtggtgcgatcatggctcactgcagcctcaacctcccagactcaagcaatcctcctgtctcagcctcctgagtaacagctaggactacaggcacatgccaccaaacccggccttttaaaatttttggtagaggccagatgtggtggctcatgcttgtaatcccagcactttgggaggtccaggcgagtggatcacctgaggtcaggagtttgagaccagcatggctaatatggtgaaaccccgtctctagtaaaagtacaaaaattagccaggcgtggtcgtgggcgcctgtgatcccagctactcgggaggctgaggcagcgagaatcacttgaacctgggaggcggagcgttgcagtgagctgagatcgtgtcattgcactccagcccagctgacaagagcgaaactccatcgcgggggatgataataataataataataataactttgctagagacagggttcccctatgttgcccaggctggtcttgaactcctgacctcaagcaactctcccaccttggcctcccaaagcgctgggattacaggtgtgagctactgcaccaggcccatatgcctttttaaaaaaattatcttttccattggtgactatgaggttgagagatgattctcctacatttctggctgctcctcttcaagtaccttccctggctcctctggatttttttgttttgttttgttttgttttgttttgtttttgagacaaagtcttgctttgttgcccaggctggagtgcagtggcaggatcttggctcaccagctcactgcaacctccacctcccaggttcaagggattctggtgcctcagcctccagagtagctgggactacaggcccagctaatttttgtacttttggtagagatgggggtttcaccaggctggtcttgaactcctgcctcaggtgatctgcccacctcggcctcccaaagtgctgggattctaggcatgagccaccgcgcctggcctggctcctcttcttcttccactcagatatgcctgaccctgtcaacactttggttgaggtcttctttcttctttcttttttgctccgcacatttagcttatgacttcaaccatcatttctcagagcatgggtctggctcaacctctctcctgaatttcagacctacaagtctagctacttggtggagacctccccagaatgacctgctgcttcccaaaagcagactctccaaattacagtcagtatctcccccggaagcattcccccaggcatttctctttctgccttcaattccccattctcctacattgccttgccagaagcctgctggtcagcttggatttctttttgtccttttttttctatattttgctggtgcctagtcatgtagttgctgcctctacactttctcttctttaaaaaaaattattaaagcaccacgtgcttgttgtaaacatttccagaaaatacagaagtgctcaaagtgaaaaaatggaaatgccttgtcccttcctcattccctgccctaacctcacgccccagattcagctatgtaatagtctgtcatgccaagtcttatttccagctcctcttttccatccccactgccatcatctgaactaaacggattgttttccatctggtctccttggcttttcctttcagtgcagctcaacagacattaatcaagtgccttccacacaccaaagtcctaccctagatcctagaggttcagagacaagtaagatagttaaagagatccacattccagagctgtttaactttgggcaagttacttaatctctctgacccttacttccttatctgtaaaatgatgctaatcccagcacctttttcatgggtttggacgagcattaatgagatgatccatgtaaaactctttgtactaactacctggtacactgtatctgctccataaatgtcagtgacaacaatgataataatgacaatgtttggaggagtttatagcttaatggagagacttaaagcataagaattatctaggcgaagaatgatgagaaaatatttttggaaaaggaaaacaaacagttctactaaaattaaaaggctgatgtagagacttgggaaactgggaggtaagagctcggactgtgtcctctaagacagtaattcccgaagtgtgagcaaaagtccacctgcatcagtcttacttggggtgattgctcaaaatgaggatttaatggctgcacctccgagcaagttggtaatttacatatcggaatgctatccatcaaggaaaatgggcagactacagttacatgcatcaacacagacaagcttcaaacaatattgagtgtaaaaagcaagacatagaaatatatatttagtaagagtaaaaatacagtaaaggtaaaaaagaggcaaaactaaacaatatattgcttaagcaataaggatacacaaactaatgaaaatcaaaggatttactaatacaaacttcagtatagtaattaattggaatgggagagaaagatgcaaagtttctatttctttttttgttttgttttgagacagtgtctcattctgttgccaaggcaggagtgcagtggcaggatctcagatcactgcaagctcagcctcctgggttcaagtggttcttctgcctcagcctcccaagtagctgggattacaagcatgcaccaccacacccagctaatttttgtaattttagtagagatggagtttcaccatgttggccaggctggtctcgaactcctggtcttaagtaatccgcccacctctgccatcaaagtttctgtttcttaagttggctgccgagtacacaggttttctttgtaaaataattatttaaattgttaatatgcattacttatatgcttttcatttacaatgtatttcacaagaaaaataaaacaaagcaaataagaaaacagaacacttctccagagattgatctttttcactcaaatctcattgagttatactgagggggaaaaagagtaatctgagtgcctgggccctgaacagacacactagatcagttccttcattcccactcaaacacatgcacacacacgcacaaacacacattttcttatatttccttcagcaaaccccccgccccaccaaccaaccccaaaacaccctctgctcctttatgtatataaattagagcagataaatgtccagaagattataggccatctttctataaacagccaatcttggacctggtgtctgaatgggggatgccctgctgcattaaagatgctcatgtgaacattttgttgtttcccagaaaaaaagtttccacattttagattattttcacagggtgagaacaattttacacctcccttacttgctgcagaatcttttttttttttttttttttttttttgagacaggtcttgctctatcactcaagctggagtgcagtggcacgatctcggctcactgcaacctccgcctcccaggttcaagcaattcttctgcctcagcctctcgagtagctgggattacaggtgcgcaccaccatgcccagctaattttttgtatttttagtagagatggggtttcaccatgatggccaagctggtttcaaactcctgaccacaagtgatccgcccacttcggcctcccaaagggctaggattacaggtgtgagccaccacgcctggctgctgtggaatcatttttaaagtgattgtatcaatttacagtgttccgaacagtaaatggctactagtctcatcacaccctcatctttaaaaaagttttgctaatttaatagacatgattcttacatattgtcttaatttgcatttctttgcttaccagtgaggttgaacatttttttctatgttagaatctttcttgtatttcttctgttgttttcattagagtaactcagagcaggattgggaatctgaaaacatgaacatttgattttgaggaagtcattgttttcctgttgtcttccttccccctctctgctttattattttttacttcaggttcatttatagaaatatcagaaaatacaattaagcaaacagagtaaattccacttcccagagataaccactaccgtttgttgtatatccttttaagctttttctctgccaaaaatattcacaaatatatcgcttattctttctgagcctgtttcctcatctatcaaatggaatacttgttcttcaagttgataattaactggtgggagcacatgaaagtattttataaagtgcacaaatgcaagttgctgctcttatgacaaagaaaaaatgtattttattctgccaagcagaatgatgacactttgtttcctgaacacagcctgctctctccagtacaatttcttctctctagaatagcttcttgcttcaattcctcctgctgaactactatctactctttttttaaaaaaatcaatattaaaatatacaaaaattagtgtaaagagcaaccacgtacccactatacagcttaggaaaagagtctggcatttctcactcctatgcctttatatatacttgctttatttcctgtctctctatatatacatacatatatatttagtaagagcaaaaatacagtaaagatcagggaaggtgcggtggctcacgcctgtaatcccagcactttgggaggccgaggcgggcagatcacgaggtcaggagtttgagatcagcttgaccaacatggtgaaaccatgtctctactaaaaatacaaaaattagccaggcgtggtggctcatgcgtgtagtcccagctattcaggaggctgaagcagaaaaatcccctgaacctgggaggtggaggttgccgtgagccaagattgtgccactcactccagcctgggcgacagagtgagactccatctcggggaaaaaaaaaaatacagtaaaggtaaaaaacaggcaaaactaaatatattgcttaagcaataatgatactcatacaaactaatgaaaatcaaaggatttactaatacaaatttatagtagttaattggaagcatatgtattatataaatatacatgtattatacatatatgtatatatgtatatatatagaaaaaagcaaatatatgtatatatacatatatatctatatatgtaaaatttttatttataaaatgtttttgagcatgaaatgatatatcattgtggtgttaatatgcatcttagctgggcatagtaggtcacacctgtaatcccaacattttgggaggctgaggcaggaggatttcttgagctcaggagttcaagaccagcctggacagcatagtgagaccccatctctaaaaaaaaaaataaaaattatctggcgtggtggctgatgtctgtagttccagctactcaggaggctgaggtgggaggatcacctgagcactggaggtcaaggctgcagtgagctatgatcatgccactgcactccagcctggatgacagagccagatcctgtttcaaataaataaattaaattaagttaaaaagtatctccctgattagtggggaagttacccaactttttttttttttttttagacagagtctcagtctgtctcccaggctggcatgcagtggcacgatcttgtctcaccgcaacctccacctcctgggttcaagcaattctcctgcctcagtctcccgagtagctaggattacaggcatgtgccaccatacccggctaattttttgtatttagtcgagatggggtttcgccatgttgggcagactggtctcgaactcccgacctcaggtgatcctcccacctgggcctcccaaagtactgggattacaggcgtgtgccaccgtgcccagcagttacacaacttttacaagtttattgttgttcatgttgcctcttcagggaattttgtttataaagtacctattcttcaaggccccattaaaacacctccctctccataaagtatttccagatctcctctatcaagcagataggatttcctttggacttctataatcctttctttctacatcttgggtttcactcacttcttatttcatcttgcattacagtcacttgtgtacttgtctaaagggcagtgactatgtttaactcaactttatgcccttgttcatactagtacaaaagtaaacatttcataaatctttgttgaatcaaatcctactcctcccctgcttataaaatcttaaatcatttcctattgtctacagacgaaagtagaatctcgtttaatgtagaatttaagacccttccacgggctctagcatcaaccttcctttcttgctcttctcctgggaggaccttgctttccgccccagatactagattcttcatccacagtaaggtcccagtccactaatgtttggcttttctctctgtagctgggatggcaggttggtcccacccattttagttgcctataaaattcttttttttttttttttgagatggagtcttgctctgttgcccaggctggtatgcagtggcatgatcttggctcactgcaacctccgcctcctgtattcaggcaattctcctgcctcagcctcccgagtagctgggattataggcaactgccaccatgcccggctaatttttgtatttttagaagagacggggtttcaccatgttggccaggctggtctcgaactcctgacctcagatgatccgccctcctcggcctcccaaagtgctgggattacaggcgtgagccaccgcgcccggtctgagccaccgcgcccggtctgagccaccacacccggtctaatttttgtatttttagtagaggtggggtttcaccattttggccaggctggttttgaactcctgacctcgtgatctgcccgcctcggcctcccaaagtgctgggattacaggcttgagccactgcgtccagcccaaactctttaagagaaaatctcttgggatcttgaagccagaagcttgcttttattactgagtttgccctgaatctgtcacttatgtactaaaaatacataaatttccttatccaggtgacttgggctcaactgaaggaaacctgaagcatctaaatgttagcacctaagcctgagtctaggtgccagcatagcctgtcttccctctccagagtcagaggcatgttacaaacagaatatatggacacacgtcgaaccccacattgtatctctctaatttattcaatttaattcagtaaacactcattacctcttatatccaggcctagttgagggtgctggggatacaggtataaacatgacagttctcttgaggagcacagagtggttgtgggaaacagacatacagacacacagtttctttctttcttttttctttttttttttttttttgagacagagtctcactctgtccttcaggccggaatgcagtgaggtgatctcagctcaccacaacctccacctcctgggttcaagcgattctcctgcctctgactccccagtagctgggattacagtaatgcgccaccacacccacctaatttttgtatttttagtagagacaggcttttgccatgttggccaggctggtctcaaactcctgaactcaggtgatccgcctgcctcggcctcccaaagtgctgggattacaggtgtgagccaccatgcccggcccagacacatagtttcaatacaagaagtatatgtcagccagagaagggctatcttgagagtcaaggaaggctccctggaggaggtatcacttatgccagttggtacatgaatgagtaaatgcaaacaagccatgatactgaaataaagctttgtttaattaaccttcacatgtaaattcagccacagaagacattctgatacatgggggcattgccagtgattccacgaaactggataatgtcattgatgcttgtggttgagagagcttgtttctgtattgtaaggaaggtggtacaacctggcctttcttttaaaaaaaaaaaaaaattcaaactggacatgtgtcaatgaactgactggagtcttagggaggaacattgctccatagctatatgtctctcccgttttttcctgtgttagtctttttttttaatttttttaaaatttttttgagacagagtcttgctctgttgcccaggctggagtgcagtggtgtgatcttggctcgctgcaagctccgcctcccgggttcaagcaattctcctgcctcagcttcccaaatagctgggactacagatgcatgccaccatgcctggctaatttttgtatttttagtagagacagaatttcaccatgttggctacactggtttggacctcctgacctgaggggttccacctgcctcggcctctcaaagtgctgagattacaggagtgagccaccttgtctagctctttttttttttttcttttgagacaagttcttgctctgtctcccaggctggaacgcagtggtgcaatcacagctccctgcagcctcgacctccccagctcaagtgatcttcccacctcagcctccccagtagctggggccacaggcatgcaccactacgcccagctaattttttttattttttgtagagatggtgtctcaccatgttgcacaggctggtatccaactgctgggctcaagcaatcttcctgccatggcctcccaaagtgctaggattacaggcgtgagccactgtgcccacgtgttagtctttacataactgaatagtgactgaagtcttgcagtttctaccttgccctgcactggcattataagttgtagtagaaatgtcactcattgcttgtaatctcatgagaggcctagttagatttttctgtactctacttccagaggagcttataggaaggtgactttccataaaggatgtgagctttctaccacccaaatatcagtcgtaaagaaaatgaggagtgataaagaaagaaggtattgagaggtgaagccagctgggcttctaggttgggtggggacttggaaaacttttctgtctagctagaggattaaaaacgcaccaatcagcactctttgtctagctaaagtattgtaaatgcaccaatcagcacactgtaaaaacgcaccaatcagcactctgtgtctagctaaaggactgtaaacgcaccagtcagcactctgtaaaatggactaatcagcaggatgtgggtggggccaaataaggcaataaaagctggccagcgaagccagcagcaggcaacccactcgggtgcccttccatgctgtggaagctttgttctttcgctcttcacagtaaatcttgctgctgctcactctgggtccgcactaccttcatgagctgtaacactcaatgcgagggtctgcggctgcattcctgaagtcagcaagaccacaaacccaccgggaggaacaaacaactccagatgagccacctttaagagctgtaacactcactgcgaaggtgtgcggcttcactcctgaagtcagtgagaccacgaacccactggaaggaagaaactccggacacatctgaacatctgaaggaacaaactccggacacaccatctttaagagctgtaacgctcaccgtgaaggtccgtggtttcattcttgaagtcagcgagaccaagcatccaccaaaaggaataaattccagacgcagtatttacagcccagtgtccacccattccccatgtagcaacccctggtacctgaggaaaaaggtcacagcctctgccaatggtggggcatctttccgaagaggttccacttggactttttgaaacatcatgtggctgtgctgtttgagaagcctggggtgaaattaactatacaagaatcagggcatgatcacacacgcacacacctttgcaatttttctggctttgtttacactgttactgcaacttgtgccctttctcacccttttcataggtcttccctgcaaagtctttttttttttttttttttgagacggagtctcgctctgtcgttcaggctggagtgcagtggcgtgatctcggctcactgcaacctccgcctcctgggttcacgccattctcccgcctcagcctcccgagtagctgggactacaggcacctgctacctggcgcagctaatttgtgtatttttaatagagacgggtttcaccgtgttaacgaggatggtctccatctcttgacctcatgatctgcccgcctcagcctcccaaagtgttaggattacaggcctgagccaccgcacccgacccatcaactgttctcttatctgtgctcctagatctctatcttgatgtctgaaagcttcttgagagtgctttgtcaggtctatgtccatcacattctttggtggatgtggcctcacaaatctttcaactcagccctctaggtcctcatgtgcattagtggagaatagcgttcacatatgtgggctttgggtccaatgcagtttgaatcctgagtatgtcactaactagttgtgtaatttttggaacattgttaacctttctgatttcagtttccttatccttaaattgaaaattctagtagttcctacctcataggattgttgtgaaggtcaaatgagatcaaatacttacaactggacctaaggggcactcattatgagttagctgttgttactagtaacccattgtcatccctgtagatgtttcaggggtttgccgtggggaaccctgccatgcaggcttgtctcaggttctgaccctgtgatggggtctggtgttccctgcctcgtttaccactctttccccatactttggtctgactctccaatgagctcatgattcctatgagcgatttctgtctcttgatgaatctttagatttgtcctttgtcttaggccttgagactgcagtagaaccttgtggcctattctaaccccagcccggaaaccaatgccccaactccattctgggctgacttcctggcttcctcccacaacttccgggtctctgtttttatatattgttcctagactaggatatgggtgttcacaaatgtttgttgaaaggttttcagaggcaattaggcatatttaagaagtgaatgaacacctgctcattgatatgctgtccataaactaggacacggtgttgaatgatgatttgacagagattttagaatcagagagatggaagcttgatcctaactctgaatcttatggccttaagcaaaatatctaacctctttgtgcctgttttctcatttgtaaaatgaggataattatatttcctcatagggttattgtgaagattaaatgagacaatataaataaagcacctagcattttctggaacatggtaagcagttggtaaatagctgcaactaccaacaggtagttcaaaacttttcctccatctgaaaaaccaagagttgaagaaatggctgaagttggaatatctggcaggagctgtgcttaaacacaagatccggaatatctgaatatctttaggacaagatgaaataggtttctctcaaatgagttggttaaggagttaagcagtgataggtaacacttgaagtttcacaaagatgaaaactggtacttgacagacagccacttgatggtattctgaagtttactgaccctttgttctatttctagaacaaggtgttctatctctttgcccaaggtgttcaaagtatagagaaacaaagaagatcagtaattacatagaccaaatggagtatcggatttattacgaactacatctgctcaaaagactcatgaactatatggagttagtcctatcagagagaagcagggtatccagctagctcataggcctttttatacaaaagtttaccattagcatgtttggtaacattacttataagccaccccaaccccctccccacacactcaagtttccttaagtgtatgtattagttttctattgaagtacaggcaagcttgactgggttctttgctcagagtcttacaaggtcaagattaaaatatccactagattaaggacttatcttgagactgtgaggagaatctgcttccaagctcatttaggctataggtagaatcaagttccttgcagttataggtctgaggtccctgtttccttgctgactatcagtcaggggccactcttagcttctcgaggctgctctcaagtcctttccatgtggacccctccatattcaataccagcaatggcccattgaaccatcccatgctttgagtctctgacttcttttgccagctaaaggaatctctctacttataaatggctcatgtgatgaccaggataatttccccatcttaagatcaactgtttagtgccttaattgcatctgcaaaatcccttcaaaatagtgcctagattagtgtttgattgaatagccaaggattgggaatcttgggcagtcatctcagaattctgcctacacagcatggttacaatttcctgaaaagctatcctgtgaggcctgacagttatagtacaagcattggataaacattcccatttcagaatggagaaatcagccaacaagaaaggtgctacaggccccatgcaagtttgaaagctggaagggcagtcattagatcttaaagctctaacataatctttgactccatgtcccatatgctgggcataccggtgcagtgggtgggctcccaaggcatggagcagctctgtccctgtggctttgcaggattcatcacccatgactgctctcatgggctcgagttgagtgcctgtggctttgccaggcacagggtgcaagctgctgttggatctaccattcttggatctggaggatggtggccctcttctcacagctccactaggcagtgtgccccattgggaactctgtgtggggaatgtgtattaatctgttctcacactgctaataaagacatacccgagactgggtaatttataaaggaaaggggtttaattgactcacagttccaccgtggggtggggctcacaaccatggcagaaggcaaatgaggggcaaagtcaaatcttatatggcagcagacaagagagcttgtgcagtgcaactcccatttataaaaccatcagatctcagggaacttattcactaccactagaatagtatgagggaaaccactgccacgatttaattatctccacctggccccacctttgacacgtggagattgttacaaatcaaggtgagatttgtgtggggacacagccaaaccatatcagtgtgccaaccttacaattccccttggcattgacctagtagaggttctctgtgaaggctccacccctgcagcagtcttctgcctggacacccagacttgtccatacatcctctgaaatcaaggtggagggtggcaaacctcaagtcttgtgctctgtacaccgcaggcttaacactacatggaagccaccaaggcttttggcttccaccatctggaactgcagcccaagctgtacttgggcccctttgagctgtgggtagaggtggagcagcctggatgtgggaagaagtgtcccaaggctgtgcagggcagcagggccctgggcttggtccaggaaaccattcttccctcctaggccactgggcatataatgggagaggctgccatgaaggtctctaaaatgcctttgaggtctttttcccattgtctttggaattagttcttgggtcctttttagtcaagcaaatttgtctagcaaatggtggctctccacagcctgcttgaattcctctcctgaaaaagctttttctttctttgccacatagccaggctgcaaatttttcaaacttttatgctgtgcttcctgtttaaatataaattccaactttaagtcatttctttgctcccacatttaagttaggctgtcagaagcagccatgccacaacttcaatgctttgctgctgagaaatttcttctgctggccaggcgtggtggcttatgcctgtaatcccagcactttgggaggctgaggtgggcggatcacctgaggtcaggagttcgagaccagcctggtcaacatggtgaaatctcatctctattaaaaatacaaaaattagctgggcatggtggtgggtgcctgtaatccctgctactcaggaggctgaggcatgagaattgcttgaacccgggaggcagaggttgcagtgagccaagatgcaccactgcactccagcctgggtgacagagcgagactcagtctcaaaaaaaaaaaaaaaaaattcttctgtcagacacttagatcatcaccctttagttaaaagttccacagatccctagggcgtggacagaacacagccaagctctttgctaagacacaacaaatgtgacctttgttttagttctcaagaagtttctcacttccatctgagaccttgtcagcctggccttcattgtccatatcactatcagcattttggttgaaactatttaaccagtctctaagaagttccaaactttccctcaccttcctatcttcttctgagccctccaaactcttccaacctatacttgttacccagttgcaaagtcggttccacattttcaggtatctttatggcagtgccctactccttggtaccaattttctgtgttggtccatttttgcattgctagaaagaaatacctgagactgggtaattccttttcctttttctgagacagagtcttgctctgttacccaggctggagtgcagtggtgcaatcttggctcactgcaacttccacttcctgggttcaagtgatcctcctgcctcagcctccggagtagctgggattataggcacacaccatcacaccttgctatttttttttctttttttagtagagatggggtttcattgtgttgatcaggctggtcttgaactcctgacctcaagtgatccacccacctctgcctcccaaagtgctgggattataggtgtgagccactgtgcctggctgagactgggtaatttataagaaaagaaatttaattggctcacggttctgaagactgtacaggaagcatagtggcatctgcttctggggaggcctcaggaagcttccaatcatggtggaaggtgaatggggaggaggcgcatcacatggtgaaatcaagagtgagagacagagtgccacacactcttaaatgaccagatctcatgaaaactcactccctatcacaagaacagcagcaagggaatggtgctaaaccattcaagagaaaaccgcccccatgatccaatcacctcccaccaggccccatctccaacactggggattatagttcaacatgagatttggatggggaccaatatccaaattatgtcaacaattgtgttacttctccatctacttttctcctggtagctggctagtttctcttaacactgattgtaagacctatcctgatttcagaggcatttaaatataaaaaaaattgggacttatttcttgaaaatgttgtacttactagacagtaagacttatttctgaagatacctggtttctaaaagtactactgggaaatataataaatgaggaagtgattaattttgcctggggagtaggtgacatttgaattgggtctgggaggttcagtaggagtttcccaggcagataataggctaaaaggtattccaagcaagggaaacttctattatggtgcttatctcaagatatcctgttaatattgcttgactcctcctggcttgtaaattctttgtggtcattaaccaattttgactcccaaaatgaccatttacctcattattttgccgtttattcatttcatatttactaattttattcatatttatatttgctgacaaaatagtatttccagcagctcattttaaatacagacaagcaagcaagcaaaccccacacaaatccagtgtaatagcactgcctggagaagccactgttaatatattggtgtatatacttcaaggctttatctattcatatgcacatatccatcaatgtatctatctatctagctacatttaaaacaaaatggtatcatatttattagtcataatttgatatattaacttaaccacaatattaaaatattgtactgccagcctgtacattttttgcctgcccagcctcccactgaaggaaattatgcccagctcatagttctctatgcttaattatctgtatctcctgatcatagttgattgaagtaaaggatcagcatccaatctaagggcagcctgcctgtgggtggtcagagatttacccacagggtggaaagctgagctgggtcaatcatatgccactctatgggttatggagttaggcaattgagatgatcctcaatggagctgatgatgtaaggataccatgaccttcagtcaaagccatggcaaggcaagcagaaacaagagttgtgagggaacagaaaaaattaaatggagtaagctggttagcaaagagtggagagtagagccagcctgtggaaaagcagagatgcccagagaatgaaaccatgacttcaagctttcattagtcctgttttttttttgtttagtgtagttttgtttttggtgcagttccagtccatataggtctgtataagaaaggcctcccttccagccttttttcctctagaagtaaaactgtgcatgtctgtttcctgtagccagtcaagcctgaccagaccacagatcatcactgttcatggctatatggcattctattgtgtatagctgccatcactgatttaaacacctactgatggacatttgagtaatttccaaggagcatcttcatggataacttttgcacatttaataaaagcacgatatccttatgatacattccaagaagtgaagttttttggttgaagaatagatgcataatgataagctggtctttagaaagactatattaatttattgcctactaacattgcataagagtggttgctttttcacccccttgccaataatatcaattaaaaagacaaaccaaaatgttgctacatatgataggcaagaagtgatatgtggcatgttatcttttctattttttttttttttggtgatgggtctcactctgtctacctgggcaggagcacagtggcgggatcacagctcactgcagcctcaactcccaggctcaagcgatcctcccacctcagccttttgggtagcatgccaccacgctgggctaattttttgtattttctgtagagacggggtttttcattttgcccaggctggtcttgaactcctggcctcaagcaatcctctctcctctgcttcccaaagtgctggggggtataggtgtgagccgttgtgcctggccagcatgttattatcttaatgtctatttctctgaatcttgagtttattgactaggaattgggctttgtcattagacaggcctgggtttgagttccagctctgcctcttgctgtgtggcttcaggtaagtaacccagttctccattttcccaagtgtaaaatggacataatgggattattacaaggatcagctgagaaaataaatgtgcaacacttagtatagtaaggtaccagtgcagttggtaacttaacatctctgtggctttcacctcagacaaactttgtaattaagtaaagaaagcctttatggaatgaacaattggattaatatgttggagttaagaagaaatatttcggctgggcatggtggctcatgcctataaccccagcacattgggaggccaaggtgggcagatcacttgaggtcaagagttcgagaccagcctggccaacatggcaaaacctcacctccagtaaaaatacaaaaattagccgggtgtggtcgtgtgcgcctgtaagcccagctactcaggaggctgaggcaggataatcacttgaacttgggaggctgaggttgcagtgagccgaaatcacgccactgcactccagcctgggtgacagagtgaaactctgtctcaaaaaaaaaaaaaaaaaaagaagaagaagaagaaatatttcacattttatgtattcgcaatgtttaagaaaatttggccgacttgaatgacagcttttttgtaaatcattttaaatgtgtaattgagttagttttagacttaggtttttgagttgaaagcttactaagtttacacatggaatcaggccatctaagagaatgttagctttgttatgcttgtatgtttatttataggaattactaagttttgaaaaagttttaaacaattgaatgaattaaaaagaaaatctaggccgggcaccagtggttcacgcctgtaatccaagcagtttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttccacctcatccccggcggccggagcctgcagggtgtttgcggaggccaggtcccagaccaactcaaactggacattggaaaggcccagcagaagcccttagtagaaaacagacattccgcatccttcccttggcatcaaactcccaggcacatcccctttccgtctggttgatagccagaggaggcgggcgagggcatcaagtattctgggaaatgtgatatcgggcttcaaactggggaggctcctgggtctcatgtgagagccagtgatcactttgggtcggcccctagctaaaaaacaacaaagtctttccttaaagtgaagaaaatgtgcctgtctactccgtttgttgattcagtgcaatttagaaaaataaaagaacattttgtgatgtattataaaacgcttagaattaccagccatagagtttttttgttttttttttttgagatggagtctcgctctattgcctaggctagagtgcagaggcatgatcttggctcactgcaagctccgcctccagggttcacgccattctcctgcctcagcctcccgagtagctggaatacaggtgcccgccaccatgcccggctaattttttttttttttgtgtttttaatagagctggggtttcaccgtgttagcctggatggtctcaatatcctgacctcgtgattcgcccacctcggcctccgaaagtgctaggattacaggcgtgagccaccgtgcccggcaattattattattttttaaaagacagtctcgctccgtcaaccaggctggattgcaggagcacaatctcggctcactgcaacctctgcctcctgggttcaagtgattctcctgccttagcctcccgagtagctgggactacaggcgtgtgtcaccatactaagctaatttttttgtattttagtagagacgggggtttcaccatgttggccaggctgctctcgaactcctgacctaaggtgatccacccaccttgacctcccaaagtgctcggattacaggtgtgagccactgtgcctgccctagtaggcataattttaaatatttgaagatgttgaattaactgagtgagacttaaaaaaaaattttcaggaaatttcagaatgctctatgtcctcgttgccattgcggctgcctttctcaagaatgcctggcctaaggagcgggtgctggtcctgttcctcaccatcgggggcctagctataaatctgaccccagtctgcccctataccatgtactccaccaggatcaactaggccacgccccacaacaacccagtgcccctccgagatgatgggaacatgctggacatgcccagccacccccaaggcccaagcatggagtggttgaagaaactgcaagcacttccattgacatggagaagaccatgtcccctgtggcccccaataaaaatgtgacccccccgcctccgaaataaataaatcattcagtttctgaaaagtgtttggtaaaatgtgctagacttataaatagaataatacaatttgtaaagtgaacttaaaagcttaagaatgaaataactttttactttgtaggcttaataaatgaaacccttgcccacttttctacaggggtgttttgttcttacaggttttcaagtatctttaatagtctgaaggaagagtgaatacattgaaaatagctggagcaaaacatctggagtcaggctatgatttggcatgctaaatcatgctgaacttggcccattatcttgaagggaggaatagaaaaaaaaatttaaaaagagaaacacaattgcatttgcactttagagagaacaccctgataactgtgaggatctagttggcagaagggcgactacagtgtaatcacaacagggatggagacaaaagtagacatctcagaaataaacacagattggatgtagggtgcgaggcaaggagcctggggtgttcccactgggaattgagtacttctgtgaatagagaatatagcaggagcagggtcagtatttgacacgtgggatttgaagtgtctgccctatacacaggtgaaagtgttcattagctgaaaatactgagggacttccagacgatctggtctggtgatacatatcgaggggtcctcagcagttataggcgagtgtagaaaagattactgagtaggcaaagaataaacggaagagggccgggcgcggtggctcacacctgtaatctcagcactttgggaagcagaagcgggtggattacctgaggtcaggagttcgagaccagcctgatcaacatggtgaaaccctgcctctactaaaaatacaaaaaaagtagttgggcgtggtggcgggcacctataatcccagctacttgggaggctgaggcgggagagtcgcttgaacccgggaggcggaggttgcagtgagccgagatcgcgccactgcactccagcctgaacgactgagcaaaactccgtctcaaaaaaaaaaaaaaaaaaaaaatgccgggcgcggtggctcacgcctgtaatcccagcactgtgggaggccgaggcgggtggatcacgaggtcaggagatcgagaccatcctggctaacacggtgaaaccccgtctctactaaaaatacaaaaacttagccgggcgcggtggcgggtgcctgtagactcagctactcgggaggctgaggcaggagaatggcgcgaacccgggaggcggagcttgcagtgagcccggatcgcgccactgcactccagcctgggcgacagagcgagactccgtctcaaaaaaaaaagaaaataaaaaaaaagaaagaaagaaaagaaaaaagaataaacagaagagggctgcggacagaataccgttgaataccaatatctgaagggcaagccacaaggtgcagggggcagaggcatccctgatacgggaaaagagttattttaaaaagaacttgcaaagaacaatgtcaagggatccaaaggtagggaatttggacagagttcggctttagcatccgcatctcaaatacctgggtacctgggtaatctggtgactgctgccgaatctaagaggactgaggccaggttgccaaactgcggagagtggggttggagggctttcatggcagtttggggcctgcttgtgtccaacaagacaacctgggtcacctcaaagggtgtcttctccaaatattggtgcagaggttagctgggccggcaagagaagggagatgacccactattttgatttcaggcagcagacaccggcagcctttcggttagagttgcggatagggcagtggccttgggggcggggctataaacctgggcgggcattcccggcagggcaagctcagcgtgagcccgattggaggatgggctctaccttcttccttccgcctacggagaccatagcgggatgcagggcggggccgggctgagggggcggagttaggggcggggcacggtgactctggccccgcctctttccggccgctcagggcggtgtcgctggggcggtgccgctggggcggggcctgcggggtggggctgacggcacggggcggggcctcggggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctgtgagtgcggggctccgcggcgcgggggcttcgggctgggctaattgcagacgaggcgcgattttcctgggggctcggccgggcgggtggggcagggcggctgccggcagctcggacccggaagagccgtcccggtggggcggcgggcggcgggcggggaggcccctggttcgcgccccctcggggtccgaggcggcggagaggacccccgaggcctcccgccttagctggggccgcggtagggggagccccacccagcgcctctcgccgcccaggctcggccgagattggggaagacggcctagagtgaggtggcaggatgaccgcgcagggcgtgtcccggggattgggggtctgggtacgcgggctctgcccgtttcgtggaaaggcgctgccctagtgttgcctgcggggtagacccaagggatagaccagggtccagacctgtccggtcccaggctagctacgaggtgccgtcctgggcaagtcacttcagttttctcgggcttagttccctcctcaagatttcaaaagtaaaatagtaataaagaaaaaaaaaagaagcagaaaatcctctgacttcctcattttctgttgtcggccctggacgtcattgaactgcaggcaggattggctaaaggaggaccctttgggattttgaggttttcggttttattttatattgtgggaataatgttcttttttaaaggatcaacatttcacgcatcaacagttatacgtgaggtattgtgccacgtttgtgaaattaaagatgagtaagatcaggccctgtctccaaagagcgttttaatcagagagtcaggtgtgcaagctaatgattataaggtgcaataatgataaaagatgctgaacttactagccatacagagtaatgtaggtaaggagaaggggcctggggaagacagtatgagcacgggaggtgacttttttttttttttttttggagacagggggtcttgctctggtcgcccagcctggagttcagtggtgcaatctcagctcactgcaaactccacctcccaggttcaagcgattctcctgcagtctcccgagtacaggcgtcggccaccacactggctaatttttgtatttttagtagagacagggtttcactgtgttggtcaggctggtctcaaactcctgatctcaaatgatccccacgcctcgacctcccaaagtgtgagccactgcacctggcctgaaggtgacatttgaacagagccttgaagaatgctgtgtagaaagtttgacaggtggccaggcatagtgactcctgcgtgtaatcccagcactttgggagtccgaggtgagaggatagtttgaggccttgagtttgagaccagcctgggcagcacagtgagactccatctcttaaaaaaaaaaaaaaaaattagccaggcgtggtggcccatgcctgtggtcccagctgcttggggctgaggtaggaggatcatttgagcccagaaagtcgaggctgcagtaagccatgattgtgccactgcactcgagccggagtgacagaacaagaccctgtctcaaaaaaaaaaaaaaaaaagtttgatagggcatgtggaacaagagacaggacctgagggaagagcataaacaaaggtattgaaagtagagggatactgtgttgggaactgagtgatgtagactgcacagtggtgggaggaagggaagaggagagtttccaaaaatagttgggaccagactgggaaaggccttgaatgccttcccaaggagttaggaatttattccacacctggtgcccatgaaggaagcagattgcttcaaggttaagctcaggctttggagacagactctccaggtttggattcaggccctgtcacttatttgccatggggctgagttcacccagcctcagtttcttcgtctgtaaaataggagtgataatcacaggattgttgtggggtttcaatgagagaatgcgtgtaaaatgcttcgtacaattactgccacttatgtctcaataactgctggctttggtcattaataaaagagggaaacaatattatcagatctgtatttagaaggagttctggcagatagggacagatttgtgccaaaatctcaagacagtatttttcaagattacactgaaacttagtacatatttatattatcatacatttttaaaaaggtcaagatgattatagttgaaaccacatagttctttttttaagaaagtcattgtagtacacctggctggctacacactcattagttatcctgactttctaggtgagtggcaggaaattgattctgtggcaatcttttatcactcaggaaggctacagatcctggtgtttacattctttcttttatgttgtagctgtcctggataatgaaagacttactgcagaggagatggatgaaaggagacgtcagaacgtggcttatgagtacctttgtcatttggaagaagcgaagaggtaaagattggctggctggagagaagattaagagaagggaactgataatagtgtgaatacaaataaagattgctttgaggctgaacacagtggtccatgcctgtaatcccaacacgttgggaggccgaggtgggggggaatcacttgaacccagctgtttgagaccagattgggcaacatagtgacaccccatctctacaaaaaaattttaaaaattagccaggcatggtggtgcatgccagtagtcctagctactcgggagcctgaggagggaggatcacttgagtccgggaggtcgaggcagcagtgagccgtgctctcaccactgtgctctagcctgggtgacaaaactcctgtttttggtggggggaaaaaaaagaaaagatttatttgagtatgttatagatgtaactgggaagctggtggttgagggaataagtataggtagggtatttatttatggcaataagtagccttgatgagagtttatcatgaatcactgtgatgggcatttaagtgtactgaacggttttccaggtttctattgttcagtcttatgcttattgtgcatgttttgggcgttaccaactgtggggtggaaatagcatttttaggatttgaagttattggctttaatgtttcacttatgcttcatgaattttgatttatatatgaattgagtctcctcctcctatgacctgcggagtggctgcttggtttgggaggcttagaagcgtggtgctgttggtgtaggtccatctgtttggcaatattcagagtcagcatcctctgcattctttgtgaagtgaatgtaaagctgctcttttcctttttcagatgccccacaaccttgtggtcttaattttagagtgtcattttgttatcagtgattcatttcttttgttctggtgcttgtgttcttttgcagagtcccagggtagatgtaattatagatcatgtattctataagtgagctttggtggaaaagtcaagtgagggataatgaaatatttgtaattaacgtttaataaaaagggtgtttgaagtggtgctaataaacaagtgtgtgtgtatgtgtgtattttaattctgaaaatcttaaaatgctacaagaaagtccagagaacagtacaacaaacatcattgtattccagaactaacaaatgttaacatttgagatatttccctttcctctaaaaacaaaacaaaacaaaaccaacatcgctacatttaaagtcttttttgtgcccctctggtcccattcttccttctcctggggcaaacactaacctgtattttgcatgccctcttgtgtctaggcttcttttctgagcttaaaacttccaggaaactggagcttgggtttcagtgatgacttaagtgaggaggataacacttgtctttctaaataatagaagatgacatagcaaggcatgctatatcactagaaaagggggcattttctcatatgaagtttataagaaaacaaaaactgtaagatctctgccatttaaattgtggatttcaaggtttggaaggtcaaagaatttggaagctgcagctgttctgagagaccatcttgtgctctgtggagctttggtgattccactgaggtgacctgggggtgagagggaagagcttcaacacaccttccttcccccatccaaagtagctctgcttttgttttactgttgaatttcttgaataaaattcacttgttacagagggtgttttggctaacacctcccctcccccaaacactaccaataactagttcaactgctaatctagttcaaccatctcatttaatgaagaaactgaagcctgagttttttggtctacttgtagttttcttgattgaagaatgtttctatctttttttttttttttttgtacagtctcgctctgttgcccaggctggagggcagtggcgcaatcttggctcattgcaacctccacctcccgggttcaagcgattctcctgcctcagcctcctgagtagctggaattacaggcatccgccactacgcctggctaatttttgtatctttagtagagactgggtttcaccataatggccaggctggtctcaaactcctgacctcaggtgatccgcccgtctcagcctcccaaagtgctggaattacaaacgtgagctgctgtgcctggcctcatcatttttttaactatggttgttaaccaggtgtgtgcattagaatcacctggggaacttaaaaaaaaaaaaaaatacacctatctgggccctaccatagagattgtggttcagtaggtcggggtgggagatccagacacatagtagtcccttggtatctgtgggggtttggttccaggacacctgcagatatcagaatccacagttgctcaacttccttatataaaatggcatagtatttgcatataaccttagcacattgcataatatatacttgaaaacatctctagattacttatcatacctctagattactctagatatatctctagattacttatcatacctgatccaatgtaaatgctacataaatagttgttacactgtattgttttatttatatctttctttatttttttctgactgtttttgatccatagtttgttgaatccatggatgcagaacccatggataaggagggccgactgtattttaaatgtctctagtgattccgatgctccttccttggcccccactcctccccctgttgagaaacaagatttaaaactctgccttatgctgggatatcatgacctcagtagaatgttacacttcatcctatttcttcatcaggttctgcattagccaggcattttattttcagctactctagagcgtctttttttctgtcaggtgtttttttccagtataggaaagtagcccatttcctttaaagaccacccagcaggcatgatcccctgaggtgtttttttgttgagtgcttttgcatacttaaggagtaactgacctggcccggtggctcacgcctgtaatcccagcactttggaaagctgaggtgggcggatcacctggcggtcgggagttcgagaccagcctgaccaacatggagaaacccccgtctctactaaaaatacaaaattagtcgggcgtggtggcgggtgcctgtaatcccagctactcgggaggctgaggcaggagaattgcttgaacccgggaggcagagcttgcggtaagctgagacagtgccattgcactccagcctgggcatcaagagtaaaactctgtctcaaaaaaaaaaaaaaaaaaaaaaggcagtggagacatttgtgatgatcttcaggtttttttttttttttttaagggagggcataatagtggcatattaccctagcacaccctgcccattggcctggcatcatggaaaggtgcctggtctattttatggaggcaatcataaaactgggtgtggtgatttttgttgttgtttaaggctttgattttaaaaaatcaaggttggaagcacctatttagattgtaaactagagaggacaaaggaaagaagcctgggaatgttatggtgagaaaagaggactagaatccctgtcagccacctatgtggctgctgccacccctaaaaagtgttgtgagtgcaccaaggacaaatggcatgctcttcgttattagtgagctattaacctcttccagttctttctcctaccttggtgaaccggcctgtatcttgtgtgttccgagggcccctctttcccctctagcgctagacccagtttgcctttttggtttggttccatcctgtttcctccataacctccacccctcccaagttggaggagccccaatatctgggatttacagtaactctaaggccaggaataaagatcatagagattggagggagaaaagcttcccctcttcagttctatttataatacctctacttctactaaaagctccaccttttagtacagtggccccattgtgtatcctagggcactccattttctcctctgcctgtaacagagctctttcttgggaaaagagaggagtgtgtagagagtgaatatgactgtgtagaggcagtgagtataagtaagagagtataagtgtagagagacgaaagttttctgtggctgtgggtttgtgtttccctgaaaggttaactgggaaaatttaggggtaattcctataaatgagcactgggagtggttgagaaatagaaaatgtagagatttctgcttttcttcattgtttggagagcagcttcaatattgaaattaagccgctgttctaatgagatatcacctaacgattcaaggctttttgctaagggctgcacaatagatcaaggatacatcttaaattattatttatgcttaaattgaagcttatttttatccttttgcctgttcttattgagttttacatttgtttaggctaaggagcggggttttttttgtttttttgtttttttttgaaacggagtctcgctctgtcgcccgggccagagtgcaatgacgctatctcggctcactgcaagctccgcctcccaggttaacgccattctcctggctcagcctcccgagtagctgggactacaggcgcccaccaccacgcctggctaattttttgtatttttagtagagacggggtttcaccgtgttagccaggatagtcttgatctcctgacctcgtgatccgcccgccttggcctcccacagtgctgggattacaggcgtgagccactgcgcccggccggctaaagagcagttgtataggagcaatgaataccgtttcactcagttgaaggaggtaacatttaaatatgtgaggtatgttcagtgcttaggtcttggacaggaggaagtaacagatcagaataaggttcaggtgaaaagaaccaagaagagaacgtgtcaggcaggacagaacagggaattctgcaagtgagaagaaagtacgattagtactggaaatggaagaaaattcagctaggttaaaggtcacaggaagaaagttaattccagcattctctgagtttcagacaattcctggtgtgcgctttcaagtctgtcatgggccacctttctgctgctgagtgcccgtaccctagctcaaggaatagggcacacccctcttgtagaagggaaggtaggaacgctggctggttggagactgtcagcaactccacggtgataagtcgagcttagcactaagtagaagtatgtcactttctgtaatttagaggaattgaaaaggtatcttggaaagaaattagttcttgggaacaaagtcttttttgtgcatatgtctttactgttggcatagagcattttctgggatgggctcttcagatctcctctccctgtaagtgatttcagaattccatgaatgttgggatatgtccaggctggcaccctgggatcatgaaaatagaagttaagacatttaagaagcaagaaaacaaaatgggtaggtgaggtgactaggaagaatatcatgcccagcacttctagaattctcaaaatgaggagcatcacttaaattttgagggggatcatttttaggatggtgacccaagctctctttgtacagatgagaagtctagttatctcatgagacccagtgtgactaaaggaccatagcatgtagctgcgtaatggcacggtggcactaggagctgatccattcatttatttataattaccaaggggaagtatggggtgagatttattcttaactcttaaaatggtgacatacactattttaagaataaacctccattcttttttcggatattaatttagtgcaacggccttggacaggctccaccataagaagtgggttgcatttaaaagtgtatttattaaaagtggttgaagctgagtgcttttctgtattgtaacactgttgcaaatggggagtattcattcctaatgtggctgccgaaagctttttaccctaccatgtagctgaaaatttagcaaaaaaaattttttttttttttggagacggagtctcgctctgttgcccaggctggagtgcagtggtgcgatctgggctcaccacaacctctgcctcccgggttcaaacgattctccttcctcaccctcccgagtagctgggattacaggtgcccactgccatgcctggctaatttttgtatttttagtagagatggggtttgaccatgttggccaggctggtctccaactcctgacctcaagtgatccacccgcctcggcccccgcaaagtgctgggattataggcgtgagccactgcacccagcctagcaaaatttaaaattaagaaatgtaaagagttgaactagttagtacccattattattaagaaaagtcatgtggctctatattctcatagtacgaataattaagtaaaatagaaattcaaaagtatgaataaaatttctttgaaaatcttgaatgttgagatatcttgccacagtgaaaagaatcagactttctgttttggcaggtgtgagttctgattctggttttgcaagttgcttaacgtcagggagtgagcccaaatttgtcctttgcagaatgggaacgctatgcatcttacagagctgctgtgatggttaattgcttggcacagtgaaatacagtaggcactcaacaaacttttttttttttttttttttttttgagacggagtcttgctctgtcgcccaggctggagtgcagtggtacaatcttggctcactgcaacctccgcctcccaggttctcaccattctcctgcctcagcctcccgagtagctgggactacaggcgcctgccaccacacctggctaattttttacatttttagtagagatggggtttcactgtgttagccaggatggtctcgatctcctgacctcgtgatccacctgcctcggcctcccaaagtgctgggattacaggcgtgagccaccacgcccggcctgaactcaataaacttttatccaagcacctggataaaggatatcctgaattttttcttttctttttttttttcttttttttttttgagatggagtctcactcttgttgcccaggctggagtgcagtggcactatgttggctcactgtaacctctgccttctgggttcaagcgattctcctgcctcagcctcccaagtagctgggattacaggtgcctaccaccatacccagctaatttttgtattttttagtggagacgggggtttcaccatgttggccaggctggtctcaaactcctgacctcaggtgatccacccgccttggcctcctacagtgctgggattacagacatgagccactgtgcccggcctcctgaattttcacattaaatctgcaaaaggaaaagcagatttaatgtgaagatgacaggaattttctgggcactttcaaggtcctaaggttggtagccctagttttttcacttcagaccttagcttttatctgaaggaaaacaccagaaacagaagatacttctagggagtggaatgggggtagagggtgtgagatttcctttttacttaatactgtactatatatttaaaatgctttttacagtgataattttataataaaggaaaagaagggattaagtaaaaggaaaaactgtgtatataatttttagatataatcacaaattcagatttttaagttactacacagatgttcctcgatttaggagggggttatatcccaatattgtaagtcaaaatgcatttaatacacctaacctactgagtatcatagcccagtccaccttaattgtgctgagaatactgatgttagcttacagttggacaaaattatctagcacaaagcctatattacaataaagtattaagtatcttggctgggcgcggtggctcacacctgtaatctcagcactttgggaggccaaggcaggtggatcacttgatgccaggagttcgagactagcctggccaacatggtgaaacctcatctgtactaaaaatacaaaaaacattagttgggtatggtggcgtgtgcttgtaatcccagctactctggaagctgaggcacaagaatcactggaactgggaggtggaggttgcagtgagctgagatcacgccactgtactgcagcctgggtgatagaaccagacattgtctcaaaaaaaaaaaaaaaaaaaaagtgaatataggaaatcttccttgaaaaaacaaagatactcctacctcagcttctcaagtacctgggactataggcccacttcacctcacctaactaattaaaaaaaatttttttttttgtagagatggggtttctctatgttgccaggctggtcttcatctcctggggctcaggctatccttcgctaaagtgctgggatacaggcgtgagcagccacacctggcctgtattgtcttaatttactattttcagtggccatctaatgttcataatttatttaggtttattcctgtttaaagttctattgctttgattgctggagagtttaaacattttcttacatatttgtttatcagtattattttcttatgcaaattttctgtttttgttatgtgcctggcttctagggtcatgatgttaacttttgtgagctcttttataacatggacttgactttctctcgtatttgctacaaacattttcccttgatgtttcattgtatttgttttcttcattgtagttttaaattttattgagtttaaatgtcagtctttcgatttgtaatttcttctatcaactcgaagtctagatagtttaatttctctaaaaccttgccaaaattttcagtttaataatcgattggcttactttttatatatttgtagagatggggtcttgtaatgttgattgtaaggggaacttatcccgaacttctggccttaggtgatcctcctgcctcagcctcccaaagtgatggaattacaggcctctaatatcctttaaaaaccagctgtttattacctattagcaattcatgtctgttttgtcaaatattatgtatatatatatttctagttctggacttttaaattatggtgaaccatatttcatttttttgagaaaaatatatatgactttgttatacttcttatcattgagaaacaacatctgaagctagcttaattttaactctatgacaagtaacttgatttttttttccttttttcgtgacttgaaatttgtagaattgttgttccttgaggtataaacatttccccagttaacatgttagggttgctattggcttagcaattttgcctgcaatgtggagactcttcttggtttataatgtctcttgtttgtttattttagctttaggaaattgtccattatgcctgtggtgattagttagatctgtgtagtctattttatggctcttcttcattttgtttacgttaaataagcgttctaggtatgtgtctcacatacatcttttgttgcactgacttgattttctacagtcttgatattttttccttggttctgttaatggtagttgctttgtcctattgtagtttatatttttaattaattccttttccgtctccattcttgttaatagcttaaatgatctctttttagttcatgaagaagagtgtggcacaaaagatcctttcaaggtgaaaaaaaggagcaggtagccaagatagttgggttacatagtttaccacttccctttataatccgtaggtgttgaaatagatgtggccatgaaaaaccagtgttaatcgggcagctgagtgtatggattgtccaccagtcaaggttggggaaaaaatctggctgggctaagtgtggcccgttagtttgacctcatttggcatgtatttcttctggtcttacaggtcagagcaactgtttttatatattttaatgtccctaatgacaaaatagtaaaaatacatttgaggacccaagttggcatgttctaggaatttcattttccggcttagtgtggtgacctgcctctgattgctgtacaattccttctgcttcacagtgtcacatctggggataccagttggtagtggaacctgttttggacatttttaagccttgtggtatctgatggactcttggttgtttctagctggtgctaaataaaccccttgacaagaagtatttgtgtaagaaagcgctggtaggcaaagtgagaacatccggaagtgattcatattactgtggttgtttgcttaactcaggacttggttgcctagagaccatatcgttgagttagccgagtgaagtgccagtggaacctggagggcctgtggcctaccggatcaaatcagggctctgctccttaatttttctcctgaagtctcctagcaatctgattgatctctgtggtttgacagtgcgtgaattaaaaaaatcttaaacatattaatgtttaagaaagatctggttaatggtttattttgaagagtaagagtttacttgctgaagtttgaatgttgggttaaaattttttaaaaaaatagttgtatgttgggaagaattagttatttcaataaggcattttattctagaaacctcagtactttaaggcagctaaaggaaagccaaaataatcccccaaaacaaaaaaccaaaaacctgcaatttgcaaggcagtcataatctaaaatattttctgtctgtcccaaagtcagtgtattccccttgcctctccccctcttcctcattgtcatgattagtaccgtttattgcatactttctacatgcaaggcactgtgctaagcactttatatgctttatctaattagctattcttgaagccctgtgaggtgcttattatctacatttaacagataagaaagcaaagctcagagaggttaactcattcatctaataagtggttgatccagatttcaggtttggcaagaactctgaagtcctttctcttaactgccatgttagtctgctgctgctatacttctggttctaaaaataatgacaacagtagtaactactgttaattaagcagaatgatgatgaaatttacatattacattattgtgagataggcattatttttattttaaagagggaaaaaaatagagttgataacacttttcccaaggtcatatattggaattcaagcccaggtttgtgacaccaaagctggtgctcttaacttctgcagatgctgaagtggcaacatttaagtctaacctctttaactggtgcccagagacattaagtaacttgtgtagttttcaagtcagtgagggaactccatcaatttcctgccacttattttggagtctcttccacctgccacctgagggaaagtctccagttgtcttatgtatttttgtgtctaactagcttgttggacccttcctaattgcttcccttcttcataacctggtatctgctttgaattcagcttagaaaggtgttccttcctaccactttcttgtttgttaaagagttacctcatacagacaggagtggcaaattggattggaaattgctttggatcatttggcaagaactgtatttttggggttgtgggaggaggagaggcctgtctaaaagctctatttcttctttactcagaataccttcctgttgactcattggaaatcataacaaaaagcagaaggaatattggagaggcagctgccagcctagggcttggcttctgttggggcagctgtttggggatttagacacactgggctctaagaactgtgaggtttctgcagcagaaggaaatagtattactctgataggtatttattcataaggttaaaaagtgtcagactattgcttgggattattgatgagcaacataagaaactaaaaatattttctcaaatagaattaactggtgatcctaaaaacagaatgaattgaggaatacaagagggagtgggggcaaaattagaaaaggaaaagttgaaaagaagagaaaaaaaacttacaatcattaaaaataggaaaaagataacatttaaatagaaaaagtctcacagatatgcatgcagtaggcattaatcagcaggtcattttactgtaagtaacatacatctcagatgacctttaaaacagctaaaagtaaacaaaatttgtcttttatttaaatgactattataacaaaatgtttttttgggctgggccctgtgattcacaccagtaatcccaacacttacggaggccgaggagggaggatagcatcaggccaggagttcatgaccagcctgggcaacatattaagaccctgtctctacaaaatataagaaataaaaaaaagccaaacgtggtggcacacacctgtagttccagctactcgggaggctgaggtggaaggatcacttgagcccaagagttcgaggctgcagtgagctacgatcacactgctgcacaaaaatgtgtttcttccctgaagacatgctatgtcattagtttgggcaataccttttcataattgatagtttaaaaaggtagtgtttgacaatggcttgacttttggggttttccttaaaaatttgagaatccccataggaatgttttttagatagatttggtcttaatttaaaatttttaaatttaaaacatttttttcttagaaataggtaatacacagacgtgatacataattcagagactatgcaagtatataacactgaaaaaaagtctatatccttagtcttctttctctagctattcagttattttccccacatggaactgctatcatgattgtgtctctttccggagatattctgtgcatgtaaatacaaattactttgatttgtttagaagtggttgcacactgtacattttgctttacatctttttgttgttgttttttgagatggagtcttgctctgttgcccaggctggagtgcagtggtgtgatctcggctcattacaacctccacctccagggttcaagcgattgtcccgcctcagcctcccaagtagatgggactacaggcaatccgccatcaggcctggctaatttttgtatttttagtagagacagggtttcaccatgttggccaggctggtcttgaactcctgaccttaggttatctgcccgccttggcctccctaagtgttgggcttacagacatgagccaccgttttgctttgcatcttaaaattcattccatatgagtgaatgtggaatgaagtgcctctttttttccttcacagttttagttttcggttttgaagttaacctgtcaacggacattttctcctcagcttttgctgttataaaaagtcactttgtaggtatgccattgtgcatgtatgagtattcttgcaggataaatttctaaaagtgtaatttctgggtcaaagggaatatgcatatttagttctcaaaaatattgccaatttgctctcgtaagaggttgtaccagtttgcacatctgcctgtcaataatgtacatataagaaggctgtttccgctttaattttaccaacccagagtattacagattttttacatttgccagtttcataggtgaaaatggtatttcattgtagctattttggattatctaattatgagtgaagatgagcatctttacatgtgtttaaaagccatttgtatgttcttttctgtgaactttttcggtagaatcctttgctcatttttctattggattattcatctttttcttattcattgtggtaagagctctttatatattgaggaaattggctcgttgtacaccgtgggtgttataaatattcattccactttgtcctttaattttttttttttgagaaagtctcattctgttgcccagcctggcgtgcagtggcccgatcttggccaggttcaagcgattcttgtgcctcatcctcccgaggaactgggattacaggcgcgtatcaccacactcagctaatttttgtatttttttagtagagacagggttttgccatgttggccaggctggtcttgaactcctgatctcgggtgatccacctgcctcgacctcccaaagtgctgggattacagccaagagccacctcacctggccattgtcctttaaattttgactttgtatttcaaataaagttttaaaacatatttgaacttactaatattttacttttagtttttgaattttttgcatgatttttaaagagtcttatctatactgagattatataaaaacattctcccatgttttcctctagtatgtttaggatgtaaagtgttttaatatttaactctttgatccatttggaatttattttggtgtgaggagtaagatagatcctgcttttttgacttttgaatcgtattttacattttgagtcttagcagtgtcttaggaaatgtgctctggagggtgtcttgtgctctagtttatgaactgatatcttaatttttttcagaacaaggcagcttcaactgttgagctttttgaaacatatggcttaactatcattttagggaatttggttaggattttccagagtgctttcaagcaagttatattgtaatgctaaacagattaatatcgtgtagtaaagttggcgttgagaaaacaggttttgaattaacagctttgacataaagactgtgaagagattactagacttgccaaactaacataatttattctttgtgtaaaggagagtgcaaatttggagtttgaaaaactgtgtggctgactttctagatcagtattttttgaggtatattgtgctgtgacattaaagaaagggtttagtggtgaaataagcttcagaaatactgagttaaaccaagccaaatattattcaagtggcaaattatttggaatctttgtcatagacttgtaaattctgagtctccaaggcaaaggatagtgtatgcaatattcctcaaacctactttatcaatagtgttccaggttttttttttttttctggtttgcgaacacttttttttctatcagttacggatttgagggactattttttctttcttttactttattttttatttttggactctaagactttcttcagagactatttcaaataagaatttgggagatgttcatggtcacttctcagctattttgtgttttatgatagttagtttacattctccgttgagttatcctgttcttggcttatagagcttaaattaaagccataattgtactaattggataggtataattgctcagtgatctttaaggcattgcaaaggacgggagtgtggtttttaaaaatgaggggtgcaaatgtactaattattaaaaaggaaaagataaatatgacaaattctggtctagtaaactagtttctggccaaacattggaccagaaaaattccagagcacattgtcagatgcataacttatgaacacttagcgagaaaagtgatgcttgggagccaacatgggctccctaaaaaaagccctgtcacattaacatcatttccttttggacagggtcaccagattggtgaatcagagaaaaacacacgcctggcaattttttgtatttttagtagagacggggtttcaccgtgttaaccaggatagtcttgatctcctgacctggtgatccacccgcctcagcctcccagtgctgggattagaggcgtgagccaccgtgcccggccggggtttgtttttggttgatgaaagtgttctggaattagatagtgatgacggttgtacaacattgtgaatattctaaaagcaactgaattgtatattttaaatgagtttacgttacgaatcgtatctcagcaaaaagagctgcagatttttagttcagagaaagcacttttagggcatgttatttgtaaacatttttattgggacttactagggcgtcagtgatgtgtcagtgaagttaggattttacttgtttctagagagatagttaatatattgtaaggcacattttgctttcaatgtaccgtgaatctaataatgaaattcaatagtaataagtgtgatgtcctacattggagttcaaaaagtgtataggataagggagagaagtagcgttagtgggaataacgttggtgggaaacgaaaacaaaatgaaagaaacctgagaagttcattaactcattagtagatatatggtatatgcagccaaggaaaagatggttccactgtcctctggactaatcagaggcttcctgaaattggtgtttagttctggaggccatactttaagatggatctcgtagtctagagcaaggatgttagatttgtggtaggttattttacacccacagcaagcactgctgatagatcagaatccttttcaacgtagaagctgaggaaccactcccaatcagtgggtgttggttgtccattagttgagacttagttgttgctctgggatgagagcgtgttcgatgagtatgaccaggatgataaagggtctaccaattatgatctatgaagaataattgggaatactgaggctatataaaatggaaacaagatttagaagaaatataaaatcagaatctcagaagctcaacctttcatctagtttaggaattcagtcaactgttatattaacattttacctactttactaaaaaattcctgagagatgggaggggagttcattttgtcagatgtggtgccaggggaacagaactagacaatggaaatctgcttaataggaggatagtttcttatataacaataagaaatttccaaacggtgtctgagctgctttgggaaaacccgtgttgcagattttcaggtttagactgtgtaacagtttaatggaagattgttatgttctaacctaagtattttctcgttatttaaaaacaatttttatttcatttcctgtgttattaaaaactatttttattttgaatgacttgatactattccattgctcattttttctaacatggctaagaagttgggaaaattcctccaataaaataattactttaaagcaagtaaaacacgtttttagctcctccattgttcaggacactctgggagaactgaagaagatgcgaaagtataaaacagtcctgcccttaggagcttacggattaattgaagacagggcataaacatttgaaaagttacccaacatcagagaatgagaggtctcagtgtcacaaggcaatatgtaattgctgaggaaatgatgcaaatagttaatgtgtgagagtttagacagggaaagattattttatggctgggtttttcaggataagctgacattgtatggtcaggcgtttccctttcaagggaaagcataacactatgtatacttgtcttgttctctgtgctcctttagagttgaagctctttccacttcctggtacccaatggcacctctcaccacagtgctttttacaaagtaggtgcttggggatattgttaagttgaatgagtacagagttgtgtggtatgtgggggttgtggtaggaaaaagaatttcagtgttatggtgataagagcttggggtaattttctgttttggtttttgtttttcttttattatttggttataattgagaccaggagtaatacggtccctaagcaagagagaaagagcagtgtgtgtctttcagtagagtctttctaatttattcaaagataaattagaaaaggattctacccttatgtacataaataactattaggcgataaagagatataaagtgccataagaaagtttagaggaagtttggaacgagaagagattatttctgatggtaggtcatgaaaaggttcgtggaggagaggtgacttttgaaggtaacatttgaattggcagggatgggtggggctgatcacctaaaagttatactaaaccttgtattctttgtgggcatccctgtctctaccttcctgcatcgtggcttgatgacatctattttctctcaaaacttcttcacattttggccctaacaaatttaccccatctcatttaacatgctatcacttaaaaaattaattaattaatttttagagaaagggtcttgctctcttgcccaggttggagtgcaggggtgcaatcatagctcatggcagccgggaactcttgggctccagccatccccagacctcagccttgtgagtagctgggactgcagatgcatgccaccatgctggcttaacatgccatcttgacctctttccctgtagcagtgggaaaaacgtatttttctcctaacacttaaccttctatgtgtgatctagatcctatcccttcttgtcttctagggttcttattccaatattattttcccaactataacttgcactttttttcctgctgcttctttctctttagcacatgaacatcctcacccattcaagatacacttccttactcctagataccctgattgttttcccctctttgttctttcaaggaaaatttcctatattcactttttttttttttttttttttagataaggtctggctctatcactcaggctggagtgcagtggcacgatctcggttcattgcaacctccacctcccggcttcaagcgattctcctgcctcagcctcctgagtagctgagattatgggtgcccgccacaacagccagctaatttttgtatttttagtagagatggggtcttaccatgttggccaggctggtctcgaactcctgacctcaaatgatccacccgccttggcctcccaaagtgctgggattacagacgtgagccactgcgccaggccttaatttttacatttttttgtagaaacgggtttcactgggttgcccagcctggcctcgaacttacgaactcaagtgttctactcaccttggcttcccaaaatgctgggattgcaagtgtgagccactgtgccctgcccctatattcacttccttaacttaactcatttggatgtaattcctgtgccttccttttccccattgaaatttctcttgcttagttccaccaacagtgtaaaagtgttcctatttctccacatcctctccagcacctgttgtttcctgactttttaatgagcgacattctaactggtgtgagatggcatctcattgtggttttgatttgcatttctctgatgaccagtgatgatgagcattttttcatgtgtctgttggctgcataaatgtcttcttttgagaagtgtctgttcatatcctttgcccactttttgatagggttgtttgtttttttcttgtaaatttatttgagttctttgtaggttctggatattagccctttgtcagatgagcagattgcaaaaattttctcccattctgtaggttgcctgttcactgtgatggtagtttcttttgctgtgcagaagctctagtttaattagatcccatttctcaattttggcttttgttgccgttgcttttggtgttttagacatgaagtccttgcccatgcctatgtcctgaatggtatttcctagttcaaccattgtggaagacagtgtggcaattcctcaaggatctagaactagaaataccatttgacccagccatcccattactgggtatgtacccaaaggattataaatcatgctgctataaagacacatgcgcacgtatgtttactgcggcactattcatgatagcaaacacttggaaccaacccaaatgtccatcagtgatagactggattaagaaaatgtggcacatatacaccatggaatactatgaagccataaaaaaggatgagttcatgtcctttgtagggacatggatgaagctggaaactatcattctcagcaaactatcacaaggacagaaaaccaaacaccgcatgttctcactcataggtgggaattgaacaatgaaaacacatggacacagggtggggaacatcacacactggggcctgttgtggggtagggggaggggagaggggggagggacagcattaggagatatacctaatgctaaatgatgagttaatgggtgcagcacaccaacatggcacgtgtatacatatgtaacaaacctgcatgttgtgcacatgtaccctagaacttaaagtataataaaaaaaaaaaaaaagaaaaaacattcccaagatcccctcaaaaaaaagaaaaagaaaaagaaatttctcttgctcatatcaccaatggcctaattgctatgtcccatggaaatttttctagtacttaatctctgcagcatatgtcactctttcctgttcaattcatggagttttcttccttttaattgggtatcttttttatgctttttgaatttcgaactgtgtattgaagtattgacctgtgtaaaaaatatattgcctatctaagaaaatcagttagcattcctctgggaaactcacttggccatccatccttaccccaggtctaagttagatgttcctctctcatgtatctttattataacttttctctttcctaatgcactgttagccttagaaggcaagtactacgttctttctttctttcttttcttttcttttctttttttttggagacagggtctcactctgttacccaggctggaatgcagtggtgtgatctgggctcactgcagccacaacacccccaggctcagatgatcctccttgtctcagcctcccaaagtgctgggattataggcgtgagccacctcacctggcagtactgtgttcttaatgtatatcatagttaacccccactcccttattttcttactaaataataggtgtgaaaattaaatttttgacatatatggctctagcagaggattgcttttacagagaaataggtgcctgtcttctactttgtagaggactcttacctgttgttttcttctcaagagctgctcacaggttagtaatgattaggctgtagagctgctcacaggttagtaatgattaagctgtagcttctgagacttagctatcatctagatttaactcagttttggaatttcatttcatttcatttaagattaaaaggtctttcatgctccatggtaagtggtaaactagggatggatggatagatagacagctgaccatggtaatgtttcaccagactctggatctgaagacttgatcaaggagtaagtaatctattagccgagacttaaacaaacgaaaaactttattggagtttaatacacatcccacaaaatccacctgtttttttaatgtacaattcaataatatttagtaaatttgctgagttgtgcaacccatcactatgatctagtttccatttctccaataagaccagggactctattaaaataaaacaattagacatgtaattttgacaagtagacttgacctattctatctgattatgctaagaatgaagtgatttgctcaggggtctgtattagatataaatacacacagaagttaaatatataacttgaagcaaaaacatttccctgtttttcacttattcctatagcttttcagattggcctaatttatactcaggtttcctttaaaacagatactatcaagatttctcattttgcttgtatggtttgaaaaacaagccttttttgttccttggctggattactgcaatactttctttagtgtctcctcacttctctctagccctttctcctacaactgctcagaatggtcttttgaattaaatcttattctttaattcctgtgtaaatccttccaagggtctgcacattctctgcccttggcctgacgtattctcccttatcagcacataccacaagtctttcaagacctataaaatcagtaccattttctctgggaagtcatcctgattcccctctttctgcgtatggtgaagaatgctttatggaatactctgcattcctttctctcaagacttagatttaccattaccatatggaaatttctaggctgtttccaatgcctaggtggtgctcagaagtgttagtggtttagtagaatcctaattgtggagaaagacagccaaatttgggaggtttttagcatagagtaaccctggcattcagggatgtttgctgtgcaagatgggtgtggtaccagaggagctgttcctggaggaactgaatctcagtggcttgaagtggtcagttccggcattggtatgttccccttctgtattgcacagagctgggaaaccactgaagtcatgtgctctgcagaacttgttcaactggtttcctctccacagacccctaattcagatttccacccttattcttttctgcatatgctcttagtctgggcttgttttaaggtttaccacagtagagttctcagtatagttatttatttgtcttgctgagtgtagagtgggtagggccaagtatgtactccctttgaaaagtgttatcagtaagacaagatagacaggtattatgtaaatcatggagtgtcagactccattagcaggtttatttctgtggatctaaccatttcacccccacactcatgtgtacatacacatatacatagctatcattatttagagcctactactagttgctgggtgaggtgtcagagccccggcattggaaagtagtcaactcacaggttggtaggaagaatttactgacagcagtataggtttgaaaaaggaaagttttattagaaagaaggaactctgcagaagaatgcctcagcaagagagaactgagctcgcggtggatttttccttagggtatttatggaacttaaagcaggagcttaagggtagtttggaccatattagccaataggtcatgataaatgattacatttttagacgtaatgtcagcaagggttgcacagggagtttcggcatggcattccagagatgtatagaaagtctagttgcttacaaattttaggttgaaaagagagctggaaccaggtgccgattttagataacagggaagttaattacttctaaattcctcagataagaagttttgcctctgaatggtctccttagtggactccaggtgatcactagtatttggtatgtatcatctcatttaatccttacaacaaccttatgaagtttggtgtgttgctaatcctgctttatatatgggaaatggaagctcagagaagttagcgggtaacatgtcattcttggtttttcttatgtccttccctcttatctcagggaggaagtggggtatattcctttctgtagctggctgccgcctctgctcttcagaaccttgctttcttttgttcttattcctgtatctttagcccctccttcacgtgttcttttcttgcagactataaaaatatgctttttccacaatcatttaaaaaaaataaaaagacactttcccaggacatgtcaccatctcagactaactccttctccgttccccctagtttttcctcttcctttcttacacttctagaaaaagaagttggctgggtgcagtgactcatgcctgtaatcccagtactttgggagatggagaagggggcggggagggagttgggggttggaagtcaagaatctcttgagttcaggagttccataccagcctggacaacatagtgaaaccttgtctccattataaaaaaagtaataataataaaataaaaattagaaaaagaagcctacatttgctgcctctccttcctacttttagttacttttctagttattttaaatggactcctgtgtcaccactccactaagactccccttacaggagccaaagatgaccttgcttgtgtgccacattcttttctcttcaccacccgcctctctgcagcattgaaagctggtgacctctaccagtttgctgattttttccttccgtgattgccattgtgtgattctctcctggttcttaacttgatcacagacgctatctttgtctctttcacctcttaagtgttggtgttctctgaggcacagtgcttcagcttttacatttttctccacagcctctttctctgtgggcttatctactcttgtggtgccattttccagatttaggtcttcagcaacaggtctccctcctgagacctgtgtttccaactgcctacaagatgccactgtctggacgtcccgttgacatttcaagctgaacatgtttcaaccgtgaattgctcatcctctccggcttttgtgggtgtccccattcttgtttaatggcatcatcttttatgtagtcatccatgccgcaagtcaccaaatcatcttttaaaaaataagaaaaaaaccttctcttttcgttttatagaagtgtttgtaagtttgctgtagatggtatatggtgccggattttctcctagaattgtgtgtcagaatgtggggcttctcgacacactggacaacaatgttattttaaaaaatctttgctagtctgatagctgaagatggtgatattgttactttactttgtatttctttggttagtagtaagattgagaaattttcttataaattactggctatatgtatattttatgaatttttaaatttgtgtttctagcatatttttctagggaaatgtttgccattttatttcaagtgtttaaaatgtatatacatgtaaagattatggaatattgttagctctttgttatatgttgtgattttttttcctccagtaacctttcctgttaaagttttatttagttttttaaaaatggccttacagaagtttaaatactagccaatttatcttttcctttctgatttctgcttctgtagtagtgtttgtaaacttctttctcattttaagagtatataactattttttcttttttaaaaaattctctaatccatttggtgtttaatgttagttgtgaaccgtgaggtctggagctaactgcttccccaccctccatgccccctgccttttcagtcatctgtgagatttcacatctttcccactgcccttctaatccccgtgcctcatctaacagattgtcaaatggggtcaattctacctttgtaattgttaatcattctctttccaccattgtcccagttaaagactgtattaccactcacctggattaccgaaatgtttgcctgatatttctcccttgaatctgtcgtccatgctgctgtccaagttctccttctaagtctacttgaaaacctcccatggctcccattcctgcaggttagattactaatccagatacttttacacctacttctctaccacagtgacttaccgttccctgaatgtgccatttgttttcagcctttttttttgtcctttgtattatgctgttccttttttgttttttaatttttttatttattatactttaagttccagggtacatgtgcacaacgtgcaggtttgttacataatgtatacaggtgccatgttgatgtgctgcacccattaactcgtcatttacattaggtatgtctcctaatgctatccctcccgcctccccctaccccacaacaggccccagtgtgtgatgttcccatgtccctacaaaggacatgaactcatccttttttatggcttcatagtattccatggtgtatatgtgccacattttcttaatccattctatcattgatggacatttgggttggttccaagtctttgctattgtgaatggtgctgcagtaaacatacgtgcgcatgtgtctttatagcagcatgatttataatcctttgggtacatacccagtaatgggatggctgggtcaaatggtatttctagttctagatccttgaggaactgccacactgtcttccccaatggttgaagcagtttacagtccctccagcagtgtaaaagtgttcctatttctccacatcctctccagcacctgttgtttcctgactttttttttttttttttgagacggagtcttgctctgttgcccaggctggagtgcagtggcacaatcttggctcactgcaggcttcacctcccgtgttcacgccattctcctgcctcagcctcccgagtagctgggattacaggtgcccgccaccacgcccagctaattttttgtatttttagtagagatgggagttctccgtgttagccaggatggtctcgatctcctgacctcatgatccacctgccttggcctcccaaagtgctgggattacagacgtgagccgctgtgcccagcctgtttcttaactttttaatgatcactattctaactggtgtgagatggtatctcgttgtggttttgatttgcatttctctgatggccagtgatgaccattttttcatgtgtctgttggctgcataaatgtcttcttttgcaaagtgtctgttcatatccttcccctactttgtgatggggttgtttgtttcttttaaatttgtttgagttctttgtagattctggatattagccctttgtcagataagtatattgcaaaaattttctcccattctgtaggttgcctgttcactctgatggtagtttcttttgctgtgcagaagctctttcgtttaattagatcccatttgtcaattttggcttttgttgccattgcttttggtgtttcagacatgaagtccttgcccatgtctatgtcctgaatggtattgcctaggttttcttctagggtttttatggttttaggtctaacatttaagtctttaatccatctcgaattaatttttgtataacgtgtaaggaagggatccagtttcagctttctacatatggctagccagttttcccagcaccatttattaaatagggaatcgtttccccatttcttgttttggtcaggtttgtcaaagatcagatggttgtggatatgtggtattatttctgagggctctgttctgttccattggtctatatctctgttttggtaccagtaccataccatgctgttttggttattgtagccttgtagtatagtttgaagtcaggtagcatgatgcttccagctttgttcttttggcttaggattgtcttggcaatgcgggctctttttgggttccatatgaactttaaagtagttttttccaattctgtgaagaaagtcattggtagcttgatggggatggcattaaatctataaattaccttgctcagtatggccattttcacgatattgattcttcctatccatgagcatggaatgttcttccatttgtttgtatcctcttttatttcattgagcagtggtttgtagttctccttgaagaggtccttcacatcccttgtaagttggattcctaagtatttttatgctgttcctttatgttacatgtctccttttcccatttttcactattggaaatagaatttatttgagcaaagcctagttcagatatcatctcctattgtagctagctgttaaagcataactgttaccagagagtaattcccttgaaggtgctgactggtattcagcacaacgttataccactgataagtgttccacacagtagtcagttcgaaatgtttcctgaatgaatacgtgggtgtcagaatagacacctttttttttttgaggaattgacttaaaatacttaggaaaaaaactttaaaaaatagaataaatatgaaaaggtataagaattactatgtaggctgagcagagtggctcaagcctataatccttgcactttgggaggctgaggtggaaggatcccttgagcccaggagttggagaccagcctgagtaacatagggagttgctgtctctacaaataattttaaaaattagcctcgtgtggtggtacacacctgtggtcccagctactcaggaggctgaggtgggagcatcactgatcccaggaggttgaggccacagtgagccgtgtgattgggccactgaactccagactgggtggcagagcgagacactgtctcaaaaaaaaaattaaaagactgtaattaaagatagccttttgtataagcattcatttttgtactaattgtatcagcttcaccaatgtgtaatactaggcctctcccttagtgcttgatagaagtaagggttgttaatgaggttatatattgtggtgtgggatacttcaggaagcccaatttcagaacttgagcatttgtaagggaatgttcagtaggtcgtaactgttgttattgttgaaggaggaagtatcctgtagcaattaagagtatcagcttcatactggttcgtggctcacgcctgtaatcccagcactttgggagggtaaggcaggtggatggcttgagcccaggagtttggaccaccctgggtaacatggtgaaaccctttctctacaaaaaaaggcaaaaattagccgggtgttgtggcacatgcttgtgaccccagcttcttgagaggctaggtaggaggatccagaggatcgcttgaaccctgaaagtcaaggctgcagtgagccatgatcacaccactacatagactctgtctcaaaaaagaaaaaaaaaaaaaaaagccagagtatgggcttcagaatcacaccaacttgggttcaagtgagagtttacttgccagataatcttggaatatactttttggaacccacagtttatctgtaaaataattacaataatacttcagaggttgttgcaaagattgagataataatgcatgtaaagtatttggcttcatgtctgccacatggtgtgaagattattttttaagtgtcatttatattgaaaatgagtcattctatgttacttctttcctgtttagtacttgtgtttcagatctgacatcacctttttaaaaattttgcatttgagtgagatttgctaaagcagttctggggttaaacttgaagagaaaatattgaatatttatatttaatatcccatgtgagaggagagattaagaaccctgttgtctgcttgttacatctcttgtgaaaaacataaaaaatataagagttttgttactgaactctacttgtggttttggtcgagtctatcatgaaggtatgttgtggagattagtgcaaataatgatttaaatatggaattataaagtttagcagctctatattcggggaaaaacgagtctctgttgattgaaaaagcataataaaataatttattctgaggctttgtggttatgcagtgtcagaatgaaaaagatgatactcctgttccatttcaggctggtcagaccatacctggaacacagtgttcagttggagaaagttcagagatgagcaaaagacgtgagggggcagagatgatgtctaacactgctaatataatacctggtaacgttttgagtacttactctgtgccaggcactgttcttagtattttatatgtactatcatctctttaatcctcataaacattctgtgggtaggtgctattattattctgtttttatgactagtgcttgaaggagctggaatcattttacttatggaattgtcagcatgtgactcatcatgaggggataggaggaaaggcacaaatatttttttcaatacccagccaagcactgtgctagctctatttcacttgcaatcttatttaatcctcaatgacaaaccttggaagatcctgttagccttttttaacaaatgaaagaactggtcaagtggcttgctgtctttctcggtaagtgcgagagacaggacatggaaccagatctttccaagtccatggccagtgctactcacattatgcttttatttttacgttctcttgctccaggaggcagcttagggtgccagtagagaattgatgccggcttagcaaaaaccttctgactactggagtccagaaatgaactaggttaccttgaatgtttgattctctgtcagtattcaggctcagcctgcttcctgatttggctgagatgttttgggaacatcaaattggggatggagtagaacatgtgaggggagtggaggaattgagatgggctgaaagatctttaatgagccttccatccttgagattctatgattattgctaggacagggttaaatatgagaattggtgaaaagttgtgttggccagtgatttttcttttgtgcatagattgattgattttgagacaagagtttcactgtcgcccaggctgggaatgcagtggtatgatcactgctcactgcatcctcaaactctcagactcaggcaaccctcccacctcagccatagttttatttttaaatgtctttataggccgggcacagtggctcacgcctataatcccagcactttgggaggccaaggtgggcggatcacttgaggtcaggagttcaaggccagcccggccaacatggcgaaaccccgtctctactaagatgtacaaaaactagccgggtgtgctgatcccagctacccagaggagacgggagaattgcttgaacccggaagccagaggttgcaatgagctgagatcgtgccattgcactctagcctgggcgacaaagcgagactccatctcaaagaaaaattttttttaataaagtcttcataaagctaaatttataaaaaagctagaggctgggcgtggtggctcatgcctataatcccagcactttgggaggccgaggctggtggatcacctgaggtcaggagttcaggaccaacctggccaacatggtgaaaccccatctctactaaaaatataaaaattagccggttgtggtggcacaagcctgtaatcccagccacttgggaggctgaggcaggagaattgcttgaacttgggagacggaggttgcagtgagctgacatcatgccactgcacttcagcctgggcaacagagcgagactccgtttcaaaaaaaaaaaaaaagctagagatatggtttagcagctctatatttggggaaaaaaggagtctctgttgattgaaaaagtgtaataaaataatttaagctgaggctttgtggttatggagtgtcataatgaagaaggtgatagtcctgttccatttcaggctggtcagaccatacttggaacacagtattcagtaggagaatgaattcagccaggtttgtttgtttgtcttttaagacagagacttgctctgctgttgcccaggctggagtgcagtgatgcaatctcagctcatgcctcagttttccaagtagtggctgggattgcaggcatactccaccacacttggctaatttttgtattttttgtagagacggggtctcaccctgttggccaggtttttctccaattcctgacctcaagtgatccacccgcgttggcctcccaaagtgctgggattacaggcgtgaaccactgcaccggttctaaatatttaagttttataagaaaggttttgtgtctaagttgagaatcactggtggatttagttaagctaaaatacctttaattattaaaaagtaggcagaatgtggagagataccagcctttttccttcttggtatttctgcgatttttccctttttagacagcctgtggagctcaaccccttttggcttttcaggtgatatagtgagagcaagagtgatactgtgaggaggattctaaacctagcaatcagtcttgttattccatctttgccactagctattggatgaccttggatcagcctcattcttatttgtaaatgggaggaagtgcaaatagattattagcctctgagcaggcttgtggccagttagattctttttcaatgtttatatttttaattttggagttgtacttctaaggacctttactaaggaattaattctaaataaagaagaacaccgtgcacaaagatattccttgcactattatttaatggttgaaaacatttagaaatgacataaatgtctaagataggtgacttattaaggacttggttaaatttttatgtaaacttaaagtcttcagaaactatataataacatggaaaatataaacatttcagaaatgtttaataattgtctcattcatatatatatatatatgtatatatatatatgtatatgtatatatatatatgtatatatatatatatatataatttttgagacagagtttgtatatataatttttgagacagagttttgctctgttgcccaggttggagtatggtggcacgatcataactcactgcagccttgacctcctgggctcaaacggtcctcctgctgcagcctctcaagtagctaggactacaggcatgtgccaccacgcctggctaatttttaaattttttgtagagacagggtctggctgtgttgccaggctggtcctgaactcttgggctcaagcaatcctcctgccttggcctcccaaagtgctgggattacaggcgtgagctactgtgcctggccatttttagatatatattatattaaaaacaaacaaagggattttccctagaagtgcatttgcttcctggctctcaggttttctgattctgtgatttagtagaagaaggggaaatctcatgtgagctgtagagaaagactgaaagaagtgtttgttgtgtcatcttggaattcgagtagaatccaaacttctgctaacattaaaaatgttaacatggcactttacttttcaaagcagtttggtcctgatttgttcgtttgtgacagggtttcactttgtcaccccagttagagtgcagtgccaccatctcaactcactgcagcttctacctcccaggttaaagtgatcctcctgtcttagcctcccaagtatctgagactataggtgcacaccaccacactggcaaatttttgtatttttagtagagatggggtttcgccatgttgtccaggctggtctggaactcctgacctcaagtgttcggcctgccttggcctcccaaagtgctgggattacaggtgtgagccactgcatcctacctagtcctgatttattttataaacaaaccaggtgatactccattgtgaaatagctcagattggtgggcaagccacatatgtggtgaggtgacttggaaggcagcttcaggtttgagcagttgtttagaaacaatgtattttgcctccctgtttattctagctcattctttctatttaataactttcaccaaatcacagttggcctttcttctctgacctgacacctgtgttatataaagagcattctacccagctataggaaacatctaagtcaggactgttttatagcagttggactagggaaaggaaatataaagaatgctgggagatgttaccatgggctctccttttatttttgtctagaaatctcagaaaagaggaaaacctaaatacctctggtaactggctctgattcaaggcaaaagtatctactgtgctctttatccgtagttttccctgtgtgtttacttcattttaaaaagaaaaataagtaactttttttttttttggtactgttacgtgcttgagggccatttttggcttaggctgaggttgttaggttttcactgttaatgagaacccaagttagattgtcccctgagagctggagttgccagtagttgtttgccagaatgattttatcaacatcctttttagcagtaaaaagatgagatgtgtccttgaactacactattttccgtaccgacaactgccaatcttttccacattgccctttgcatctttaggctgaatagaggtatagtttagatttttgtagccatttcaaattggtatctcatttattatgacaactcttctggaaaactcatttgtttcatttttcccctttctgacaatttaagttctactatttgaaagaaagaaaagacagcagagaagcttatcatcgagtataggaaacaaccagaaaattatctggcccattcatatacccatcaggcttcatgtgttagagagtacgctgcctaatttaaaggtagagtagatttaaaagcaagactgagctgggaacggtggcttacgcctgtaatcccagcactttggaaggccgaggtgggtggatcacctgaggtcaggagttcaagaccagcctgaccaatatggtgaaaccccatctctactaaaaataccaaaaaattagccaggtgtggtggcacaggcctgtaatcccagcaactcgggaggctgaggcaggagaattgcttgaacccaggaggcagaggttgtagtgagctgagattgtaccattgcactccagcctgggcaacagagtgagactccaacttaaaaaaaaaaaaattgagtgaaataattttaaattaggagttttaaatctagggttcctagagtcaatgaagtctctgaaattacatgtaaaatttaagtatatgtatatttttccaggggaaggttctatagctttccttcgatattcacaggattctgtggctcagtggttgaaaactgttgccatggtccgggtccagtggctcacacctgtaatcccagcactttgggaggctgaggtgggcggatcacttgaggtcaggagtttgagaccagcctggtcaatatgacgaagccccgtctctactaaaaatacaaaaattagctgggcatggtggtgcatgcctggagtcccagctactcaggaagctgaggcaggagaattgcttgaacccgggaggcggaggttgcagtgagctgagatcatgccactgcactccaggctgggcaatagagtgagactttgtctcaaaagaaaaaagaagaaaaggaaaaaaaaaccattgccataaatgatctttagttacctatgtttccgttggtagaaaatacatgtaactaaactttcctttgttttatcttaggctttcttgaaatgtactaagagatatttgaaggggaaaatacagttttctttttttctttgttttattctttttctttttggaaaatagttttcttttcctatcctttttacaacctcctccctgcctccaaaaatctgagaattcattatttactgcttccataggagtttcttttaatattttagctgaaataattgagtctgttttgataacccccaagcaaccttaaaacttggacctagaaattcactgtggattctgagttctgcaactggaagagaatgtcagcaacaaattaaagcttctgaacagttgaaatggtggcttcagttaccaatggcttttcttaggatttgttaaagagcaacttaaggactgagggaaagggtctgaggttctgggagcagtcaggatctggggagccagctggctgtgttgctgcagcagaggaaagtggggtggagaagaaagtggcattcatgctcaggaattttcctaagttccccgcctctgagatctgactgggccaggcagggaaaggatgtgtgtggaactgattgtaaaagagtgctattatgttcagtttaagcttctccaaggagaatggaaataaagcttaaaatctctaaggaaaagttctgaccttccctttctttttttgcatcctctctcctttggtgcaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggtgagtccttccttgctttgtgcttagatttctgtcaacttgagaaagttagcatgttttattttgtgtaagagttattgagaagtctgtgtaaggtgtgtttgttgcaacaaattatagcctttaaaatgcctggcagaatggagaaatttgtgcaaaggcaatatgtactaggcaaatattattacatctcttttagaatttatctggaaagcccgcctcccccctaccctgtccccccacaaaaaaatatgtactaggaaaagaactttagctgtctttgtttctggtagaattcttatgatgttatatatctagaaattttcctagttgtagatgaattttttaattctttagaaggtagaagaaataactaggggaattaccactttaaatctagttttggggccgggcgcggtggctcacgccggtaatcccagtactttgggaggctgaggtgggcggatcacaaggtcaggagttcgagaccagcctgaccaacatggtgaaaccccgtctctaccaaaaatacaaaaattagccgggcgtggtggtgcatgcctgtaatcccagctactcaggaggctgaggcaggagaatcgcttgaacccgggaggcagaggttgcagtgagccgagatcatgacactgcactccagccctgggtgtcagagtgagactccatctcaaaaaaaaaaaaaaaaagaaagcctaattttaggctgggcacactgattctcacctgtaatcccagtacttggaaggccaaggtggtaggatcacttaagaccaggagtttgagagtagcctgggcaatataatgagaccctgtcttacaaaaaaaaaaattagccagacatggtcacacatgctgtagtcctggctacttgggagactgaggcaagaggattgcttgagcctaggaggttgaggctgtagggagttagtattgcgccactgcactcccacctgtctcttaaaaaaagaaatgaattttaagcactgagatttgttggcaaattgaatgcaaaagtaacttcatgaaaaaacatcaccctgcgttgctggagttcaaggtacaatgggaaagtgattcagtttcagaaaattgagataagtgagagggtttgattcctgtatctcaaggtgctataaaaaagaagactgactgcttaattaagttggaatgttgggccaggcccagtagttcatgcctgtaatcccagcactttgggaggttgaggcgggcggatcacttgaggtcaggagttcaagacaaacccggccaacttggtgaaaccccatctctactaaaaatataaaaattagccaggcttggtggcgcacacctgtaatcccagccactcaggaggctgaggcaggagaatcacttgaacccaggaggcgggggttacagtgagctgagatagcaccactgcactccagcctgggcaacagagcaagactctgtctcccaaaaaaaaaatggggatgttgacaaggaccaaattttcttgtctacagaggttacctgtgaatccttatttgaaaaatgatgactatgaaagatagtggagaattgcattaccaagaccaaatgtaagggtggtcagctgtaataactgggcccaaactcagaatgagtaaggctacaatgtcaaagagataatttttatgttttatgtttaaattcaagggaaaacaaggaacggtataggtactcagccaaaattaacatcataaacagaaactttccttaaacaaaaagacttatatgttcagtgggttttttttgttgttggttggttggttggtttttgttttgagacagggacttgctgtgtcacccaggctagagtgcagtaatgccatcatggctcactgcagccctgacctccctaggctcaagcaatcctcccacctcagcctccctagtagttgggactatgggagcatgctactacaccaggctaatttaaacaaattttagtgtagagatgggggtctcactatgttgcccaggttggtctccaactcctgggcttaagttatcctcccaccttggcctctcaaagtgccaggattacaggcatgagccactgtgcccagccctttgctcagttttgaatacacagttattctgaagacaactctggagctattctgtaggcagaatgggaagatagtgtaaaaggagagcggagactctgcagcaacaataaaaaaaaaatggctgggaggagtggctcatgcctgtaatcccagcactttgggaggctgaggtgggagccctcacttgagtctaggagtttgagatcagcctgggcaacaaggtgaaacctccgctctacaaaaaatagaaaaacaattagatgggcatggtgacatgcactcgtagtcccagctactcaggaggcaaaggtgagaatatcgcttgagcccaggaggtgaggctgcagtgagccgattgtgccagtgagccgattgtgccagtgcactgcagcctggacaacaaagtggagccctgtttcaaaaaaaagcagacattgaagtttagaggggatatctgtatatatagaatgaaagccctgattgattttttttaagacagagtctcattctgtcgcctaggctggagtgcagtggtgccgtcttggctctcactgcaacctctgcctcccaggttcaacgattctcctgcctcagcctcccgagtagctgggattacaggtgtgcaccaccacacctggctaatttttgtatttttagtagagatgggatttcaccatgttggccaggctgatctcaaactcctgacctcaggtgatctgtccacctcggcctgccaatgtgctgggattacaggaatgagccaccgtcccagcgtggtatttttatacagcattttgtgaacatctatgtattcagacaccatactaatttgttcatgtgcattatctcacttagtttttatacatacaaagcagctgttctagatggtaaaactctgtccctaaaggatgaagtggcttttccagtgtcaccagtagattactaagccagtaattgaatccaagataatttaactccaaagaccacatgttctgttgagcacactatacacaagaaggctctccaggtagttgctaagtgagaggagctgagatgtggatttggctttttggtattggaatgtgagcataatgacatcaaaattaaggaaaatttgtcaaatctcttgaggaaacttttgcgaagagagtttttatttaatatttgcttcaatacagccaataatacctaattttcttttttttttctaggcgactggcctccactttagacacactgataatgtgattcagtggttgaatgccatggatgagattggattgcctaaggtaacttacctgagataatagtttaggctttgttccagctgttgtggcataaccctcaaacaacctgttctcattctacctgtaaaattattctcagaatctttggtgtttttttaaatactaaaagatgtctttctttttgacttaggaaatagttttgttctttttcttttataatcctcatacctgtttcatcttaccctagagaaattccctgtgatgatatctacttttactacatcaaattgtagacttacattttactatttttccttagatagaattcacatgctgtgagattcaccattttaaagaataccaaatcagtggtttttatttattcacaaagttgttaacattaaaatttgacctttggaaatataaggaaatattttagaaatctgtagggagtatgaagggtcattttttattttaaattgtagaggtggtagaatgacgtttacttcctggatctgtttttggtcatggctgcagttttgtttggagtgtacatcttctgggtgttctgctcaggagtttatttagtgttgctttcagtgaaattgccatcccagtcctgtctgaatctataactgccacactgtatggtcactcttagagacatgaatggattgattgatttcattctttcttttgttctcatttttttctgtttatatcctttgacgtaagaattccgcttctgggaagttatccgaagtaaataatcagaaagcaccaaaaaaatgtatacagaaggattttttagcattgattatgatagaaaaaattgatagcaaagtacatgtttctttacaaggggtattaattgtgttacagccaaatactagtgccatttaaaaggatatcaacccaagtaaagggcctttgatgtattaagtggggaaaaacggttgaaggttataggagtttgtgttctagctaagatcagatcactatttttgtgtaaaaataaagtgagtgttcttgggaaaaatttgtaaggagataaaatggttttcatttctgtgtgatgggattaagggtggtttttattttccttgtactttcctgtagagttcaaatttttgtaaccaaaggaaaatttattttaaaaaagtgaggtgtagggtatcagaaggtggctaaaaccattttatattttgtattttgttcaatatagaaatattgtatacattttatattttgtattttgtgcaatatataaatattgtatacaaatatgtatattatatagataaatatatgacttatacaatatattacaatatagaatatattgtaatataattttacaatattatataatatacaatatataattacatattgtaatatataatcatatatacaatatattatatattatatatacacaatatattacaacatgtaattatatattacgtatatagtatattgatatgtatacaatatacaacagatatgcattgttgcatacatacctgtggaattgtgttaaatcagaactgagtctttgcagaagactagcttttctcctctttttttcagagaaagttctgaagttctcttccttgccactggtatgtttgagaattaggccccacaattgttaggaaatgcagtacgtcaagttcttacagctacgtggcctgtctgtgcacctgtaatttcctttccctgttttttaatatagtataaaatactgtgctatatagtgtaaaatattacactgtgcacctgtaacttcctgtttctgttttttatatagtatattgccagtgggcaatgacaataacctcatttgaatgttactaagagctttgttaatatttgcaattgctagtagtgttgttactacgagatgcttttttaatgatgtaattttgttaccttttttggtttactaacagtagtatattgtcctggactacaattgcaacaaacacagaatgtattaaaggctttcaggaacaacttgataatcatggctgtaagccttgaattgtccaccctacgtttaggcccagaagacttctgagtaataagaactaatgataacctaaaaatgtattgttgttcttaatataatgtataatacgtaattgacaatacgtatatggtgtttattgggatgtcttttctaatctctttatatggtacatgctggcctattatagaaaattcatgcagtcattttttggttcttatcctttttgactctttattataattggtactgttggctgccttttccctgagatatttcttagtttgatttttaaaattgtttttaatctgctcaactagtcctgttttctttaattattctaccttccatgtcctagtgatggacatactttaagatgcaatccttgttagatacattttcccattttcatggtttcatttattctcaagacttgctgacataagataaacacggtatcttcagttggctgctggacatttctccttggatagctttctgtcacctagaatttttcatatctaaaactaaatctaccttttccccaactgaacttcccttcctctataataaatggtaccatgtcatcattttcccagtcatccagtctcaaaaccttggagataccttgaacttctaaatctggtcattccctaagccttctccatttatttgaaatatctcttttatccatctactgttacaacagcctcccagcatacctccccagctcccatctcccattattcaacatatgctgtgtcctgtctccagtcagatctccccagggctctatttttatccttagctccaaagctaggctacttctttatgtcctgcttatcaagttcagacttgtctgactttcaagttgcttataataatctgattttatcctacctatccaaccttatttttctgttattttctagaacgtattctgtagattttaaaaaacaatagggtatattgccttactgtctcacaaacacatcatgattatttttgctttatttattctggctatttctcttatttggaaggccttttgctctctatcatgattcactcatttctttagtttatgatttcacagtcttaatataggcctttattgcttatccaaattcttctcacctcattattcagtcttttgcttctccgaaccactgtcaccccttatttccctaaattacagattgaattgtatggtgccacatgactgtgagaataggccttgaagttcaaggctattcccagtctaaatctactctgttcctatcctacctcattcactaactcatcgaatgtagagcttccatgaccctggctctgggcttgatatcaaagatatggcagttaataaataacatagatctagccctgccttcgtgtggcttatagtctgttggagtagccaaacagataaacacaaatgatcgattttggtaagtgctaccgtggaaaagtacttgtcttccaaattccctcatacatgctctattctagctacttcatctgtgtagcttcccatttctcctaagcattaaacacattttaatattttatagtttttttcaatgtctaaatgtagcaggttgcacaaactaaagcacttagtaaatgttcattgttgagttgtttctccatctaggcatggtagatagtaactaggagcattgtagttctgaaagcctcatactcagatcagtccagtgatttaaactggactagaacttggtcttcatatgcctgtgtctgggtctgaaataagtaaatcaccttctcacacctaatgaaattcagtgggttgtccaaatagagattttccaagtagtactttttattctgtattatagcactttattccttgcaattcttatgatgaaatgtctgttcaccctaatgaagttatttgctgaatgccaccgatgttttctaagaatgccaccgatgttttctaactgtccatagtttgatttggattattgatgattggtgaatgtcagatgaacacagtgaatggatatcttactctgtttcttttatttctccctagattttttacccagaaactacagatatctatgatcgaaagaacatgccaagatgtatctactgtatccatgcactcaggtagtcaaattttcttggcaaaataaggaaattatgaataacatctgaattgagtgtgtagttttttatccttgaggtaagaatgaaaaagttttttgattagtttcaaaagttccaaataggataaaatactattatccgaacaaaatggtgagaaacagctgtgtttttctagggagtttggagaagggatttatttatttaatagcaggtaattttcttctaaaaacatggtatctttcataattgatctagtatttctgtgaactatgcattcacttggggtgcagtctcttgtttagttaggtaggtccttgccattgttaagccatttgttcattcattcaataatttttataagccggatgcggtggctcacgcctgtaatcccagcattttgggaggccaaggcgggtggatcacctgaggtcaggagttcaagaccagcctggccaacatagtgaaaccctgtctctactaaaaatacaaaaaattagctgggcatggtggcgggtgcctgtaatcccagctactcgggaggctgaggcaggagaattgcttgaacccggaaggcagaggttgcagtgagccaagattgcaccattgcactccagcctgggcaacaagaacgaaactccatctaaaaaaaaataataataatcataataataataataatttttgtaccaacacaaacatgatagtaagaaatgatacaaaatatatttttttcccataatgtcatggtaaatttggaatgtgacttaattttcaggtccccagaacactaaattaaataggaaggaaaagatgcaagtctggaaggatggtgggatggcatattagtagatgcttatacaggttgaatatcccttctctgaaatgcttgggaccagaagtgttttggattttgaagtatttgcattatacttaccagttgagcatgccaaatctgaaatgcagaatgctccaattatagcattgagggtcatgttggtgcttaaaaatttttagattttggagcattttggattttggattttcagatttggtatactcaacctgtggtacagtagtgtagtattttagcagatttacttgatggccacaggactaaagaagaagatggcagagcaagtgggacatgagtgagatatttgcttgggctgcacttcttatatggcatcctctatgtgtgcttgctaagtgttaattacattggagtaggtatataatactgatctataagaagactattgtctccagtttcttgagcaaacatgtactagatctgtggtatcattggaatcagtgtgaaacatatgaaagaatgaatatagctgagaacttgtggatctcgtgttgagaatgtagcaatttcaaatatgtgtctgaggctgggtaggtacagtggctctcacctgtaatcccagtgctttgggagaccaaggtgggaggattgcttgaagccaggagttagagaccatcctgggcaacgtagcgagaccccatttctacaagaaataaaaaattagctaggcatggtggcattcacctgtagtcctagctactctggaggctgaggtgggaggatcacttaagccgaggagtttgagactgcagtgagctatgattgtgctactgcacttcagcctggatgacagagcgagactctgtctctaaaaaacaaaacaaaacattaccaaatatgtgtgtctgagtccagatcagattaattctgagtattttgtttggcttagtgttgcatgagatttgtccatgttgataatcttgtgaaggccttacctgcaatggatatctgaacgtggaagcagaattcctctctgctagttgtgtagccactactctgcagtgtaacctgggttccaggccctcaaattctctgtagtagagcctaaagaattaactatgccttcctagtggtagagtcagaatgagaaagagaggaagtctgctattgttttccatttctcttgaatatgtagtctgtgcttagaaagtatatatagagcagtgtgtttcgtgatttatggtttcttttttatggtgtttttcctgaagggtggattggcaacatttgataatatgtaggaagtatttataattgctgaaagtgccttcttttaccacaaaacacagccatgttcaaagcaggttcctcaccttgctatattggataaggctccatctccctttggatcaacagtgacagaaaaatactacctctctgtctcctccctgcttgcctttttttttttttttcctctaaagtcttgattggcattattccagagatagtcactgtactttaatcatactaaattacttttgtagataacattccactctcagataagaccccagttttccattctcaaaatacttgtatactaagtttggtgtaagctcatttgtctccttagtatgattatgtttgtgtgtttctctgcagaaagtaatggattggattgaggatgctgccccagggcttgctggggatactttatgataccatatacactgtaaatagaaatacactttctaatatctgagaaattcaatattcagacatatctggctccaagaatttggataagggactgtggacctgtagtagattctgtttcctaatcacctgctgtgtttcagggtctttattaataatctttgagattggcatagtgacttctaggttactcaccattcacagaaaagataattagaatccagatagattaacatagcttccttctgcccattgctacaaagtacagcttaagtaggaaataagaaaaataaatctaagtgcagttacaggctgacgcattatagtgcctaacagtatatttgtagaagtaggcatgggagagcaggagcaaagattggaaagtgctgttcaccattagggtttataagtttcagtgtgaagctaagtacttttgattgtgggtaagaggacttaactggccgttttgaatcctttcatagctccagtgtctccataaaatactcgtaataattaaagagagttaaaagaaagatggtgcccatgtctactttttatattagccagtgatacggttgtagcacctttaatttaccactgaaagacattaaaagctaagtcagtgttcctggtactgtgaaagcaactgtattagtccgttcttgtactgctataaagaaatacctgagactgggtaattcataaagaaaagaggtttaactggcttaaggttccacagcctgtacaagaagcatggctggggagacctcctcaggaaacttacaatcatggtagaagacaaagaggaagcagtcacgtctcacgtggcaggaacaagaggaagagagaggtggggaggtgcttacatacttttaaaaaaccaaatctagcgataactcactcactgttaggagaacagcaccaagggggaaacctgcccccattgatccaatcacctctcaccaggcccccacctggggattacaatttgacatgagatttggacagggacacagacccaaaccatatcagcaacattcttgaactttcttaaaatttcttgttcgctatttccaagtaggaataaatgagaaagaaattcttggagaaaaatattctcttaattaagaatgcagatgtgatgtattagtgagaaaaatatataaaaaatatataaaaatgtataaaaatatatagaaagttattagttattttgctttggaatttcttttttaaagaggcagggtcttactcttttgcctaggctggaacgcagaggtgtgatcttgactcattgtaacaacctcccaggcacaagctatcctcctgccttagcctcccaaatggctaggactacaggcatgcaccaccatacctggctaattaagaaattttttttgtagagacaagtcttgctatgttgctcaagctgttttgaattcctgacctcaagctatcctcctgcctctctttctcaaagtactggaattacaggtgtgagccactacacccagtctggagaattttttgaatacatttaaaatcttctgagacaggcgctttatatatccatcttgagtcttttacctgaaagaaaagcatttaatcatatacacatgacttatacttgcacttctctgagaaaatgtttagcttctgtggatgtataaattctagtgtgttttgagaatacttgatttttgtttttctattatacatttgggtttattatatacaatttaaattttgatcagttctgtgattgcagtgtacatgatgcgtgtttgtatttagatgatattgaggtttatagattatttacaaaaactgtataccactttaagtttctatgatttatttcttatatatttcttatttccctgcttactttaaactgtcaatatcttgcttttgtcagtatctgtaaagtacccttctgatctcttctaatttattgattctgatcagttagggctttagaatccacttaataacacaggcttatggacattaatttatccgtccatccatctgtcaaatattgattaatgtttattaatatatgctaggctctgggtaaacattagtgaatgagccctgtattgtccctgctttcatgaagcttagagtctagttgatttttttttaagtttaaaaagtaaaaataattttcaccaacctgataattaaaaagtaaaaatatatgaaatattctttatctaaaactgttaaattacctggattaaacttttccatcagtaatatgaattcagtttaagtaagatttgccatctgaatcatttttatgaagcttttctaaaatgtcttattatttaaaacttattgattacaggaaggcaaacaaatgaagagacacttcacattatattaacattaatgttaacatcttttttttttttgaaacggaatctcacactgttgcccaggctggagtacagtggtgtgatctcggctcactgcagcctttgcctcccaggttcaagcaattctcctgcctcagcctcctgaatagctgggattacaggcacatgccaccacgcctggctaatttttgtatttttagtagagacagggttttgtcatgttggccaggctggtctcaagctcctgatgtcaggtgatccgcccacctcagcctcccaaagtgctgggattacaggcatgagccactgtgcctggccattaacatctaattatgcattgagtttgtgccagaaccgggactttaatttgtgcctactgatttctcccagtccagtgctctttgcattgtgttatgtgactttttaggacaatgttgtcatgtaaactaaaaaaaaaaaactgaggtaaatagcgtattgtaactacaaaggagactgtcgtaggtactgggagtctcagtgttcagaatacttctattttatacttcatgctgattttcgccttttaagggtggcagctaggcacagctgggaggcctaaccttttgcatattgtatcttctagtttgtacctgttcaagctaggcctggcccctcagattcaagacctatatggaaaggttgacttcacaggtaaggagttagatacttggcaggaaatgcttgaattatgtggaaatagcctggagagccagcagtaccaattttgaagacctagggctttaaaaatacactggcagtggaggtgaaaaaaatacgaataacttgcttctctaatgtggggtaaagaacactaaacttgaaatttcaagctctgttctctcacttaataatgtgaacatgattagtgagtctcagttttcttatatgtaaattggggataacattaacatatataaaacataataatgttaacacataacactaaatgttcgggtatgttgaaaaaagctttataactatctttccctttccattccagcaagcatctgttgtgggcaaagcaagagggagagtggggagtgagatgacacaaagatgccaatttagtaattttaaaatttaagcttatttgggtgggtgtttctatgtgtatttgctatagccagatgcttgaagagatgaggggttggggagaaaaagggcagtggtaatactgtttaagggtaagatagattcaagtctttcaaagtggtgattattttgtaggcttgaaagtttaaaaattggtaagaaagtttttgtccatgatattttttccttccagggaagttattcaccagacctggggaaaggaccagaccttacatgttttctttatcatttggctttctgccttagaaatgaaattgttgaatagcagctaatgattgtaaagactgagataactgacttagtttgtgattcacttattgttgagctcacgttaaagctgttccatttataagttcattgtaggaaatgccataagtagcaattttgaaaaactatttcctgtaggaccttctcactttatagttatttttgatgcccttgataataataacgtttgactacattttatatactagttactgtgttaagtgctttccatacattgtatctttatatccttataaaaccctaaaaggtaaatgccattttatcccattgcatagttgaggaatatgtttccttctcttggttatggaagggtgcttagcttgattgactgattattaattccctcctgtagaagaagaaatcaacaacatgaagactgagttggagaagtatggcatccagatgcctgcctttagcaagattgggggcatcttggctaatgaactgtcagtggatgaagccgcatgtaagaagagagaaattttgtgggttcaactgggattgttgccactatttccaataattaattctatagtgatgatctaggacattatgaatcttgccagcaagtttaagtccacagatgtagttgtaaacacatagtcttccatgctgttattatttggaaatacatgattaattctgattaaagtgaaagcatttagaaaggaagtcctggctgggcgtggtggctcacgcctgtaatcccagcacttcgggaggccaaggcgggtggatcacctgaggtcaggagttcaagaccagcctggccatggtgaaaccccgtctctactaaaaatacaaaaatttagccgggcatggtggtgtgcacctgtaatcccagctactcgggaggctgaggcaggagaatcacttgaacccaagaggcagaggttgcagtgagccgagatcatgccattgcactccagactgggcaacaagagtgaaactctgtctcaaaaaaaaaaagaaaaaaaaagaaaggaagtcctacatttccgtggctcattgagtttcttattgttttatggtgtttacttggtaattaaggcagatatctccagagcaagtgttccttgcaaggctctcttatgagtgtttctctgtgagattctaaattcaccatcccagacatggatcacagatggagctgtggctttgcatactgtaaggaagaggctaggctcatagcctggcccagggagccagtcttcgaaccccagttgttatttctctgtgaaaaggagcctctgtctctaatggggggtgcaatgttgctttctgttgtgatatacatcctgtaatctatataatctcagtgtttttgttggtttgtttttttgtttttttttttagtacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacagggtaaaaatgcaacatctattctttctaattaatttatattattccgtcatttgatatggctccagtttaaacatcagttttattgagatgcagtttacatacaacaaaattcaccggattttaaatgtacagtttgagttttgaaaagtatatgtgatcatttaaccatcactcccagaaagttccttagtgcacttttgcaattagtttccaccttacccacacccctgagcccaggcaactaccagtctattttctattgctgccattgacctttttaagaattttatacaaatggaatgatgcagtatctaatcttttggtgtgaggctccattttgacctctgcttcttgaattttatataaataaaattctagagcgtagccattaaaattaatagtgccctttggaaagattatctctaaatattaacatagtctttcctctttcccagattctctggggtaaaatgtttgtgtacagttgttatgggtatgtggaagttagttaaatgattctgacttgaaaaaactgaatctgaggatctcatttcccgaggtcaggagtttgagaccagcctggccaacatggcgaaatcccatctatactaaaagtcaaaaattagcccagcgttgtgttgggctcctgtaatcccaggtacttgggaggctgaggcagcagaatctattgaacctgggaggtggaggctgcagtgagccaagactgcaccagccaggagacagggcgagactccgtctcgggggggaaaaaaaaaacttcacacaaatttatccaccccttgttaaaattagtggttgatgacaaaacgaagacaatcctgctctcagaacattctttgtatctcttatcatagagcagggatttcagtttcccagttaggtgccaaactggcctgcaggcaagtagctgctgccctgcctctgcctatgtcaccagtgagactccaggattgtggatctgtatgtgcccattctgctcagatctgaggcaaggatgtgctgcccctaatcccagcactttgggaggccaaggcgggcagatcacttgaggttaggagtttgagaccagcctggccaatatggtgaaaccctatctctactaaaaataccaaaaaaattaactgggcatgatggtgcacgcctgtagtcccagctactcaggaggctgaagcaagagaatcacgtgaacccaggaggcagagtttttaatgagccaagatggtgccattgcactgcagcctgggtgacagagtgagactctgtctcaaaaaaaagacagaatctcgctcagtcacctaggctggagtgcagtggcacggtcataactcactgcagccttgaacttctggggaaagcaatcttactgtcacagcctcctgagtagctgggactacaggcatgtgccaccacattgggctaataaaaaaaagttttttgtagagatggggtctcgctatgttgcccaggctgatctcaaactcttggcttcaagccatcttcccaccttggccttccaaagcactgggattacaggcatgagttactgtgcctgctttgttctttataaagggtcttaagctacacccatattcttggtagtgttatggtgcaggaggagcacacgtgtatttatgtggtcttcttagacaccttaagctaacttaattacgctttttactcatcctcagacagaaaactcagagagagaaagagatgtttatgaggagctgctcacgcaagctgaaattcaaggcaatataaacaaagtcaatagtaagtatgttcctgaatcaggcacctaaagggatattataatataatgtgaatgttgatctattctgggacttacaacatagtttgatttacttactttagacattcgtggatttgtttagcaataattgcttgttaacaatcttttgtgtttctatgcctccgttttaattatttatcttcagtcagccgcttgttcctacactgacagtagcatcatagtagtctgtttggctacagtttcactctttcaccctattacatgcttttaaatattattttcctggccaggcacagtggctgattaatcccagcacttacatatctgtaatcccaggactttgggaggctaaggcgggtggatcacctgaggtcagaagttcgagaccagcctagccaatatggtaaaaccccatctctactaaaaatacaaaaattagccgggcatggtggcgtgctcttgtagtcccagctacttgggaggctgaggcaggagaattgcttgaacctgggaggcataggttgcagtgagctgagatggtgccactgtactccagactgggcaacagtgagactctgtctcaaaaaaaaaaaattatttttctatttttttaaagtaacattatatttttgtttttcctttaaagaataatgcaagctgtctagaaataaaaaataaaccacaaaaattagactccttcacttagaaataatcatcacttaggaataatcattactggcatttttttgtatgtccttcaaaactgtgtgtgtgtgtgtgtgtgtgtgtgtgtgtgtgtgtatatatatatttttttttttctttaagagacagagttacactttgttgtttaggctgcagttgcgattatggtttactgcagcctcaaactcttgggctcaaaccatccttctgtttcaaattctctagtagctaggactacagtcatgcgctgccacacccagctgatttttaaaatttttttgaagagacagggtctcgctctgttgcccaggttggtgtcaaactcctgatctcaagtgatcctgccaccttggcctcccaaattgctgggattacaggcatgagccaccttgcccagcctccaaaacatatttaaacaaaaatgagattatacttttaatattgacttttatatatgtgttacttttgggaaattaatttattgaaattatcattttgtcactactctgctaaagaactcaccatgactacttcatacttgccagacaaaatgcagatccctagcctagtgcagttctttatgcaatatttcatgcatacagctctttgtagaagctcatttgcctaattacctcccatactcattctgtacattttatgacttaaaaggaatctgggccaggcaattccagcattttggaaggccagggcaggtggattgcctgagcttaggtttgagaccagcctgggcaatgtggcgaaaccctgtctctacaaaaaatacaaaaactagctggacgtggtgacatgcgcctgtagtcccagctacttgggggctgaagcaggaggattgcttgagcccaggaggttgaggctacagtgagctgtgttcgcaccactgcactgtagcctgggcaacagagtgagaccctgcctcaaaaaattaattaattaattttttttttttaaaaaagaatctggctctgaagtggtactgacctggtatttgatctcttgttcctctgttaaaagctgtgtaacattgggcacctgcagtagcgttgttagacatataatacgagatagtgtatgtaaattgcctgctatttagtaagtactcaatgaacattaatattatcgctatgtcatgtaatctccctactgtaatgccttcatgcctcatctcttcctaatccaaattgtacccatcattcaagatccagttcaattttcacttcagtgcctgtcacagttcaatatggttgactttcaaatctcctgtgtcgtacacaggctcatccctataaatttgcacttaattatatattgtcttgtattgcttgatctttatttctgacatctttgtaaactccttaaagtagagattacgtattctgcttcttttgaagtcctcctaattcctagcataggtttagactcaccaaaaaaactaaaaggtttgatttcaaccaactaggtcaggcttaatcttgttttgctcaagatactcataacaataataatagtaattgttctcattgttcatttggagggccaaatttctcatttgaactaatactaataactagagaggatttagaagattttaccaattgcataggattggagttttaagtcctgaccagcattctttttttttgggttttttttttttttggagacagagcccaggctggagtgcagtggcacgatctcggctcactgcaacctctgcctcctgggttcaagagatttcttctgcctcagcctcctgagtggatgaccagcattctttgtattctgctaccttctggttcatttaggataatgaccttcctagcagaataatccattcaagtgtggatggtatcttgtgctgaatctgtattaatccttaagtcagcaaatataaactggagtgtccttatggttggttctctgtgagaagaaagtccacgatgtttcctgttgcatagagtacataaaatattttttgttttactgagggatttttctctaccttactgtttggtattttataacctttatagttttaccttgctaattgtataagaatcagttgtgagcacatgtaaggaaataataatatgttcttaaaatgtcctattcatattattattatgtagtcagaggagcaaaataataaaaattccctcaaatacctttcagtatagtggggaagatagacatacaaatgagtacttttagggcagcttgattagagcaagatgccaagagcacatgtggtgcagtcatagaataaagaagggaatgatgacttctgcttagaagtttgagcaggttttcagtgtacatggatcttcacagggatccttaggatagataagagggtgaggataaggcagaattccctataaaaggacagtcttttcctaattgtagagaaagtcttgaggcaaaggaaagttagatgccaggaggatatagggacttcgggttccaggaattaatgtaattatagataagattctttgcctagagcattcgaaacagcaatgaggccattgatgctgccccaggagaaagctgcaggccaagcagttaaaaattagaaaaagtttttattttattttttgttaagtagactaaggaaaattagagttatataactaaagttcagtgagagaaagtatttaagtaatgttccacactttattatgtttgcaatataaatgtttatagatattcatttaatatttacatatttaagtagtatgtgtacacttctagaaaaagcaaaatttactagatgcttttgtagatagataatctaagactctatgctatatacctagagaaagtctagtttgttatctacattgattttattttctgtccctagctactatgaaagctccttgaggacaggatatttgtttttttcacaattatatttgcaacatatagcagatcctcagtaaatatcattgaaggaatggatgattagttggctaacagccacatatacctgcagacatgacttgagaagccaccaccttggtatggtgctcagttgaatggcaggtatgaatattaggaagaaataaacagtatcttaggagcctacagtgagacctcacatccataccaatgttttaaccttttcttccgccctttttttaaatagttctagtctcctcattgcccctacttcccattttctagtttgagactttattttcccttgggctgttttgattttctttataacagcttattaattttattttgttttttactaatgaaaacatttgcaattgataagtactattatgccccagatatttttatttttggtattttattgatttctttttgctactgtgataaaatcagatgtttatctgtgagtggtggtagggacaggcattttctcttcaaaaaataaggaaacggaaagtaaaaaagtaattatgattccttagtggctatcatttctgaaatcagaaattatcttattctgtctttcaggctaagaatacctttttgttttgttttgttttttttacaatatataaagtgcttttatgtatatgattttatttaatcttaaaaatattcctatgacggaaggtatcttcattatcattttcagatgaaggaacatctgggttttcattgtcatgtattgtattatagagcttgtgtgacctcaggttctatgattagaagagagaatgtggaaaggggaagatgacccctttcactctgcacaggttggaccacccttgatagcagggcactgactgttgtgggtggagtgtgttcaggaagtatcagggtaatgagaggattcaaaatggtgctatgtaagacatggttaaaggaaataaggctgctagtaaggcatttgctgtcatagggaggggcagtggaatgtattcagtgtgaactttagggttggagctttaaaaatatttttgaaacaaaattgtccaaagatgtagtaagtggccacgggagatactttctcctgtttggtagtctgtaagtataatctggacaactacttggcattttaagggaatttaagcgtcatgttggtctggattggtggctccatattggtgctgagctgtctacatttggaagtttttaagtaggctgggagtgtggcccaggaatctgtatgaaatctgatgaatagcttgttgggaacccctggacttgatgactctaaggttcttttccaatcccaagatcttatgcttctgagaatcacagagtaaaggctctctgagttatatttccttatctggaactgagattggttttggggaaggaaaactattctaggctcttctgttaacatagtcctttcacaagcttttgccttttttcctcagcattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacaggtaaacatagtctggattgaagctgcaagagtttgtatatatccattcgaatcccatgctgtcatttaaagatatatatgctgcctttgtttttcccccaatacgactttttcctctgcatataaattagtttaaaaaaaaatcctcaggtaaaatacacattgtcttcagctcacttttgcttttagagctatgaatcctcttttaagataaacagacaatacccacccatccccagtctaatcactccttcacttcagctgtctctctctccaactaaaagacattggggaaaacctgaatatttttgcattcttacgtcaggaatttgcactttaaaaaaaaactgcaccttattagtttgctctggccaaagctggaaaagtacttactgtgcagtcagggtagcttgtgtgggattgtatttcgtgggttttttttttttagaacaaacatgaggggctttcttttttgtctaaataagggcaagtatacattttacaaatatccagcgtacgttggtcaaagtaagtagcattaacgtgcttaagattctacaaacactttttccttagaactttttgaggcttttcatgtaatatgtttaagaatgtactggtatctgtaaagtcactctaccccagctttggcaaaggcatttggctctacctggggctgccaccttggctgcatgtagcctgagctgtcacttatgactatggctctctctgtccctagtgactgcttttgagagatgagaaccttaaggcctggagtcataggaatgagtaatctttacataattttctttgctttgctcagagtggtcagactgaccccctgcagaaggaggagctgcagtctggagtggatgctgcaaacagtgctgcccagcaatatcagagaagtaagagtccattgaaattgtatgggaggaaagttgtggctttgtgttattgaagggtctgaggttagcttctgtcatcgtcatcacccactctgagcctactagccataaccaactgccaggtacttttggtggcaggagggttcctccagtttgttgttgtggtggttttaattgctgtgtaatagttgtacatattttgagggtacatgtgttttgttttttaaaccaaccaagaagcactgacaccaaccaagaagcactgacgtatgatattttgatacatgcatacaatgtattatgatcaaatcagggtaattggaatatttgtcacctaacgcatttatcttttgttgatgttgggaacattccagttcttctgttttgaactatacattattgttaactatcatcatcctactgtgctatctaacactagacctattccttgtatctaatggtaattttgtacccgttagccaacctctctatgtcctcctccccactacccttcccagcttctgggaaccaccagtcaactctacctctgtgagatccacttttttagctcccatatatgagtgagatcaggaggtatttgcctttctgtgtctggcttatttcacttaacataatgaccttcagtttttatggctgaataatattccattatgtgtatacactacctttttttttttttttttttttttttttttttttaccatttattcattgatggacgcttaggttgatttcatatcttggctattgtgaatacagctgcagtaaacatgggagtgctgatttcctttcttttggccatatacctagcaatgggattgctgaatcatatgtagttttattttaattttttgaggactctccatcctgttttccgtagcggctatagtaatttatattcccatcaacagtgtatgagccctttctctgcagccttcccagcatttgttattttttgtctttgataaaagccattttaattggggtgagaaagtatctcattgtggttttgatgtgtatttccctgatgattaatgatgttgagcattttttcatatacctgttggccatttgtgtgtcttcttttgataaaaatctattcagcttatttgcccatgtaaaaattggattatttgtggggtttttttttgtttttttttttttggctgttgtttgaatttcttatatattatggttattgttctcttctcagatggatcgtttgcaaatgttttctcctgttctatatgttgtctcttcactttgttgttggtttcctttgctgtgcagaagctttttagcttgacatagtcctgtttgtctatttttgctttcgttgcttatgcttttaaggtcttagctaaatggctttgcttagaccagtgtcctgaagcatttccccaatgttttcttccagtcgcttcatagtttcaggtcttagatttaagtctttaatctattttgatttatttttgtatattatgagagatagggatctagctttattcttctgcatatggttatccagttttctcaacaccatttattgaagagactgtctgtctcagcccattttacgtggctataaagggatacttgaagtggggtaatttattagctcacagctctgcaggctgtgcaagaagcaaggcaccagcatctgctcagcttctggtgagggcttttgtgctgcatcaaaatatgaaggagaagatcaaagggcaagtgggctcatgtgaagagagactgatccccggggtagtgagtaggggtcctggctttataacaacccattctaatgagaactgatccgttctccccaagaaccaatccaatcttgcaagagctcactaccatgagaatggcacaaagccgttgatgagacatttgctcctatgacccacacagctcctactaggccctgcctcccaacaccaccacactggggatcaagtttcttctttttttttttcatacccttagggtgatgtcaggtatcagatttcaatgtgagatttggtagggacaaataaaccaatccaaaccatagcactgtcttttccctgatgtgtgttcttggtgtctttgtcaaaaaatgttctcctcatggctgtaaatgtgtggctttgtttctgagttctctatggtgttctgttggtctgtgtgccctttttttttttttttgagacggagtctcactctgttgccaggctggagtgcagtggcacaatttcagctcactgcaacctctgactccctggttcaagcgattctcctctctcagcctcctgaggagctgggattacaggcacgtgccaccacacctagctcatttttgcatttttagtagagacggggtttcaccgtgttgaccaggatggtctcgatctcctgacctcgtgatccacctgccttggcctcccaaagtgctgggattacaagcgtgagccaccgtgcctggccaagttactccagttttaaaggtagaactggagtcaatatagcctcactttggctcgcacacacttcatgatttgttagggaaatatctggaggaggtgagacttaagggatcgctaagatttggatggtgaaagaggtgagaaaagaacgtcctagtgcaggacaatgagggaaaaaggaggtgggagcggaagtacaggtagtgaaagatgtctttgaggaatggtggttagaatacaaattttgtaaatgttttgggctgagttgtgtaagatcaaggggtggaaagattgtagaaagctttgaatggtagcttaagaagccaggcagtaggagaaggaagaggtggtttagatgggaagtagtggtagcatataggatgaattgaacgggaagaaaatagggatgaggagaacagttaggaggctgctttttgaagaaaacatcttgattgagacatggttcacataccgtacagttcacccttcttcagacaaaggaggctgcttttttaaagacgaaagttccacttcaaacttcatggctgatagccacagaatgtgatatttttcccatgaagattggcaccttcttcccctgagggctctctaagcccactgcgtttctgactcctgttttttacacaggattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaagtgagttcactaaacctgtcctgtttgtgagcaaagttgggtggacgtgagtgtaatacccacttcttcctgtggttaggtagaacttttttgcataaacttggttttcttacagttttattaaacttataactccctgggtcttggagaatgtctttcctcactgttttcccttctgtccctttctgtacagcataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtgggtgtccagagtgaagggaataaatccattacgtagctgttaaccctgtcttttgtatgtcagtgctccgattttctttgcaggcattattactttatcatggtcatacttttgtttggttctactttgattcacttaattctttgttatgctgaaaaatatgacattccgttcctaaatatataagtaggcttaaatatgttacatagtcaaaataacactatctctgacaaagttaaataatactttttaaatatcatctaaccctagctagttcattttcattcttcatttgttcccaaactgtcctttatagctgttttgttgaaaacaagatctagcctaggaacatgtattatatctggctgttgtgtcccttgagtatcttttaatctagaattgtccctttcttcatgagactgacttgttaaagggatgggaccaattgcctattttatggatagttctagttgctttctcatatttgccttattcctgtaaattggaaattaaatttctaggcttgtcacgattcagttcaacatttttgatgatgtgtatttcatattgcctcatatcaataggcatataaaacccacttttcccaccatcccaccattagagatactaagattgatccctggattagggagaccacttatacttccattgcgtatttacgcttttccctcatcactagaacatcatctcttttgcaccgtcaaaatatctagttttccattaagcattcacgtgatatttttaacccaattgataatctttcctaaatcagtaccttcagtaaaagttgctgaatgatgatttgttgctctgtcattcctcctgcatttattagctcatgtgtagcctttttttcttgtctatggaggaattgcttgaactgctgcctttaattctagagttagtcttaacatggaatttagaatatgtaacaggatattgagaataagtgatttctgttgcatttttgcactttgtttaaagtaactgtgcagttccaaaactggtcttgagaatatatcaaatggttgggataccctagcaatctttgttccttgaatatttaaacatgctgtgcttaatgctctttttacttgggggtctggggcaggtatctcgatgagttgatgaaactgaaggctcaggcacatgcagagaataatgaattcattacatggaatgatatccaagcttgcgtggaccatgtgaacctggtggtgcaagaggaacatgagagtgagttatcttcctgtcctccccaaataatgtcaccattaatgatgatgtgattccatgaagtggttcaaaatactactcctagaaggatttttgggtgagagattgaaaatatctatataacacaaaaggctaaagttggatattgttttgagaacaccaggcaattgctataattaggtatatgtccagtaagaactaaattttgggggaggtgaattgaacatgatctgttatttttaaatgctgttataacaagtagtcctgacactacatggaattaggttgaattgcacaggttgtaggcatggtcctccacaagactcctctcacttcagacacaagctgaaagctgcagggttcccaggccactgtacttctgaacaactggctgcaaatttggaggatcccttctacccgctcaggtttaataatttgctagaatgactcacagaactcaagaaaatgctagacttacgattaaaattttattacaaaatatgtaaatcaggatcagctgaaagaagagaatcatcaggcaatatctgtgagagtccccaatatgaagcttctgtgttctcaggatgtgtcactctcctggcacattgacgtgtatcaccaaccagggaaacacacctgagttttgggtgtccagagtttttatttgggttcgttacatatgcgtgattgatagtattggctttgcgattaaactcaattttcatttggcctctgctccctggagaatgggaggccaggctggtatcacgtgactctatacctcagtggttgatctttccagcatggccagcctccatccttaaactctcatgaggccaaccaggagtcattggttggcataaattcaggtgtgggcggaggggcccaccatgaatcacagaaacatacctatcactcaggatatcccaagggtcttagacgctcccccagagacaaagaccagccagactttttattatacagcagagtccttacaaaagcagtacggctgcctaagatacctggggagtgaacgttcctaattttaatttgtatttcctgggagaaatattcaactgacttggtgggaagagccttgcttcgcattagggagccctgcgcttggatctttcttctgccatttgtttgctgtgtaatcttggagaagagattgctaagccttgttatttcttctataaaagtgttgaattagatgactttttaagaacccttgaacctttttaagactcttcgtgaatcctttgtgactcaagaatgtttttgattacacattccagtgtacctgaaagctatacagtaaggccagtttcataaaaatcctcatcgcttttaagttagagcaattaaaaatgaaacaaaaggacttgagcattcaataggaatatgaatacaagtgagtttagttgaaataaatactaattaaaaaatgaaaacagtgctgcttaacggatggtaagttgcagtttgaatcatggttactcttaggtggatttatgattagttagcatgttccatgattgatttgtttatgtacttccttaattagaaaaaaaaaactttctgtctctttatatttagggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggtgagtggcatcggaattgttctttatgttcagagcacctcagccctcctagaacaaaggtagaggtaggaatatcttccttgattcattcagtgaatgccttctgggcacccttagattcaaagcactggagggacacaaaaatgtgagagacataggctccacctactaggagctcatgctgttttacacatttgggtttttgttcttttgtttgttgttgacagtcttttgtgtctctttcagtaaattctttactgaaatataagatccagggctgggcgcagtggctcacgccttgtaatcccacagcactttgagaggccaaggcaggcagatcccttgaggccaggagttcaagaccagcctggccaacatggtgaaacctcatctctactaaaaaaaaaaaaaaaaatacaaaaattagctgggcgtggtggtgcatgcctgtaatcccagctacttggtaggctgaggcacaggaattacttgagcctgagaggtggaggttgcagtgagccgagattgcgccactgcactccagtctgggggacagagtaagactccgtctcaaaaaaatatatatatatatatatgtgtgtgtgtgtgtatatatatatatacgtatatatataatatacgtatatatacatatatacgatccagaaaaaaaaatatatatatatgatccagaaaaatgaacaaggtagatgggtatgcaattgcataaattttcaaaaggaggcacacctgtgtatttggcagtcagattgtagaacccattaccagcaccacagagaccttcctcatatccccttccacccttagccaccctccatttggtggtaagcactattctgatttctattaataacaccacagttcatttccgtccacttttgagctgtatttaagtgggatcataccttatgtgctcttttgtgtctggcttctgttgccctaaataatgttaatgatatgcatccatgtggttgcatggagccatcctttgctcattctcattgttgtgtactatttcattgtgtggttatatgttattggtgaagttttttgttgttttgtttgttttttcagactgttgtaaatagggcttctttgttttttttttgagacggagtcttgctctgtcacccaggctagagtgcaatgacgcaatctcagctcactgcaacttctgcctcccaggttcaagcaattctcctgcctctgcctccccagtacctaggattacaggcgagagccaccatgcctggctaaaattttttttttttttttttgtattttttgtagagatggggtttcaccatgttggccagtttggtctcgaactcctgacctcaagtgatctgcccgcctcagcctcccaaagtgttgggaattacaggcatgagccactgcccatggcctgtaaatagtgcttctatgaatttttaattttggttaaaaacatatatgtgcatttctgttaggtatacattttggagaggagttatggccatagggaacacatatatgaagctttaatagataatgtcatgaaggttttttgtgacaacttaattgaaacgtaattcacgtatcaggtaattcagcgtcagtggactttagtacgttgatagaattgtgcagtcatcaccacagtcaatttttgaacatttcatcaccccaagagaaactcagtacccattagtagtcactcattttcccttaatctcccccagccctgggcaaccatcagactgctggtttgtctatgggtttgtctattctgaacatttcatataaatggagttatgcaatgtatggtcgtttgtgactggcttcttttagcttagtttatccaagctgtagcagtagcacttcatttctttttgttgctgaataatattccattgtatgactgtaccacattttatttatttattcatgagttgatgacacatggattatttccactttaccacattttatttatccattcatgagttgatgacatatgaattatttgcactttattcgtgatttgatagacacttagcatgagtgacagctatataagttgtatcttcaatctacttccctttttagatatggaagccgacctagcttattctccgaaaccccactcctctgacagtcagatataaggctccctttggactttcttagcagcaaaaacaaacattactaccactagcatacatagaatcattgcagcctgacacattagagattctgaatcagtagaattagactttaagcttaggaatctgtattttaaaaatgactttttcattgttctgatgaccagccaagtttgggaaacactaatctaataaaatgaatcaaagacagagacttccatttctagcttccctagagccaactacttcttatccgagtaagtaaaatcagttgatctcaatttcctggctatgaaatagcagttgtgattcaaccctctccacagcatcaagtgacattctgcataattatatctcttaaatgaaacctggtagtatctatcagatactacacttacatgattaggacatggtaatgtcaactactgccatgccaatgtaatcaaaggagatcagtcaacatcataatattaccaacatataaaattgcccactcctctacccttcaccaaaacttacagagcccacacgagtgtcagtgtgcaaaaagctccaatacactaaagccttggtctgtttttatacgtctggctactcagaattaaaaatttcttttagcccttccgcttgctgcctcacttcaggagtcttctgaaggctatggttctatccagttgttgttacttagtaagcactgaaaaggaggtcaatcacaattagaaaacagatgttaattatgctttaatcaacaattatttgagggcctactacatacaaggcaacttcctagacagcaacagcataaaaagaggcataaaccttgtcaatttcctcagcaaactaggtagcgggtaagacaaacattttaaaagatgagtttatgttacaattactttaacaactttatcttcatagtagcattattcctgatagccacagtggaaaaaaacagtatgtctatcaagtcaggaatagataaagtgtaaataattcaaaaggctgtgtgtgcgttttgtttgggtcatcggagtaaaactttttgaggatgtgactatagagtttgaagcatttcctttgctgtggaataacttttcagacttcatcaaaggcggaggaagtcgggggagttaaaggaaaaattgcttaacattgccaggcccagctgggtgaactacacattgggtggaattgttttttgtttgtttgtttttggtttgggttttttgttttgttttgttttgttttttgtttttggcatcacctgagcatctaagtctccatcagccatttgggagtgtttttaaaaatatttatcactgagttacaaatttagagagcaaaagatcttaatttaaatttggtctgtagttttattttcttctgatatctttgtgtttggttttggtatcagggtaatactggcctcatgacttgaagtgttccttttatattttcaaagagtttgtaaaggattagctagttctttaaacatttgttacaagtcaccagtgaggccacgtggtccggagttttttgtgtgggggatattttttgttttgttttgagctgcagtactgtgtaggaaaggggtcccgatgcagaccccaagagatggttcttggatctcacacaagaaagaattcagagagagtccatagagtgaagtggaagcaagtttattaagaaagtaaaggaataaaagaatggcttctccatagacagagcagccctgagggccgctggttgcccattttatatttcatgatgatatgctaaacaagagctttatcagatcttttctgagcatgtgcacagcccacacatgcactgtggcctcctagatcccatccaggaatatgtcaagttgtcagagctctccatgaacatctcattctccagcttttccttataaggtttttagttagtctcttgtttgcctaaactgttatccttaatgtttttgacaattgcttttggagaaaaggctgtttgcagtggatgagctcttggtcaggtcaaataaagacagccatgcgagtgtgacctctgaacaggtcagctaatgacagttctttgggaatggggctttgaagggatggtaggaggggcagattggaataggggagtttaaagcaccacagaactcactgttcttactgagtttcagctgtttttcttgaatgcattctccaatttctgcaagcctttggttaatttctaccgtattgaaaaaactggccgggtgcagtggctcatgcttgtaatcccagcacgttgggatgccaaggcgggtggatagtttgagcccaggaatttgagaccaggctgggcaagatggtaaaaccctgtcttaacgaaaaataaaaatattagctggacacggtggtgtgcacctgtggtcccaggcacttgggaggttgagatggaaggatcacttgggcctagggggctgaggttgcggtgagccaagattgcaccactgcactccagcctgagtgacaaagcaagaccctgtctttaaaaaaaaaaaaaaaaaaaaaaaagggctgggcgcagtgcctcatccctgtaatcccagcactttgggagtcccaggtgggcagatcacctgtggtcaggagttcgagaccagcctggccaacatggtgaaactccatctctactaaaaatacaaaaaattagccaggcgtggtggcaggcacctgtaatcgcagctacccaggaggctgaggcaggagaatcacttgaacccaggaggtggaggttgcaatgagcaccactgcactccagcttgggtgacaagagtgaaactccgtctcaaaaaaagaaaaactgatgctggtgattgtttgccagtgtaccaatgttttttgtttgtttgtttttcatggtggagaggattttcagaggtctttaccattttcactaatgtcacgtttctcttcattaaatttagtgtttgtgggactcttgataaaagtggattactagtcgtgagtagtacagtctgaatgcaagacatggatatcagggctcctcaagaactcattttataattaagaatatgaatgacttaggccgtgtgtggtggcttacgcctataatcccggcactttgggaggtcaaggcaggcggatcacttgaggtcaggagtttgagaccagcctggctgacatggcgaaactccatctctactaaaaatacaggtgtggtgtacacccctgtagtcccagctactcaggaggctgaggcaggaggattgcttgaacccgggagtaggaggttgcagtaagctgagatcataccactgcactccagcctgggtgacagcgaagctgcatctcaaaaaggaagaaagaataagaatgacttaaatcggctgggtgcggtggcttacacctgtaatctttgtactttgggaggctgaggcaggtggatcacgaggtcaggagatcaagaccatcttggctaacacagtgaaaccccatctctactaaaaacacaaaaaaaaaaaaaaaagaaaaaaaaaaaattagcccggcatggtggtaggcgcctgcgcctttagtcccagctactcgggaggctgaggcaggagaatggcatgaacccaggaggtggagcttgcagtgagccaagatcgggccactgcactccagtctgggcgacagagcgagactctgtctcaaaaaaaaagaatgacttaaatctctctctgacctccatgtgtgtatatgcacttatgcacacatgcttatatacatgtagctagtaatcagctggttcacaccagcacagctgtaccagttgttaggacattgaaattcttttattttgtttggtacattgttactgtcccaaccctcccatatctttgccatcactccccaactctaattgaaatcccactatatggcaactaaaccagcagtgaccataaggactctgctccatcctgattggtcagtgcttatgttgtgtagttgataaacgtgttgtacagatttgtgtatgtgtgtttatgtgtgtatgtggtatatatgtggttatatatttatatatgtaatattgggtctatcatcacacatgcaaaccaagccacatagtaagtaaagtctttttaaaaagttttgagtgatgagaagtgccctttagaggggtgtgtgagtgtgtgctttccatatatacatgtacataacatagtcattcctttgcctcttcccccttttcctgtgtttgtggcttcttcacctcttctacctccaatcattgcccactctttttttaaattctgacttctggtccctatctctttacctcttctgaaatgcaatcagcgtgtttctaagtgtcagagttgttagggagctgtgcttgaatatatcttagatagcatttttacagcaaatctgttttctctccataatatctagcctgggctttaacactctgctcagtcatttgagttaatctttaggtaatctctttaaaacaaattttaccagaaggatttgggttttgtcattttattcagtctaattggagcagaaagaacctgttctttcttcttacactgggatgaggtgtagtgtatgctgtctctctttccttcttcattctggtgaggggcttttctgtattaatgtttccctgaaacacctgagacacccatccattcactttttcttgcctttcatactattgctctattgcttatttcttaaggagtatgtatgaaaggttttactttaatctgcatggggcagggaagaaagaattctgaatgcttagaaaggttctacctttctcaatgcaagggaggttgtgctaagtctcacaactttgcttacagcagattctgctcagatatctgttgtatgattatcccagaagtgaacccaaaatggcttgattctgtggaaatgcttctgtttttatgatacgaggatttttctgctgcttctcttggagactagaccatcagccctctcgcttatgacttcacaatttaagttgtcacaagcctgcagctgactcattgtattgtctcacattggaactattgtctagtatttccagtagttattcttaggactctaggggatggtgtgtggtcattttctattttcagtaatagaaagcgactagtggtaggaaggtactaggttctgcagcttttaagtgatttatttgttcttgcattctatttatctgtttactctttccctttcccaagactgtgagcttcttaaaattgggacagtgcctcttagaattgtaaggccagcacctaccataattaggttaaatgatctttctaaaagactgcatttaagagaaatcactgctttcaatttcagatgctttcctttggccttatcctgtcacctgcactctttataaattgcagggattgtggctgcttcactatatggagtgaaatgttgtgtctttctctaataaaacaggaggaaagccaagccttccctaaggttttgtgacttcaactgttgggcagtgaaacgtttcactttgcctcaaagctcagaccctgcctcatttaggcacatagttatggtgatttactaagttctttattctgcctcattcatgccttggcaaattatattcacatcgagcaatctaaatgaatttttgagctgctatttataccaactgctgttagctcaagcctcaggagtatgttaattttgttgggtctgcgtagatcaccacaaacatgactctcacaacctggccactttaaaacctgaagtgccttgtcttttctagagaagattgccccagtaatctgctgaattgatgctctctgtaaagaccttacaggcatcttaataaagaacccccactcttttgagatcgttgaaacctacataacctcagtatgaccatggaaatctaatggggtatcagcagtggtttctgattctatcacactgagagtaggtagaagtagaatcctattgtgctaactctcagtaacagtagtgactacctggggctaatccataagctacttccccaaattgaaatatggcagccacattcttgaaaattggaagataacggccaggcgcagtggctcacacctgtaatcccagcactatgggaggccaggacgtgcagatcacaaggtcaggagattgagaccatcctggctaacatggtgaaaccccgtctctactaaaaaaatacaaaaaattagctgggcgtggtggcgggtgcacgtagtcccagctactcgggaggctgaggcaggagaatggcgtgaacctggaaggcagagcttgcagtgagccgagatcacgccactgcactccagtctgagtgacagagcgagactctgtctcaaaaaaaaaaaaaattggaagatattagaggaaggtatttctactaatctaattctgtttaaaatgccattcagagcaaatggtcaccaataagcgcctttaaaaaagaaacttgtcttaacgaatttaggaagaggaaagtaagtcacctccactacatcatacatcatctctatccacaatagtcaactcagactatgctgtgaggcttttgttagctgtactaaggaaagtaatcacaacattcattatatttctgtgtgaaaatttgcttttaagttcccagcaactgatttaacattcaagttttaggatatcagctagtgagaaatgtagattgcctgtagtgacttctggctttaaatgtgatgagtcaaagattctggttaaagtaagacttgacagtcttaaaaacattagtagtcatagagaacgttaacttcctctgaacattgttggcaaaggaggctttcaaataagtactgcatattcatatatataccctggcccttgtcaccctgttaaagtctctggaccccttcccagtctgtctgggcctcttgccccttctagctgttcacaacttcctgaaccacttaaattcatctttatataatcttcacctacatgtgagccatttcccttatcttatgacctttaccagtttgtttgtttttggagaccggtctatactcttgactggagtgcagtggtaagaacatggctcactgcagcctaacctcctgggctcaagcaatcctgcctcagcctccctagtagctgggactataggcgtgcaccaccatgcctggccaagctatgtttgtttgtttgtttgtttgtttgtttgtttgtttttagagagacggggtctcactatgttgcccaggctggtctcgagctcctgggctcaagcattccttctgcctcagcgcccccaaagtgttggattacaggtgtgagtcactgcatccaactttttaccagttttttgatgcctccttcttccatttgactaacccacgtgtctcatattttttaagcctgttcttccatatttaattgagtctaggaagcccccttcttcacatgtatgttacatgtaccctgatttcatgactttaatattttgcttttaatgatatgtaggaaatccaggatgagtcagctgtgttatggttggatgaaattcaaggtggaatctggcagtccaacaaagacacccaagaagcacagaagtgtatgtatcacctgttttatttctgttttggtggaggctggggtgacaaggtgctccgtacagcttgaccaagataggtatgggggaacaatttgccagtagatatagttaggtgaagcagtatgtgaatttagacactctctaaactattctggtaacagttctttcccgaaatagttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggtgagttctgggataatacatatgtgccctgaagctaacccttgagtatatgaggggacagatgtagaggaaagggataagctatagggaaagaccttttagcatagatgtacagtacttaggctcattttaaaggagataaaatccctatttttgaaaatatccttccccccccccttgtggacagctgtgttaataaggccaattttctgagaatgtgggaaagattaaaatatttaactgtttatctttcacagagtagcagtagctctgattaagcctataggcaattaaaagtagtttgtctgtaaaaagagggaaagaaataagatttcttaccccattttatggacttttaaaaattaaaaaactgggccgggtgcggtggcacacgcctgtaatcccagcactttgggaggctgaggcgggcagatcgcctgaggtcaggagttcaagactagcctggccaacatggtaaaaccctgtctctactaaaaatacaaaaattagctgagtgtggtggcgtgtgcctgtaatcccagctacccgggaggctggggccggagaatcgcctgaacccgggaggcagaggctgccgtgagccaagatcatgccactgcattccagcctgggcaacagagcaagactctgtctgaaaaaaaaaataataataataaattgaaaaactggagaggctgaatggttgcacattttttaagacagacaggccttaaactttggctttggagtgaacaaagttaatcatggttaattccataattggacttcataggtattttcttcttatagacataaatgagctaaattagtcattacaaagccataatttaatgggagcttagcatgcccctttactctcacagatccaaggagcagcttttggagtggtcttcatttagactgtgagactaactaataatcctgcagttctggacgtacagctggggagtgtggctctggatgtcttctatctttcctttattttctgccaggagataataacagcaagtgggtgaagcactgggtaaaaggtggatattattattaccacaatctggagacccaggaaggaggatgggatgaacctccaaattttgtgcaaaattctatgcagctttctcgggaggagatccaggtaggttacctttcttcacgtaagaagaagctgagagaaagtgttttcaagctataatattaattaagaggaacagggcatgtggtcagaagccctagactaaaattgaggttatgtaatgagctgttttgcggtaatttttttgtagtagttgggggagtgactgaggcctgaatttgtaaaacatctgaattatagaattaagtgatataaaccatatgctaagaaaagttagatgatctataaaagaaaaatgaaaagttgctaactccattaaatgcaactattttaatctctcccagtttatattttcagtctctcttctaactgttccacaaattatattagctacaacctgcactttcaaataaagttagcattttcatagagcttttaaagtactttttcatcttctgtgtctttgtgtctttgcttatactgttccattcaacagtttttgtttgtttgtttgtttgttttttgttttttttttgaaacagagtctcactgtgtcacctaggctggagtgcagtggtgcattctcggctcactgcaacctccacctccctgggttcaagcgattcttctgcctcagcctcccgaatacctgggattacaggcatgcaccacacctggctaattttgtaattttagtagagacgaggttttgccctgttggccaggctggtcttgaactcctggcctcaagtggtccacccgcctcagcctcccaaagtactgggattacaggcgtgagccagcacacccagcccattcaacagttatttgttgaatacctcaaatgtagcaggtactcttctaaggaatggggatatagtcatgaaccaaacaaagtctctgctgtcatgagatgtctctcccctgccatctatatctgtcaaaattctttccttccctttgtactgattgttggtatcataaaagaaaaaaattcaggctgggcatggtggctcacacctgtaatcccagcactttgagaggctaaggcaaaaagactgcttgagcccaggagttcaagacaagcctgggcaacatggtgaaacctcatctctgcaaaaaatacaaaaattagctgggcatagtggtgtgtgtctgtgattccagctacttgggaggatgaggcagaaggatcacttgagcccgggaggtcaaggctgtaacgagccatgatcacagcagtgcactccagcctgggcaacagagcaagaccctgtctcaaaaaaaggaatatttaatttaaaaattcagtcctccaagcacacccatctcaagtcacctcctctatgaatctttttaaaatttcctttccttacccccttcatcttcctttgaagctcccaaagaacttggtattcattcagaatttaatgtacttggattcgaattttagtgacatttgtgcttgtctatgccccctagtagtttttaaggtgagctgctaagtttgcagtactttctcaaaggggaagttacattgtcattgatggactgttgaggacttttaagttttaacttggtgctgcactcctgttacttaaaccagagttgtttaatgaatgttaaaggggaggaatatatactgggggaagatgctcagtaagctcctgtaggtcgttagacatattactaacagacattcaggattcctagagaaaaacgacagtaaaagattttcaaaaggtcatttacttccctttggcaatatttcccaaatcgtgtgtggaacaagtcaaaaatacacctgtggaaaaactgaaatagtccctttatttaggagttaacatcagatgggtgatttctaccttgtggttaaagttctctttatatggtgggttacagtctcttacccttccagtgtttcatcttcattgctaatgatttcacaggtgatgaaatttaaattcattgaactctgttctgggcattgagaagacagaaatatgtatcagagagtctctaccttccattgtttcacagtgttgtgaaaacagcagacacaaaaccgagtactgtaatgtaaggcagagagaagtggtgctctaatcacagcacaataagggaagtcttaagggaatttttcattttgtcctggagtaacatagcgtagataatattttagcagctgaggaaaaaaagaaaaggctgttctagacagaaagggaaagttaaggatgagcttgctgaaattataaaaaggaagtaggagagaaaatagaaaaggaaaaagcacagagtactgaaaggacatggaccactgaaggagaggcgaatggtgtattacctggcacgtggtaggagtggcaggacaagaggcccaggttgaagcttgagggcctaatgtgctgtgctaaggaattcagggtacaacttctagcagagtgatttttaactcttgttagttcagggacacctttgagaatcttattaacctccacagaaacactcatgtttgaatagtgttttgcatatatggacctaagaatttaaacagggaagggatgctacctcattttcagcatgtgacctgacctcttacctctcctgccaacaatagtggcgatcacatatagatcctcccactctactcaccactctgtactttgaacttacttggattttcactgattccttcttcattttctctctggaggaaacagctatcctttctaaagctcattattgatcttactgcttgatttcatcctctcccagttccttgcagaccttgtactttttgtgctcttcctccagtgcttgtcaggatttaatgtctgtctgaatcacctgggatcttgttaaaatgaaggctctgattctagtgcgaggtctgagaaaatctgtttctgacaagctttcaggtgatgttgatgctgctggcccaaggactgtattttaagtagcagcctacatacttaagcatctttatttcccacatctttgaaaaaataataatacaaaatttttttaaagcccatggaatttccctgatctggcctcacctacattcatactcttgctaagggccttgaaagttagtctactcgtcactaattcactctctgttaccatccacttcttggctcacagcagtgtggtttcctgtccagcttttacttagtaaaactcttattttagaattcatcaataaccttttaattgccaaattcaattctgagcactcatcatatttgacttgtcaaaagtctcttcctcaaaccctcaattcctttggcttctgccatccaactctcttctaattttcctgcttctaaatgttccttcttaatctctcttgctaccttcctttctcgacctctgcttgaattatacaaagagtccattggctgccttctcctacacattcttcctgagtgatctctttcaagcctgtggctctagcccttacccttgtgcttgtgactcctaaatctgtacctccagacgttagcccttttccccaccaccaggtttttgcccttcattttgcagtccagaagtccagcagacacctcaaacacagtttaacaggaaaaaaccagaggctgcaatagtgtataaggttgtatttttatctcacatgaaatgattctgcagttcagcagtccagggaaaatgtggcttcatggtatcatctgtcccaggatccttcatctttgtgctctgtcattcttagcatgtggcttccattctcaaggtcaccttgtcacctataatgacagtttggagctttgaccatcaagttagcagtccaagcaggaagtaggaagaaggggaaggagagcaaaaaaggtgtactgtcagctgtctgtttctctcaaggagctttctcaaaggtcttgccatactactactgctcacagcgcatgacctcgctctacctcatgaagtcttttttttttttttgaagcggagtttcgctcttgttgcccaggctggaatgcaatggcgcgatcttggctcaccacagcttccgcctcccaggttcaagcgattctcctgcctcagcctccccagtagctgggattacaggcatgcgccaccacacctggctaatttttgtatttttagtagagatggggtttctccatgttggtcaggctggtctcgaactcctgacctcaggtgatccacccacctcagcctcccaaagtgctgggattacaggcgtgagccaccacgcctggccactcgtggagtcttttaagtgcatacagtgttgcccagaaaaaaaaaaaaatcgaggctctggtaccaaggagaaaggagaaggtagatgtggataagtaactagatgttcctaaccattcttactgctgctgcccttgttcaagcccaggccatctgtcacttggatcacaatagcagcattgtaattcacccacttggttgaagtctcttctcactctaatctgtcagctgctttcctaacagtattgtttttctaaaaataatctccaccctgggcaatataatgaggactcacctctacaaaaaatattttttaaaaaattaaaattagccaggtatggtggtacacttgtagccccagctactcaggaggtgaggtgggaggattgcttgagcccaggagtttgaggctgcagcgagctgagattgtaccactgcactccagcctggatgacagaatgaaaccttgtctctaaagtaaataataaacatctgattgttttattcctttgcttgacaaaatttcctggctgtccagtatctttagtaacagtccaaaccctctaggctacttttcaagaccatttgcaatctgcctggagaagcaattttcagtcctcacctctggtctctccccctgagatgtcctgcattgtgacattctaggggtccctcggtacgtggcacacagccctgttgggtacctgtcactctgttcttgtctacagtgaccccagatcagccagcacagtgcccagcctagtcagtgttggataggtagataagtgagatgacatatgaagtaaaagaagatcaagtttttgtttatgaagtgttttctaggtgggaggacgtgtgtgagaacaacctagtcctaaaaaacagacctgagggctttattcctgttatgtagctaatgatctagtatagacttaggaagcaggaggtgttagcttgtgtgctgtggatgatacttcgtgaaaacctgcatccattcttgcctgtgaatgtctttgaatgtgaccactgctttttcagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcaggtatttcagaacctatcacacagacagcaagcgggcatctagagcaggggtaataaacggtcagctgtcaccattgactgtctgagtgtgttttttgagtgctggactcttagtcttctctttcctttgacaggtacctcctctttactaccatttaactgtagtgtgcctacaggtgtttaatgctggcacagtggcagttcttgggtacctcttcctctcttcttctaagactgtacctttctgtaagatttgaaccttgagggaaacaactgtggtctggcttcaatgataaggtagcacaatgtcctggaaagaattctgagttaggaatgatggctgcactactgccagacagtggtgaatctccaagtctttgtccccatctgtaaaaggggaatgccccattgtatcttatcttcctcacctggtttgttgtaagaagccagtaaatgaatctgtatggctgcactgtaaaaggtgtgcagggctgtgctgacgttggggaagtagaatgtagccatcgtgttcttccagtggagggatggcccgtgcccttgttcccctgtcactgctggaagtggtccttcctaaaacttcatcatgaaattgcacttggatcatgtatcaagatgaaagtttttttttaacttccattgatgcttgggaagtaatatgtcttctgtaacatttgactgtttcagtcacagtggagaggatacaagcagaagaaggcatatcaagatcggttagcttacctgcgctcccacaaagatgaagttgtaaaggtatggtagcctgaacagggtttctccatgaggggcacaggtataacacgtgttgagatgaaggactcttctaatttccaggatcccttttccacagattcagtccctggcaaggatgcaccaagctcgaaagcgctatcgagatcgcctgcagtacttccgggaccatgtaagcacccttggatcatacaggccattaggagcaattttgccatatttttggtagacagatgaacagagaaatttcttcttttttgttccttagataaatgacattatcaaaatccaggcttttattcgggcaaacaaagctcgggatgactacaagactctcagtgagtaactggctccgcatgaagagttgaggcagtggctgggagccaccaagttcagggtattctccacagacctcttttgttatcctgaaggcaaggcttgggggagagggtgtgacctgtgacataagcccctttgctaacatgtggctaggtgtcttgttggcttgttgcattaacctttatcataacatagcaatagcctgacacagaagactgcacctgatagttgtcttagcacatctcaaaattaaatgtttatgaatagactactttttcaagacaatgctatttcctgagacgtagtactttttctgctaactccattctttgatgcatactttctgtcagtcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggtatggcccagtgccagcgggggccttggaacggttcatcctgctttgtaacccctgcattcccctttctgactggtggggagggtggaggctgactttctcctcagctactgccataagagctttttttttttcttttgactgagtctcactctgttgcccaggttgtagtgcgatgtgatctcagctcactgcaacctctgcctcccaggttcaagcaattctcctccctcaacctcctaagtatctgggattacaggcacgtgacactatacctggctaatgttttttgatttttggctttttttttttttttttttttgctgacggagtttccctctcgtcgctcaggctggagtgcagtggcgtgatctcggctcactgcaacctctgcctcgcaggttcagcgattctcctgcctcagcctcccaagtagctgggattacaggcgcatgccactacaccctggtaatttttgtatttttactggagatggcgtttcgccatgttgaccaggctggtcttgaagtcctgacctcgggtgatccacccgcctcagcctcccaaagtgctgggattacaggcgtgagccacgacacccggcttttttgcatttttagtagagacgggggtttcaccatgttggccaggctggtctggaactcctggcctcaagtgattgatccactcaccttggcttcccaaagtgctgggattacaaacatgagccaccatgcccggccatcataagcttttaaaaaagttatgtaagacaggtcaggcatgatggctcacacctataatcccagcactttgggaggccgagaagggcggatcacttgaagccaggagtttgagaccagccaggccaacatggtgaaaccctgtctctactaaaaattaaaaaaaattagctggacatggtagtacatgcctgtaatttcagctactcaggaggctgaggtggaagaatcgcttgaacctgggaggcagaggttgcagtgagccaagattgcatgactgcactccggactgggtgacagagtgaaactctatctccaaaaaaaaaaaaaaaaaaaaaattatttaagacataaaacaacttaattgacaaaattttgatagagaaaagaagataaatgtcttcccctaatttcacctaccccagtcattttgtatcttacattcttacttcatattaaaggataagactctttccctatgataagtagtcataatttttttttaattttattttttgaaacagagtttccctctgtaccccaggctggagtgcagtggcatgatcatgactcactgcaacctcgacctcctaggctcaagtgattctcccacttcagcctctcaagtagctaggacgacaggtgcatgccaccacgtctggcaaattatatttttataagagatagggtatctttgtattgcccaggctggtctcaaaactcctgggctcaggtgatcctcctgcctcagcctcccaaagtgctgggattacaggtgtgagccgctgcacccagccataaatattatttttaacagtagcatattagatttttagaagatatactatgatttacctctttttcccctagtatttgacatttaggttgttttccaagcgtttattataaataacattgcaattaatgtttcaatatatatgtagcttttattgtatttaagacttatttttataatagactgctggaagttggtttgccaattcagtggacattcttatggctcagattctttgttggaacataggaatggatttgactggtgtactgaaaacaggataaagtgtagtggtttttaaatattcagtgggaatctgccagtgcagtacaccttcatgtgagtttgcacatgctgcaaaacctttcctcaatgcccagaggttcatctttgaaagctttctgatctatttattggtttttgtttataggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaagtaagtggctcctggaatcagtgttataaaaatttagtgaatttatttttccacaagaaagccttaccatcgatctctctggaagtatttttgacttccactgaggggtgagtgaggggcactgtaacatgttaatttattaatcttttttctcatatgtattgtagtccttcaattttaaataattgaatatatcttgccagcctttatattacctacaaatgacttatcccttggttttatttcagaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtatgaacagatttcctcagggcacaggccccttcccactatcagaggggctcccagtttgagattcatgccttcctgatcttttcttgatctcaattaatttatgaaaaatacttactctaaagaagcatctaatttttaaataactgatataaaatcttgctgcttctagggaagggataaattaactttaggaacattctgtattaaggtataatttcaaaaagtaatctgaacagaaagaattcacatttttatctagtagcggacccaatcatgaccacgattgagcgtgcagctgcaggaacattctgtgagtgctggggaatgtttcgagagaaactgtttcagggagataggatctttaagcaggaaggatcttttaagttgatgggttttgtgacaagtttaaatttttatctgatgttttataggtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaaggtatgttaaccataatgacacttttctttcatgttgttatagtctttccctcttttttcccctctctttatttataaactaatattagttcaaatagtttttcttttcttttctttttttagacagagtttcactcttgtcgtccaggctggagtacagtggcataatctcagctcactgcagcctccacctcccaggtctaagcaattctcatgccccagcctcccgagtagctgggattacagttgcacgctaccacacctgtctgatttttgtatttttagtaagactgggtttcaccatgttggccagactggtctcgaactcctgacctcaggcaatccatctgcctcggcctcccaaagtgctgtgattacagctgtgagccaccacacccagcctcaaatagtttttctttagaaaactgtgctttctaagttgttgacctagtaataaattcacttatttagcaaatatttattgagtattaactatgtgccaggcattgtgttagagatgtgtacagtaatgcaataatgagtgaaacagacatgcttcctgccctctcttcatagttcattgggtggaagagacaccaaccaggtacataaaaataaaagcataattaaacattgaagaaagttttatgaagttttatgtacggttctttaatggagactttataagagggagctaacataaggtggttagggaaagcctatcccggaagataaaatttcatttagctgaggccctaaagctaagatgaacccagccttactaagagctaggtgcagagtgtttatgtctgaacactctaagctggagggtgtaggacttaaatggaccctggcataactagggatacagttgaatgagaaggttcatatagattgggtgagatcactgtgtttcattaaaggaaaaagaaaacggtgtggagtgagcttccctgaaatatcgtgagttgggctaattaaattaacgtattacaggagatagctgagctagggccatagcgtaaccaccaacattcatttatctaaagcaaaagtgtgccaatcaaatattggtaatgctgggaaaagggagttcagaatgccaaaacgtttctggttttatttgtcttgggtgaggacccagaggggtgggagatggaggtgtgagcagcatggtctgttgtggttttttcttgttgtggagtagagttagatcatgcatgaagctctctgggcataggtggagtagcagctgtccacaccattgctattcaaagtgtggtttgcacaccagtaatggaaaatcatctgtgcacactgtttagtttaactgatactttttttttcatagcaagattttcttaatgaaggaagtaatgtattgatttacattctgactcattgtctttatcttgtctttgatcagtttgtagactggcactggtccacactttgaataacactattcttcattctactttccatgtacccggatgccaggcaaacagggagttttacgctgggtggagaacggaacattctgctgactccttgaaagggcttatctcaccagccatggtagctcacgactgtaatcccagctctttgggaggctgaggtgggaggattgcttgagctcaggagtttgagaccagcctgggtaacatagggataccttgtccctacttaaaaaaaaaaaaaaaaaaaattagctgggtgtggttgtgcacacctgtagttccagctattccagaggctgaggcaggaggataggttgagcatgggaggttgaggctgcagtgtgccttgatggcgccactgcactccatcctggttgacaaaaaaagaaagaaggggcgtttccttattaggaatcatttggcatctgattggttctcagtaccatgtaggtctgttatcaggactcagatcattgcaaaagtctttttaatttttttgcctgcatacctgaggcccacatccaggaatgtggtcagccaagtgcaatacttgtctgggaagttttgcctgcaacccagggcattccttgccgatagccccatgtacactggctccgggcttctcagttatttcctctgatggtccatgagtcagtcattttcagatccaaagcccgctggacatttcaggattggttttcttgtgggtacctataagaaactggtgtcttattttgcctttcataaaatggaaattgagccaggcatggtggcatgcaccagtagtcccagttgctcaggaggccaagacaggaagatcgcttgagcccaggagtttgagcactgcctgggcaatgtagaccccatatcttaaaaaaaaaaaaaaaaaaaaaggaaattgatttgaactctttttaagataccagtgactgtgagggatggtggtgtggtggggatctgtcctgcaggtaagcatcacaggtcccttagctttcttcttttacttcagccaccatacacgtagcaaactggaatcttgtcacctcttgggaatgttctttcctaaaatctcaaagttaatgttctgttctatcaccaacgttttttagcatattgattcccttgctggttactacttttaaaactcatataaataataaaatatacaatattctttattgttaagttccatgtatttatttatttctcatagaatgtttctgttgatttttgcagaatttttgtgttcatagtctaccaattttaatttagccatgctatgacaaatgaagaggggtatccctatctacttgtatttttctttttgttgttgtggttgagacagagtctcgttctgttggtcaggctggagtgcaatggtgtaatctcagctcactgcaacctctgcctccctggttcaagcgattctgctgcctcagcctcccgaatagctgggattacaggcatgcgccacacgcctggctaatttttgtatttatagtaaagatggggtttctccatgttggccaggctggtctcaaactcctgacctcaggtgatccacccgcctcggcctcccaaagtgctaggatgacaggcgtgagccaccacacccggcctctacttgtattttctaaggctgccataacaaatcacctcaaattgggtggcttaaaacaaccgaaagtcatggtctcacaattgtggaggccagaaatttgaaaccattatcatgaagtcgaggtgctggaagagccacgctccctgcagaggctctagtggaaactctgtttcttgactcttagagcttgtggtgactgttgacatccctcaacttgtggctgtgtggttccagcctctgcctttgtggtcacattgccttctcttccccttctgtgtgtaccaaagctctctctgcctcttttttttttttttttttttttttttaagacaaggtcttgctcaagcagtcctcccacctcagccttcctagtagctgggaatgctagcatgtgctgctgtgcctggcatagcactcctatccttgaagacctccttctggtttctaacaaagtccagatttgtcagtatcatatacggggtctgtcatggcctgctccctgtctgcttttccactgtcatttctcctgtctccccttccttcctagaagactcttcctctccttttttcctgagttcaagcatcccttcgttttggaagctttccttgctttttccattctgagttgaagccctttccctatggtcctgtggcacttttggtgaactgatttacagcacaataggtttataatcatctgtttgtgtgtcgctcccaccagactgtaaaagactgaagagaaggtgtcatgtcttgtataacttttattcccaagtgcctgttattgtgcctggcacacaattcaggcacctgattcacagttaaaaacctgcgttcagattctagacttatcacttaccagccccgtgaggatgagcttaagctatctaatatttctgggtcttatagtttatgaaagataagacacttgcttcaggctgttcctggctgttagtctaacatagttgggtataatttctgtcttcccagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccgtgagtgccatcagttgtcatgacccccagtagaacccagcactaagtgcctttctgctccttggcccttctcactaagttttgtccatcccgcagttatgggatgcgcttcattgccaaagtgctgaaggactcgttgcatgagaagttccctgatgctggtgaggatgagctgctgaaggtaagaatctcatagccggcagactcctgccctttgaggacaaagcaataaaaccagggctgaccatagatcattactaactgcctaagtgtaggttctggcagtagcttaccattgattgtgagcttttgaaagcaattgtaattggtaaatggtacctctcttaggatgaaacacttcctatagtttggcacacaaacatcaaacaagtagaaagatggatttttcctgttttcagatgagtttctttgagtcctatcttttcgctgtagtattgttccctctgctggtgacctggcgaatagtagcaggcacagttgtttctgctaaggctgttgctgataactctttcttactcagctatgctcttctcttttctttttttttttaatctgaatgcttttttcttctctctcctagttctgtgctttcctacagtgaggcctcgattctagactttctgttcaggtgaattaattttatttcttctgaatgaaactctaggggaaatgctgtgactgcccctgaattcttctgtggaagagatgtgtgttaagtgaatttaatttcagaggcatgaacttggcctttgaagtctgcagcatgagaatgttgggaggtggggttactctatgctgattgggtcatgttaaggaatttagctatgtttgttagctttttataaggaaagcccatctacatgaaagtacaaagtgcatgtgggtgacagcagccttatttgctaccatgatatgtgaacaaaagatgccctgaaatacttaataacagactttaagtgtgtcatttttaccttctgaatctgctctttcattaactactggcagtagttttcagttctgttctcattgttttcctgtattgaacaaagggatatttcatttagttccaggccatgagagagagtgtgtatatgtgcatgcatgcgtgtgtatatgtattttttatttattttttcctcataggactgcattttctgcttttctttgctagcaaagtcatttatagcttccttggtggtatgtcttttaatacccatctttctgtttcgtctgttccagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcaggtaaggggaaaggcacaagtgcttaagagagtctgtggatgtatttttattgttgaggggaaaaataagattaaaaaccacctctcactttccccggactgccatatgtagaagacgtgtttgatgtgcccaggattccagaagatgatccatttactttgaagagaattttcatatgaaatagatagtagttaacacttatgaaatagatagtagttaacataaaaataatgatgattatgcatttagtacatgttaccttgtaatcagagaagaattggagaatgcttttaatttttgtaaattaacatctagttttgaattcagtgcttcagagcactgtcttagagatagaattggttctcctaatggtgtctggaaacttttaagtcatggtgcaatggttcttatgggtaaaactaaaactacaaactaggtggagaaagaagttattcgaaccactatcccaaggttgtcaagcacagcaaacacacagcactttctcttgaagtaactgttgactggcttctgtttgcactcattgtgtgagaggtttgtgaaatgtcctcttgccaacttcatgtgtatgtccctttttggggggctgcctcctgtgcttatttcagacggtttttccaaactgcttgtgatgtcccagagcttcaggataaatttaatgtggatgagtactctgatttagtaaccctcaccaaaccagtaatctacatttccattggtgaaatcatcaacacccacactgtaagtatttttctttaattacttaatttcattgtccttaattattatccctggctgctgcttatcatctctggtagccaggtgtctaaccttcctgtaatctaactgacaatgcatctccttgatgtctctttttttgcttgttattcttttttgtttatttatttattttttgagacagagtctcactgtgttgcccaggctggagtgcagtggcgcgatctcggctcactgcaagctccacctcctgggttcacaccattctcctgcctcagcctcccgagtagctgggactacaggcacccgccaccgtgcctggctaaattttttgaatttttggtagagacggggtttcactgtgttagccagcatggtgtcgatatcctgacctcatgatctgcccacctcggcccccaaaagtgctgggattacaggcgtgagccaccacgcctggccttttgcttgttattcttaacagtatctactgctaagtttctaaaaggtcttcccaggccacctgcatcagaatcctatgggctgatagttaaaaatgaagtttcctggacaccgccccaggcctactgaatcaaaatcccactaaatttatctattgccttaataaaatagtgcttttactcttctttctttttaccctagctctctgcgttatttttctaacatgatctagaatactagctttctctgtgtagccttggagtggatttttcccttggaagctggagctccatgtttcttcagatttttcaaatcattttttcccctctggggacatggacatgtaaaacaggaacaagggcatatgttaaaatgtaaatgaaatttcaggttactgtcatttctgagggcatcactggggataatggcaccttgaagactttgttgagtgcccctacaataattataacattgatttggtatacttttctctgaattaaatcatgtcatacactggaaacattaagtaaaagcgtgcacgtgacttatttgaactggcagtagggtacattgatgactttgggtattgaactttgagtttcagtgttttgtgggttttttgtgtttgtttgttttgttttgtttttttgagatggagtcttgctctgtcactcaggctggagtgcaatggcgcaatcttggctcactgcaacctccacctactgggttcaagcaattcttctgcatcagcctccctagtagctgggattacaggcacacaccagcacgcccagctaatttttgtatttttagtagagacagggtttcatcatgttgtccaggctggtcttgaacgcctgacctcaggtgatccacccgccttggcttcccaaaatgctagaattacagacgtgagccactgcacccagccagtgttctttctcaaacagggcacatttgaatcctttatggccatgaggttaagagaataccagtatttcctcttcttatatcataacataagtcattcaacagagcctggtgtggtgccttatatatcatattgtttatttgggttagtttgctgaggatttgcttgttgtttctttgaatataggaactttgttggaacctctttgtgcagatcattgttagacattctagggagggacgggctgaagagttgaatgtataaatggagttgatcattggtgtttgcagctcctgttggatcaccaggatgccattgctccggagcacaatgatccaatccacgaactgctggacgacctcggcgaggtgcccaccatcgagtccctgataggtagagttctaacttttgcctggaagatcaaaagggaatgtgacagaaaagtgttgtaattgtcacctcctctattttttgcactataccaaactctggatatacattgagaaataaaatagatgtgatcctgatagtttcataagagagaaaacaacaacaacaacaaaagcccagatgtgatcaatatctataaggaactggagtcagaggaaaagatcattttaaacgcagatacatactgccagcttgtgtttttttaaaaaaattgcagatacataaattaaaagtcctctaaaggaaagaatttttttgtttgtttgttatgagacagggtctccctctgttgcccaggctgaagtacagtggtgcagtcatagctcactgcagcctcaaattcctaggctcaagtgatcctcctgagttgtttttttttttttttaatagagatggagtctcactatgttgcccaggctggtctcgaactcctggcctcaagccatcctcctcctttagccttccaaagtgctgggattgcaggactgagccactgcacccagccagaaagaatgttttcagagagaattgtgatattgtagtgttgaaatgatttctcaaacatttatggagttattatggatcccttgcctttatcatttggcataacattttatttctcagtaaaagttgttctcgtcacactgtatgtgttaggtgattcaagtattatcttagacttgcatcatcttatatttgtattatttccccccaatatctcctctctttattacgctgactctttccaccctcccaaaacttcaggggaaagctctggcaatttaaatgacccaaataaggaggcactggctaagacggaagtgtctctcaccctgaccaacaagttcgacgtgcctggagatgagaatgcagaaatggatgctcgaaccatcttactgaagtgagtatcaaaagaaggaagaatgaaatgaatgtaatctgaaggtttcttggcctttggagaggaacctgctgggtcctacctgaaatgaccatcctgacctctcgtacttgtcataatcccagtcaccaatcacctcgcatattgtacttggtacaggacttatctgccttattttgctaatatgctacagtgaaatgtaaatcttggaaatcctaaccctcgtacctacttatggaatggctgggtaaataagccttgtgccttgagtactgtgtactggcagctgccgcttgggacttctgtgaggtactgtttgtgctgctgctgctgctgctgcttcggtccacttgagaggaactagaacactggtaatatttaaatgcctcccccatctcgtttcagtacaaaacgtttaattgtggatgtcatccggttccagccaggagagaccttgactgaaatcctagaaacaccagccaccagtgaacaggtaaaatttagggtctaacatactcctttgtttggtagataagctctcccgataggcgcatgtcagagaaaggaggggagacacaaataacagttggtagcctaggggtgagcatgaatgtaactgggggacagtggtagttatggctcgtctgagaaagtttttgcttcctgagtccaggtgatgtcctttggacaggaagctcactggcacttgcatgcagaatcattgtgcccatcccgtatatccatcccttggtatccacaggcgattctttccagcacccattctccccacccccggccaataccaaaatccatagatgttgaagtcccttatataaaatggtgtagtatttggccgggcatggtggctcatgcctgtaatcccagcactttgggaggctgaggtgggtagttcacgaggtcaggagattgtgaccatcctggctaacacgtgaaaccccgtctctactaaaaatacaaaaaattagccaggctaggtggtagatgcctgtagtcccagctacttgggaggctgaggcaggagaatggcatgtacccaggaggcggagcctgcattgagccaagatcgcaccactgcactccagcctgggcgacagagcgagactccgtctcaaaaaataataataaataaataaataaataaataaataaataaaatgttgtagtatttgcatatacttacgttctcccatatactttaaatcatctctagactacttataatacctactacaatataaatgctgtgtaaatagttgttactgtatttttaaaatttgtattattttgtattgttgtatttttttttcaaacagtttcagggttggttgaaaccatgaatgtgtagggttcactgcaatttattgaatattatatattttgaattctgttacatgccttggtagatagaagaaaagtacagaatgtggctcctaaactcagtgaacccatggtcttgttggggaaatgtgacatatatacctgaaacagtgatgaactgtttcaaaattaactatgttactgactgaaaaataagagaagtttcaggaaagaggccagtgaagcagtgcattaggaagcttcctaaaagaagtggaaccggagccagatgtataaaggtggaaaggatttgggtgtgcatgtaagacaagagagggcattcgaggcaggagagcgatgtgaacaaaggtacaaaggagggaagagcatgatgcgactagactacatgtctagaatggagctgtgggtggaggtgagtagtgagaaataaaacatgagaccaaattatttagaactcacaaactagatgggaatttgtcactgcagagataaggaataaagagcctctgtaaggttgaagaccatttaataaaagttaattaattcagcagtgctattagagcagatgtagttgagtcatataggtgtgtgataaggtccagtggggtgggcagatggttgggtcctggcattttgtagggttggatgagtcatgtcatatctaagacccttgtttcttttttttttttttttttaatttgagacagagtctcactctcactcaggctggactgcagtggcgtgatcttggctcactgcaacctccgcctcctgggttcaagcgattctcctgcctcagcctcccgagtagctggactacaggtgtgaaccaccacacctggctaatttttgtatttttagtagagacaggatttcacgatgttggccaggctggtctcaaactcttgacctcaaatgacccacccactgtggcctctcaaagtgctgggattacaggtgtgagccactgcacccggccatagacctctgttctcatttgtcaagtaaggaaagtaggtcaagtcattcattctcaaattttaagcatggtaatctgtttcattaaatgacaacttagctaaaagcccagtatatagagcaggtactctgctactctggagctactctgatagccagcaatagggcatctgaaatccagccctataggactctgtgatgcctctggcaaactcttgaggctgcacagagaactatttggaaaccattgttttcaatgaagtctcagctgtcagttgctatgactgattactgattagatatgtgtgaaaggcaagtaaggacatgtaaaccaatacttgaaacatgttgaacctagaaagaaatttgaaataaggaaggaggagccagtctttattgagaacctagtatgtgtttggtgctctcacctctgttctttaatttaatccttacaatattcccatgagtcgagtcttttcatccttattttgcagatgaggaaaccaagacccttacaggttaactggctaagatcatcagcttgcagtgacagaaccggaggtggatccagttctgtctgcctccaaagcttatgctgtttacattatgtgatgcagagtagtcttgacattagaaaaaaggggactattgggaaagggaattgctccagttagggggaattacaagtttgaactatgagccatcccgaatgtaaacatcccagtacaaacagctcagaatatggcaccagagccatggtcacaaagatttaggatctgtcaacacagaggcagtcaatgaagtattgagagtaaacagagagaaatggtcacagatcacatagaagtaccaaaccatgcatagagcaagaagacagtgcagagaagatgagcaaggtgacagaaaaggctttggattttggacaggggaatggtaattggtgataagagcagtaaagaagaaagtgctgaaagaacgaaacagtgagtgtagatcatatgttggacagggacagacaatggacggtgactatgaaggatggcgactatgaaggatggcagtatcaagggaaggtgtttccctgttagattgtggtgtctgcagaatgtttgaaagcagaggcaaggctcgagcatgattccaccttgtgacaaagtgacacaaagaattagcaaggatttactaagcactggtcttgttgtattagtatagttataacatttatacagctatgtttttaataaaattaaatggcttccatgtctcaaaatgtggtagagaaaaatgactttgtagccagtagagtccagtctcggtgattgtacctggagtccaggaaagaagccctaagcacctaagcagttgtgtgatttgtttgtttgcttgttttttgtttttttgagacggagtctcgctctgtcgcccagactggagtgcagtggcgcgatcttggctcactgcaagctccacctcctgggttcacgccattctcctgcctcagcctcctgagtagctgggactacaggcactcgccccatgctcggctaattttgtttttgtacttttagtagagacggtttcaccgtgttagtcaggatggtcttgaactcctgacctcatgatccgcctaccttggcctcccaaagtgctgggattacaggcatgagccaccgcgcctagcccagttgtgtgattttgtagatatcatctcttctaggtggaaagagatgtgcctctgcttcatgcaatttttcatctatcatttggcagggggcagaatttgtttccttctgtttcaaggttggagtttaagaactgtataagttcaggtgcaaatgtgctatataaattcaagtttaggattagtgtggtaaacttgctaagaacttctttttcccatccgtaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggtactgcattcgggggacagaggggacccggccttgttcaaagctgagaggctcgagagacagtagctgttcacataacagcatagcttcagttcatgggcaaattagtgccctcctctatgagaaaccatatctgactctccagcatgagggccttgcccgacctgaggtggcttattccatggcctaaattactagggagaggaccttaactggagcctcctatgaccttaaagaatttgtcttcagccttaaagaattcttccagatctttttcatgattactgtgaaatataaattcacatcaagctgattaaatcgttgatttgtatgaatcatctcaagcgaggggctttggtgaggactaagagtttaggtgttctgtgctgttgcactaagataatattatgcacacctgagaactggtagttgatgtattatagttctctttttctccctttcccaacaaaatatttaagaggtccaaaccagctttgcaagtaaattctaaaaatgtgtaagtctaaatgtaacacatttccctgctagaagatacaaatgggggaagaaaatttgagatctgaatttctctgttaatttgtgaaaacaaattactgcctgttgaatgtatggttaggtcaggcaccgtggctcacatctggaatctcagcactttctgagaccaaggcaggaggatcgcttgagaccccatctctacaaaaaaaagttttttaattagccagatgtggtggcatgtgcctgtaagtcctggctactctggaggctgaggtgggaggatcattttagcctgggaggctgaggctacaggaagccgtcaaccactgcacactcgagcctgggcaacagagtgtctaaaaaaaaaaaaaaaaaaaaaagtaggtagtcatatttaaggcagagttaagcattgctgggttgtagtgtgaaatgataatgataactgtcgttatttttctaactttaataattatgtctcaggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaagtgagtattttttctttttaaagaatcaatgtcagaattagagtgaggaaaaagcagaggcaactgaaatgacactggaaatttttacttaaaatacactggatctatttattgcattagtcttttattttacctctaatcatttgtgtaattgcctaattccatttgtaagtgtatgatgtgaatagtgggtgggggatttcatggatgcttatcgctaagtattccttttgcaaaatatcttcttggggcctgtcaaggtggctcacacctatcatcccagcactttgggaggccgaggcgggtgtgtcacttgatgtcaggagttcaagaccagcctggtcaacatggtgataccccatctctactaaaaatatacaaattagctgggtgtggtggcacgcacctatagtcccagctacttgggaggctgaggcaggagaattacctgaacctgggagatggaggttgcagtgagccacgattgcatcactacactccagcctgggcgacagaacaagactctggaaaaaaaaaaaaatcttcttggccttagaaattaaaatcatgaaaggagatcatctgctggtcccagaatcacttaaggaatattatacaaatttgggtccccttgctcctctctatacttcctggggacaagatcacaggctctgattttttttcctgggtgctgaggaaagtctgatccagccttcttggcactggccacaaactatcagcatgcccatgttacagggagggaattgaaaacccagagaggtgggtgataagagcaggttttacttgcagggtagtttattatttattcctaactttttattttaagagttttcaaatctcagatcgaatgaatagaacaataagcacccatgtgcccttcacctagattcacccatttttaatattttgccatatctgcttcccatttccctggctcttgcatgtcctctgtttctctctttccatggaagactctctggggtcaggcatgggtgatggaagggatgaaaaacaggcccacctaaccctgcttgcagatctgactcctgtgagcttttgatgtgttttcattgttccttgtgcacttcctgactttctgacacaagatgtttcatgttcaacctgtagtttcccctccccagggccagaatgaactgtttctccaagcatgcctggtttctttgaatgaagaatggtatttagaaaccaagatctagaactaggtgtgttcactgccagatttgtcatggcctccaggccttctaagcagacagacctagattctcatttttttttaatgctgcatattattccattatgcagatagatataacagttgacttcagcagttctccattgatggacatttaagttgtttccagttgtttgttattattttttaaattctgcagcaaataacctcttgtacatatgtcattttgcaaatgtgggcatatttctgaagttagcacttcttgccttgattatcctaatagcctcctaacctgtttctttttccttattttcattcatctgtaattgctgtgctggcttaaacgcttttaaaaagtatttgatgacattttaattttttccctacacagctgaggggcgtagagtaactccttcactcctgggattcagtaccattccctcagctggcatacgaagctctcctagttacttgttaggtacttaagttcccagaaggacatgggaggattaagacactgttaaattcatgggagtgttctcaaatataatttaaactaaaaatagaagcaatttagtaatatttcccctgttttgcagagatattgcttaggctaattctaacatttgtttgccattttagagttggtatgttacttatgcttatgtctggaagtttggtttctgacatgtttccttcagttaccaatgatgaagattcagagtagatggttacttatagaaagtgacatgatgtgatttttacagagtctccaaaaagcctagggaaatgaaaggaaagaaaagcaaaaagatttctctgaaatatacagcagcaagactacatgaaaaaggagttcttctggaaattgaggacctgcaagtgaatcagtgagtctttgctttttgttttataagttgatttttatttctacatttatcacatctttgcctttttgtcttcatttctcttttctggatggttacttttagtattttttatgtatttatatatttttatgtgtagaattaggcctcatactcagagttaatttgtcataaaagagtttttcttttccttgtttgtagaacatttgtctcaggtcatgttcacttatttgggtctgatcttaatttttcctcattaaagcaggaagccattccttggatttcttctgtttctgaaccaagaataaattaagagtaacaataagaggagtttgctttattccacttatagctaggaaccaggcacttatcttcatttgcttttctgggaagtatcagcttgctttgcacgtggttcatggacctgacatgtcatcctcccacaggtcctgggcccagcgtcattagcaagcatttattgagcatctgctcagtcagccctgtgacctcaggctactgatctttctcttcttttgtctgtttagggggggaaaaaaaacaacttttaaaaaaagaaccttttacatttttctaattctaaaataatatgtattcgttattaaactttgaaaatacagtaaagcataaaaaagaaaacacctgtaattccacaagccagagataaccactgaaatcgttttaatgtatttttttctattcacataaagattatacacgactcacccacttatgtatttaactactttatatataaatacatatatatatatttttttcttcttcttctttttcttcttcttttttttttttcacggagtctctctgtcacccaagagtacagtggcgcgatctcagctcactgcagccttggcctcccaggttcaagcaattctcccacctcagcctcccaattaggtgggactacaggcatgcaccaccacacccagctaagtttttgtatttttagtagagatggggtttcaccatgttggccaggctaatctcaaactcctgacctcatgtgattcacccacctcagcctcctttgggattacaggcctttattattatgttattattattattattattattatttattattataggtcattatcttccactactgttcaagtgcctacctctatttgcctttctgtcttctttttaatttgctcctatgggcttagaaactaaatagccaactaaatctggtaaaattatttatcacttaagataaatatgtttaaggaataacccgtgaggcgttccagttgaataagatgcatgtgtgtttcagtgcatgggtttttgtgacttctttaactctcagtgacctttttgcatctttcatggttctcagccctgttcgtaataggtaaggcagctccatagttgagttctggaaatctggggtgctatactttgatcatccagagaacagcataatccctttttttttttttttttttttttttttttgagacggagtctcgccctatcaccagactggactgcagtggtgatagggtatggtactcagctcactacaacctctgcctcccgggttcaatcaattctcctgcctcagccttctgagtagctgggactgcaggtgcatgccactatgcccagctaatttttgtatttttaatagagatagggtttcaccatgttggccaggatggcctcgatctgacctcgtgatccgcccgcctcggtctcccaaagtgctgggattacagatgtgagccactgtgcccggctgcataataccttttccttttggccccccaaaatttcctggcacgtaacatattgtgaatgagtgataacttaaatacgttcaataataacaatttatctttggtaatactgagtgtgcttatatacacagcacctactctttctagaaaacctcctcccttggtgctttttatacggacccccttttgtttatttacttctcccagtcctcaaacatgcatgtattcaaacacatacaccctctccttccccagtgtcctccgttttctccttttatcattaggtttcctttttggccatgtggaagtgaagagaattcctatgatgtcatcccttcacacgccacttgtggaactcctcagtggttcctctttgataggatgtaagtgctgcaggcagagagaggttgccattcctctctccaagtcccagagcagatggtacttgggcttggcaatctgtgctgcttcagctgcagaagtacttttgacctgtattttctgcagcccttttcactcttgaagacttggttcatctcctttccccatttcacagaatatttttatatgagaatataaaaaccatacccttacgatgttatctttcaacaggtttaaaaatgttatatttgaaatcagtccaacagaagaagttggagacttcgaagtgaaagccaaattcatgggagttcaaatggagacttttatgttacattatcaggtgggtatgcaccagcaggaaccaaaaactttctggatgagattcttgtccaagtaggagaaatagataaagaggagactcatctgaggaaagctgtctacattcagcagtgagctaggctccacactgcggggaaagaagctgagggtttctgcatgtctggtttggtgtgtgcgctctggagagcttttgcagatgtcactcttcagaaaacatttagctgaagcttccacttagtgctgccactaaatcgagctgacaccttggacttgaacaaaatgcagaagtacacatgctgacactgcagaattctaagcccactcagtagcttgaaatctttttgtcattttgatttgatataggtacttaaaagttagatacattctgacaaggtgtgtgtaaagtttatgtttgtaaactgaattctatcttaaatccaaaaagaactcgggagtaattcatttttgtagcataaagatccctaagttttattttgaaatatctgatttttacacgttaaaaaataacagggcatcgagaggattcctaggtgacatccagactcctttagctttgtgtgtgtggcaccggttagtctgcttctctctcctttcttgcactgcttcacacagccatgccctgccagcccgggcaggtgccttcctgtcaatgtacatttgggcttctgctcatgctgccctccctcccctcccctgcctcccaaccccgccccttttgttcctccatggagtacttccatgggtgtgcctcccccagccaagccataataggtggtttccccttcgcttctgtagcccttgcagacatcctctgtttacagtaggtgttgacttacttcccctctccccgctaaagccataaactccttaaggacaggtagcatttcttagtcatcttcgtttccttctcaatgaccagtagaccattaaaacatgttagctaaacaaatgtgaaatgattttgtgatgcacacagctaactaaagtacttccaccaaaaaaaaaaaagaataggaacctcttattccctcagtttcaccaaattatttttttaatttaaaattttttatttacgtggagttatcagaacatatttttatttttaaattttttaaccaaatcatgttaggccaaccagtctgcctgtggtaatttattaatttatgtacaaattcattaaatgtggggtaactgccaggtgtggggtattctgttaggcacaggtcccagcagccctcatggagctgctaggatttttccaacagataattgaacttgtggggtcctttctttttttggaggtgggggcagagtctcgccctgtctcccagactggagtgtagtggcgtgttctccattcactgcaacctccacctcgtgggttcaagtgattctcctgcctcagcctcctgagtggctgggattacaggcgcacaccatcacgcccggctaatttttttttttttttgagaccgtttggctcttattgcccaagctgcagtgcaatggcacaatctcggctcactgcaacctccgcctcctgggttcaagtgattctcctgcctcagcctcctgagtagctgagaatataggcgtgcaccaccacgccccaacgcccagctaatttttgtatttttagtagaaacagggtttcgccatgttggccaggctggtctctaactcgtgacttcgtgatccgcctgcctcggcctcccaaagtgctgggatgacaggcgtgagccaccacacccggccttgtggggtcctttcaagacttttgacccttgctttctcatcaccactcttctaaagttcagaagtgagaccactcagatttcttaaacttgttcaggacaatggtgaaagtagcaggaaaagcgggagcattgcagtcagatctggatttatcgcctccatctctgtcctgttgtgcaagtcatttaacatctctgagtctcagtagctcatctttaaagttagaataatcgcacctcataaaaatttttgtgaggactttaaaagatactatgtaatgtgcttacacaatgccaagcacatggcagacacctaataaaacatcaagttctctcttttccccttgccttcgggatagaaagtgttctcatatggaatagaaattaagaatctatcagatagtattaaggtgacattactagccttatctcatttccccgtgcttagtatatttcatcataggtttaaatgcttcaccttttccagatttattaaaactagtgacccataacatggatgaaatgggaaaatgtcattgtgacttctgaaataaaaagcttagatgtgtgtggcaattgaacatgtttctttttctttccatgtatgatgaattttgatatgaacaacatgacttcctaactccaaatcaaccagaagcctcccttggccaatgtgccctattgctccagctctcaggctggttgtgcagtgggtagttgcctagcgtggaacttttctttcgccccagttcacatctggcacacaaggcaggcctcagtccatctggatccctccctacattgtgtcctttttccttgttccacagacttgattaactgtcaaaatgttttgttttgttttgttaataggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtcatttgttcatgtttgtgtttttctcagtttcattgttaacagttcctgctaaacaccttgactagagtgagatgtatcagttaaaatcacaacagcagacaaccccttccttttaaaggagaaaacgtaagtccaccatcagatcattgaatgtctcaaagtgacttttaatgtgtgaacgtgtgactttagcctttttaatgaatatgcttaagttatcttcaccataaaaagaagggtgttgcgggaagcaaacattatatgtcacttaattctgattgacgaacggtggaaagtttaaaattgcaacagcatttaaccttttttgaccagcatactgttgttgagcacatagactgtgccccttagggggttcctatgtcacttgcaagtcaccagaaaagactaggggatgttgaatgtggaaaaagtaaatcacagcagtaaaaaaagaagaaaaggggccggcgtagtggctcacacctgtaatcccgacactttaggaggccgaggcgggccggatcacctgagatcaggagttttaagaccagcctggccaacatgacgaaacccctactaaaaatacaaaaattagctgggtgtggtggcacacgcctgtaatcccagctactcaggaggctgaggtaggagaatcacttgaagctggaggcggaggttgcagtgagccaagatcacaccactgctgtccagcctgggagacagagcgagactccatctcaaaaagaaaagaaaaggcttccttgtcagagggcagccttacttaaaaatacaaacgtacataagcatcctgttgtgttggtaaactgtggccagactatattggaaaattagtgacaggttgaaataaggggggaaacggaataattctaaaatagggaaaatgaaaaattggaggtgatggtttgtacgagtggttggagatgaccgcatgctcctctgaggaagagtgaggggaagagcatggctctcctggtgggactctggaaggtacccttctgagccccaggtttctcgttctgaaatggaaaggatgctgtctggtagctttgttattgaaacctgaaatattttaataatatgctctatattgtcctgcaaagaaatcaagggagttagaaaagtgcttatcaggactgggtgcagtggctcatgcctgtaatcccagcactttgggaggccaaggcgggtggatcacaaggtctggagatcgagaccatcctggccaacatggtgaaaccctgtctctactaaaaactacaaaaaaaattagctgggcgtggtggcgcatgcctgtagtcccagctactcaggagaatgaggcaggagaatcgcttgaacctgggagacagaggctgcagtgagccgagatcatgccactgcactccagcctgggggacagagcgagactctgtctcaaaaaaaaaaaaaaaaaaaaaaagaaaagtgcttatcggccgggcacggtggctcacacctgtaatcccagcactttgggaggccgaggcagggagatcacgaggtcaagagatcgagaccatcctgggtaacacggtgaaaccccatctctactaaaaatgcaaaaaatcagctgggcttggtaatgggtgcctgtagtcgcagctactcaggaggctgaggcagaagaatggcatgaacccgggaggtggagcttgcagtaagctgagatcgtgccactgcactccaacctgggcaacagagcgagactccatctcaaaaaaaaaagcttatcaaggtatagcaacattaaataagaaaaataagagggaaaatcagagtaggggctggacgtggtggctcacacctgtaatcccagcgctttgggaagccaaggtgggtggatcgcttgagatcagaagttggagacaagcctggccaacatgttgaaaccctgtttctaccaaagatacaaaaattagcccgcgtggtggtgcgcacctgtagtcccaactacttaagaggctgaggca

SEQ ID NO: 15317 - DNA, 37004 bp, Human
gtaattctgtagaaagtggaactgttgttgcgttgtgtgttttgagtttggataaattttttatctagagaggtgaaactggtttatgcttccattaagagcctatgggagctgtggggttttttataatatcatcctccaaatggctagggggaagggagagctctctgaatttaggctagagctggcccactgcaggctgggcaggcccaggcctggacttggagcccggagaactcaggtatccctctggggccccccacagacaccgagacaaagttcagactcttcagtgtgacacacaggcctcggtgacccctgctgccctctgcagcctcctctgctcttgctccctgtgtttcatactggacccctggtaattcactggatatggttatgtttgcctgccctttgcctatgcgtcccctccccctggaatgtcttttcttcttaatctccgtcctccctgtccttcaaggcctgggtcacaagtccctttctccacgaagccttcttataatctctccagcctgaattgtcttctctgtgttcctttagtcttttatctgaaccatatccccccttaggtgggagcaagttgtgggtgggagagggcaaacttcagcctcattagatagaggctggacttccggaagagctgggaagggggaccatagtttctggggaggggtggagaactcacatttacctagctgctggccaggctattttcatacccacagaccgatttaatcctcaactactgtactcatttagtagatgagaagaatgagacattgaaaacatgcacagtggaggtgggaatgaaagccagctctccaactctccagtcctctttcctgtgactgcatcaggctgcagggtgaaggggaggtctgggatacaaagagaacttagaggtggagcagttggattctgtgcagtgctaggagggaggagaggggttggagtaggtgggaagtaggcctccttcagtttggatagcacttcccttaacccaatgactctagtgggagggtggagggatggggatgggaagggagcctgggagtgaggaggaaaggcaaactctgtcttcccccaggggagtcaatgaatagtacctaaaatggaaaccaaacaaaacaacttcaggaagtaacaagggcttgcttagagacatgacggtaaaccctgaaccatcagctaaaagaggtagatagcagtggttgcccctggggagaggtaaatgtgatggagagggaacaactgtgtacaaacatgtgactttacgttttgatcaaaataagacttttaaaaaacaaacactttttaaaaagaaggaaagaaaagtaggaggggctatcccaggagctgagcgttctgccccgcccctctgagtcctgccggcttcacctgcccacgggagccgggtcccctgccctgctgcggcgcatgctgcctggtgggggttctgcccaggcccactacggcctgagttcaaatcccggcagcaccatttacaagctgtgtgcaagttgcttcaccactctgcgctgttcccccctctgtaaaatgggttggccgttgtaccctctctgaaaaggatgtgctgatgcctcggtgaaaagctttcaaaaattgttagttcatgttatttttttgctggaggtgttaggtgcggagaggcgagggggctcgcgtgcgtcgcaggaggctcagctgggctcgccgccgctcgtgcctgcgcccatttagtgtgcacacagctagcgcccgccgtatgtcaggcctggtgctgggtctccgccccggagctggggtgcaggggctgccgcgccctgtcgggtcgatccgggtgggaacccagatgtctccaagatccgagacagatccccgccccgcgccctccctggggggcggtccccggcttgggcgggatgggcgggcggctacttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcgggtgagtgcccggggggccccggggctcccggagtaactctctattgtaagttcttgcagatacagcgctaggaaaaggggagtaattcaggtctagaatggaaaaactgttttgttgctttgtaagtatctcttgctgcttccggggctctggctcgcagacgagggtgggagcctcggggccctggctgttccttcccaggaagctaacctcaccttggccggatttcttttcccctgtcctcctctaacatcttacctcctgtctcctgaattctccttttccttctctgattttttctcccctctgcctcacttctctccttctctcttctgatgtcttcttccatttacgattccttgttctcatttgatctctctccttctccaatatttccttctttcttgtatgacctcgcctgtctgcttatggtcattattatcatttcttctctcctttctgctgtcttccctgccctgtctggtttcgtgtttttccacccttctgcctgagttctccccaccttgtttctctgacttctctcctctgatttttactcccaccagatctcttctccggccagaggtgacctgcacctgctgatttttgtcctcgactccagcctaaccctcctgcaccctccccggccccagccccagtgcatgtgtaatagcctccccatttttaaccacttcatctccaacagcctcctgcagaccctggtgcatcctcttctcctcttccaagaaatgaaatttgggggtggtgtgttgtggggcaggagggaggaggcagacagcgcaggaggccacttggactcagccatttggacccttcttgggggtatgatggggatgggtacagagaggagagggggctcctgtggatcacaggaggctcaggtgggctcacctcgatttgcgagtgcacccacttagcgtgcacagagctagcgcctgctgtctgccaggccccgtgctggaaatctttccacttccaaagagcaaaagcaaacaggctgtgtgaccttcggtcagtcccctcccctctttgagcctcagtttctctatctgcagattggggttggataatgagctctcagagggccctttggtttcaagagccattgaagatgctggaaggaagcaagctgaggccctggggacccttagatttactattgccatctgaggggtctacccatcatcccagagcttgtgatcttggagcctggggcaacccctgctacactgtttcctagctggaggtccctggcagagtcccttcatctctctgtgcctcggttatcacatccaattggcaataagaaaagaagggaggctgggcgcggtggctcacgcctgtaatcccaacactttgggaggccaaggcaggtggatcacctgaggtcaggagttccagaccagcctgaccaacatggcgaaaccctgtctgtactaaaaatacaaaattagccaggcatagtagcgcatgcctgtaatcccagctactcaggaggctgaggcaggagaatcgcttgaacccaggaggcagaggttacagtgagtcgagattgcaccattgcactccagactggacaacagtgcgagactctgtctcaaaaaaaaaaaaaaaaaaagaaaaaaagaaagaaagaaaagaaaggagcagggaggtagagccctctgtaccctccatcaccagaaaaagctgaagaggggctgagtaggagggacagatgctggccagggcacaggttttgaagcataaaactcttgccctgtttgctgactcgttgagacagggtgcccagaaggggatagacttccctggggcgtggggagagcaggaggctcaagtgagatgctcttggtgctagaaaccgccctccctcatgcctggggtctctccctgccaggaccctgccccgcttaggctctgccctgtctcatcccagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggtgaggctggccctgcccagcccctgccccagcccccattctgaacagtgcagacctttggggcatggtccccagggagggaactgattattgagcacctagtatgtgctgggcccttgactggtggttcatgccctgagacgctagagccagcctggccaagttcacacccccactctgcccctaacccatgttctgtcctttggcaagtcacttagtgtccctgtggagtggacatgatgatagctctgcactacctcacaggaatgttgtgagcgttaaacaccttactgtgacactcagaactgtgggtgaattggagaccctggacctctccacaacttccctggcccagctccaggcactccccagtttgcccttgagtcaggagcccggagtccctgccacacctctgccgtgggatgctataagttctgcccccttgctgagcctcagtttcctaatctgtgaattgatctgatgctcccagtcctgagtttacgctcaggagggctgagaatgaacataagggaatgtgacagagctgggaggacgcttagagaaaaatgaggtccatcgtcctgttatacagatggattaactgaggctcacagaaggcaagggctttctcagcttctacagctaggtcagggcagtgctggggttcctcctccacctcctcttcctcaggggtctgggatacttctggaaagccaggctcatattgctctgatgtcccgtaggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaaggtgggttgggccccaccttgcttgagcggtagggacagatgcaccagtaacagggctcactcaggcccatctatcttttggccttgtgatgcagtgggcagaccgatcagaggtcaggctttggagtcaaccaacattgtgtttaaatcctggcctctttctagccatgtgagcttggacaaatcacactgcctttctgagcctctggttccttatcttaaaatggggagaagaaaattccccataagttcatagtgttgtcttcctagccccaacagtgaggagtgggccagaggtgaaaatccagttcttcttgcaggccctggggggctttggcctagtcctgttctggtaccccttaattcttaaggccttgccaacagagggccccgtgttaagtatttaatagggcattgttagtcacatccctctttctgttcactagaatcccctttgaacttgaactcttcagagtctggatcaagacagagctcttttcccaagctcctagccaggtggggcagagcaaggccaaactgggagctccaagaggctgcaccctaatatgctggtgacttcctgcaagccacttgacctccttgagcctccctttcctctctggttacctgagagccagttgtacctgccctacagggctgggagaggatttggtgtgggggtggctgggaaatgccttgcgtggggcttggccatctggaagggctatggaaacactgtagttttacaaagctggggttttccttggtcaggatagagaaggggatcacaggctttcacagccaggtgggccttaatgtcagagtccaaatctcattttaccaggggagaaggggaactgagacacagaaagtcttaagcaattggcccagagtcacacagcgaattggtgccagacccaggactagaacccagatgttctgactcttagcattctttccactaaaccaacatacctctaatgaccagggtcctagggtagggtccaagcctgtctgtgctgctgatgtgctgtgtgaccttagagaagtcactgttcctctctggacctcaggatcatctatgtcaatggagtggtgaccttgtctgccctggtgaggcataagagattgaatgatgggaaagtgccagtgagactcagatagcaatgggcagggtgtgtcctgggaactcacagtccagggctgggcagggctgggctggattccctggagccccttgtgcccttgcactgagctcctcctgctgaggtgtccagctctgccttcttcccacagccctttctggggccttgataccttgcagaaggagaggtgagaagtttgggagccagtcccctgagctggagaaggaccaggtctttttgcaacttctggagcaagaaatggaacgaacacttgcccaggaatcacagagattgggattcaggttggaaggctaccttctgtaactgctgtgagactttgggcaagtcttgtatctttgggcgggtgttctcaatcatcctccattcatcattcattcagcaaatatttactgagcctcaataacagcagcaccagctcattgttgctacactatggcagatatggtactgggaatgtaggttatctcgtttcagcctcacaactgtcctgggaggtaagtaattcccattccattttacagatgagactggaggctcagagaggtcacataactatattcaaaccaggattgtgttcccttaactctgccaggccctgtgatgggtgctggggtgcccaagtgaagaaggtgggtccctgcccttgagagtgttctgaggagttggggagactggcaggctcacgaagagttaatccattgcctccaggtggggtgatgtgggatcccagggagtgctcagctctgagaggggttcagggatgagatagatgagtaggtgtttgctaatctatcttgtcctagtcactgtttcttagggcataacctgacagtctaacatggttacaaatatgagagttctcatatacacagaaagggtgattttccaggtcagagaatgttgcagagcaggtcataggctcccggatttttaggaataaacaaggatgataataacccttaccgtgtgttaagccttgactacaagatctcatttaattctcactgtagcctttagggtggatggtaatgctccatttcatagacgaggaagctgaggctcagaggagcaaactaacttgcctaagttcacacagctagtaaaaggtgcttgtcattgaacacttatctattactttctgtgtgtcagggactcttctgggtgctttactcatttaactcattttaccctaacaggtagggtatctgttagcaccattttataaatgaggctactaaggcacagagatgttaagcaacttttccaaggtcacacagctagtaagtgattggactagtgtgcaaacccaggtgtgaagggcctagcacagacctggttcagagtagacatttggaggctccctgatctttgatcctcgctcggatatggcctgggatctacttggatagccaggttccccggccccccgatgattttccaggatgttcttggatcacactcgaggaaagctccagctgggcccagatttggggcttctgtcctgaaaggcgctggctcctggtgtgaatgggaggcccagggctggtcttgtttaccaccttctgtaagtcctcagtctgcccccgcacttggcaggtccagcccaaggttctcgccccggcgccctcatcaattatagatcccggaggagcagggcttgttatgcaagacttgttcctgtgaaagcctcttcctctgagccaattctgtcctcggagtgtgagaaggggcagggaggggacagcaagccactagaaagggctgacatggggcttggccctcttgttctatgacccccaaatccttagatcactgccctgcaagagagttcagaatcccttgattccccgcccctcctcctcccactccgcagacccccatttttggactgaatcctggagaccccgtggggctgggttatttgaaacccattgttcaaatggaatctgggctaggcagagacctaggagcccttggacctgaggaacacaattgggaacccatagaatcactggaacctttctgtcctccctctctcctattccttagataaggagctctgagtttagagggtggaggggcccaagcctgatcaattcatttttctttgttttagaaacagtttaacttttgttttcatgtaaatcttcattgcttcttttcccccttcttctgactacaagagcaatataagcttattgtaaaatgtcaaacattacagaaatataggttccagaaaataaaagccctcccaacatgattctccccttggagatatatatcatatagtggctaatttctttctgtctctctgaacgtatataggtagacagacacatatatatgtaatcactttaatttggaaaatggcttttaaaacaatttatcctgtagaattttgttcaaataatttgatgccaatcttgctcacctaatgattagaccacagaaagcagcaatcagtgctaaagatgatagtcaaaaacaggaaaaacttcaaaaaacttctttcccctgcccttgtagatccactaatgtcttctaagagcttgctttaatttatttttgttaattaatctttccaattctaattccctagaccagtaaaattagaggagttaattaatcaggcagctcatggctgcaataattcaacatcaagagttatgttataaggccgggtgcggtggctcacacttgtaatcccaacactttgggaggccgagatgggtggatcatttgaggtcaggagttcaagacctgcctggccaacatggtgaaaccctgtctctactaaaaatacaaaaattagccgggcgtggtggcgggtgcccgtaatctcagcgactcaggaggctgaggcaggagaatcacttgaatctgggaggcagaggttgcagtgagccgagatcgtaccactgcattccagcctgggcgatggaacgagactctgtctcaaaaaaaaaagaattattttataaataaatacagagaatttttaagaagtgagatttatgacgtgaagcaacccttttcctttttaaaaaatagggtaaagattttaataacaaaaatgaaaggcatacttcaacaagtaaaatatttagaggggtaaaaattttttctttccccccatttccttgtctccgaggaatcaatagaaacagtgagtccttctagcaccttttggaaaaggtttgcacatccactctctcattatgtccaggtgaatgaagtcccctggtcaggagttcctaggctgacagttgaatgaagctgggtccctggaagggggatcttggggatagaacccagcactgccgcccagcactgggctctggacacaatgcttaatctctttgaatctcagtttccttgcctttgaagtgggaaaattattaatagttcctgcatcaggggcttgtggtcaggacttcattgcatgcacttaaagcaggtgccccagctttggcaaagctcggtaagtggcagccactgtgcttgtttcaggtaagcacagctgagcacaggtgagcgcaggttgttgcattttcttccctggcggttcttcctcacttgctctgggcaggcttggttacatcggtctcagaaccctcctgtctttctgcgcttcccctgcctttctgcgcttcccctgcattgccctgacctatgtcctttgcactctgcctggctctccaatcccaggcctcacggccatccagccttcggaccccctcagttgtgactgcagttgtgactgcagctggtcagtccctcaccccagagtcccaactcactccttcctgatgatggaaaaatttactgtcttgcttcccagttttgggcagcaaattcaggagcagaagtcacagtcttaccccttgctccacaccgaggtcagtcatagtgtggccaacccacagctcccttgaaggggccctggaagcagggtggaaagataggttgttagctctgtgagcactggccgccctgctagtcccaagggactcttgaaaggccttagctgagaccaagaagggacaccagggagtcctccagccactggcaacccaaaaacatccattacttgaaagagggctctgaataatggcttgttcctgcctcccatcctggatgactgagtgatctttgctctaagaaaacctgatattggctggcacagtggctcatgcctgtaattccagcactttgggaggccaaggcgggaggatcacatgaggccaggagttcgagaccagcctggccaacatggtgaaacttcatctctacaaaaaatacaaaaattagctgggcatggtggtgcacatctgtaatcacagctacttgggaggctaaagcacaagaatcgctggaacccaggaggtggaggctgcagtgaattgagattacaccactgcactccagcctgggcaacagagcgagaaaacctgatattgagagaagaatgtggatcttacagattcagacatgcctgggtttgaattctagctccaccaccttgggcaagtcccgtcacctgtgggccccattttgcacatcagtgcgatgcagcaatgacacctcccttgcaggcgatgcgtgaagaatgcccggcacagtgggcatcatcatttcacaaacacgtatactgctgacacaggaagacagagcaggagcccaatatacacggactccgtttgtcccttgccctcctcgagtctgtgcggctagaattagacttagcacagtgggctgaggggccctggatggggtggctgcattgctggcctgagtggaagccctctgcttccacccccatgtgtctccggagcagggagacgagcacccgattgggaggaggaaacaaggtttccagccttggcttggccacgcacttgctgagtgcccttgagtaagtcacttcacttctctgggcttcagtttaccgtgggtaaagtggggtgaagtagaaggacctttccaactctgatttgacaactctggggcatggagctggggactgctcacaggaaagcccagctgactttccttggcttgcttctgagtgagggcagttgtgactgcagcagggaagctctcctgaacgccttgctctgggatgcagtaatgattacagagggctggggagcaggagcttgtgtctccacttcagaaaggagaggcctgaggctcggaaagggcaagtgacttacccaaagccatccagcattgttgtggcggggcacctgtcccttacccatagctgctctgaagggactgctgggtgggagttgctgcggtaccgtaggggaaagcagaagggtggcatgggctggaacaatccagaaagacttcccagagagccttgaaggatgagaaagatttggattagtacctctcaaagtggcttttgcaaaatactcaagctggaggcaggatatggtgaagaaaagtggttcttgggctgggttcagtgactcactcctgtaatcccagcacccaaggatctcttgaggccaggagttcaagaccagcttaaacagcatagtgagaccccatgtctacaataaaataaaataaaataagtaagctgggcactgtggctcataactgtagtcttagccactcgagaggctgagatgggaggatcattcaagtccaggagtttgaggttacagtgagctgtgattgtaccaatgcactgcagcctgggacagagtgaaaccctgttgaaaggaaggaagagagagagagagcggaaggaaggagagagagagagaaagagagaaaggaaggaaggaaaggaaagagagagggaaagagaatgaaagaaagaaaaaaagaaaggaaagaaaaaagaaagagggaaagaaagaaaagcagttcttggttcaataagatagggaaatactgtataaaacaaaaggcaagcaggtgtattcaccataggatttgacagagcctttattatgcacatgcgcgttgtataacagtcagggagggtgagtgagaagcattccctatgcttatttgaccgtggaactctttccttgcagaatgtcttaggggactagtgtgcctttgggaaacgccggttttgaggaaggaattgttgcagtttttttgatttagaaagtggctacaggggtccttgttagtggagtatgggattcaaaggggtggcagaaagatgcagtgggcagggaatctctcacttcttagctgtgtggccttgggcaaattttattcctttcctaaacctcagtttcctactctgaaacagtctcaaacaagataatgggtatgaaagtcctgagttaactgagaatcactgtgttgctggaaagcccctggtccacaagccagaatttcctttacctcaattctgtccccttcttccatatctgcttccctgggccttctcccctgggctaatgctgtctctttggccccacagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacgtgagtcctgctttcctctttcccaggagccactgaggtgctcctggtctgaccagggacttgggtacatccacgtgaacaaatgcatagatgcaggtgggcaaaccacagggaccagcattgttcacgtacagatatgtctgtatgcaaagactcccacaaatgtagactcacaccacgggtatagtgcgtacttggactttgattgacatatagacttcctggcaccttctgttcatatgtacgtcttgtgtcctttttcacatgcttataaatatataacagtcatgggcaaacactctgggcttttgcccaccaggtgtgcacatgtgcaccatcatgaatgcccacacatgtatactcgggtatgttgtttaaggtcccacatgtgtatgtcatacatgtagttgcacatgcccatgatctatgacaatgtgtgtgggatgcccttacccaggcccaccttatagatgtgtgacgctttgtacacacttgtctcacaaatccctggagcgcagacctgcaaatggacacggcccttctaccccaaagctcatatgcttatacacctgtgatataatgtccgtgcaaacatgagcacacactgatttagtgtaagctttttattaaagcgtcatgggcacacagaggagtgtgtgaatcctgagtgtacagcttgatggattacacagagcgaacacactcacgtaacactggatcacgaagcagaacctcaccagcccctagaaggccccttttgcccctttcggtgccctcaccccaagggcaaccatcatcctgaactttctcaacagcatagatgagttttgcctgtttctgaactttatagacacggaaccttgttcttttatctctgaccttttgctcaacattacatttctgagatgcatccgtattgttgcatttagttgtaggttgttcattttccttgctgtggaagattcagttgtgtgggtgtaccatgatttatgtatcctttatgttgttgatgggcacttgaggtggcttctggtttggggctattacagacagtgctactctgaacattcttgcacaagtcttttggtggacatacgaacgtacttctgtcaggtattttcctagaaggaggattgctgggtcataaggaaataggtatattcggctttagtggctatggccaaatggttttccaaaatggttgtgccaatttatattcccttcagcaggcaaacatttttgcacacattctagatgtagttgtacctgtgaaaaaattcctgtcctcagacatgcactcccatctcctggtgtgtgcagatcacacttaattgtacgtaaataatgcacgtgtgcagactgtgccagccttcacctgggcaagtgcagaacagggtgagcctgcacaccacacgccacactccccaagccctgtcgctgggcggggcttataggaaggcggggcactgacttcctgggtctctgtcttccagaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgcctgtggggtgcgcaatggggtggccatggggacacgctgctcatgactttcttctgttcagtaggcaatttgaggtgaatttgaggaaaaaaaaaaacttccgctctaccccacctttttatttttaaaatacttttttattttaatttttgagacaggatcttattcattgttgcctgagctggagtgcaggggcgccatcacagctcactgcagccttgacctcctgggctcaagtgatcctcctgcctcagcctcccgagtagctgggaccacaggcgagtgctaccaagccaggctaacttttgaattttttgtaggaatgaggtcttgccatgtcgctcaggctggtctccaacttctggggtcaaaccatcacctgcctcaacctcccaaaatgctgggattacaagcatgagtcaccatgctggccctgcctcacttttgaggctgtttttccatcaaacctgatcactttagggaacaagggagatcagtttcttgcacaactcccagactaccctgagaggtgggactggaacccaaggctgtgctgtgagtgtgagccgcattctccagtggggagggccaggtcctctgcagagctaaggagggcagtctcttagcatccccagagggccagctttgtgctagaataaggtcagaaagagaccactgagccccaatcccctcttttctcttctgactatttctggtagtttttggcccatttagtcacatggtgggattgccagccattgtgcgttgaggacgtatcaatagaggcaagattcactaggaaaaggagaagaccatgagctctgctccatgtcacttggttcctgcttctctgggggcatccaattccagcttttggagagagcagaatggtgattattattatgggaagggacctggacaccaaccatggcttgggagggacagtgggagtgaaaataggctctgaagccacagggatggaggttcagattctggcttagccacctaatagctgtgtgagtaggtgacttcatctttctggacctcagattcctcttctgtaaaatgagagtgataatctgtgcctcctggcctggctgcgaggatgcagtgacatcttttaaaggtaggcggtagaaggtgttcagtagctatagttatcacaattagccggtaggcgaaatatctgaagcgctgtctggaggcagaggagcaggagtgttctcctggagtttctgagtcagggagacaaggtggaagggacctctgatggacagatctggacatgtgagcagatgcaggatgtgtctggaggaggtcagactccatggggagggtcacagtggatgtccttgtgatccttgcctgcctgggagctatctcaggagcctggcccctccctcacagccacccttcctctccatctctctatctcctacaggtgctgggccccaagccggctctgcctgcaggtaccgaggacaccgccaaggaggatgcggccaaccgcaagctggccaagctctacaaggtgagcaccagatgcactgtctgcctgggcatggggtcaggacagggaggtggaagacttggtcttccccactccactgctatgggaccttgagcaaagcacccctttggaggggggcctcagctttctcacgtctccagtggatgctcgtgtacttcctttgctttcctgcactaagagcatgcgatcaactccgtacatatctgtgtcacgctcatacatgaggtctctctgagtctcagtgtcctagtctgtaaagtgggaagaagagcagaatggtcgactttgtaggatttctgggagtccacagataaaatggatgtgaaaacagcttagaaaatacttggggaaatactacagaaatggtgtgtatgtggggaggttgggggtgtgggttatagttaatgactttatttatgatttctttcttgtgattttcacaactgaattcaggcttagcttcagctagggaactctcttggctgagctctgggagaaagctcaatcacacttatgttgtgccccaagtattttcagtaaaacaacaaaaaggggatgtcgattttcaccactgccaaagaaaaactactacattatcgattttttttctgattatgaagtaatacatgtttattgtaagaaaaaaaagtattcaaaatataaaaagaaaataaaagtccatgcaatttcactggtttaaaaaaccagtattacttttaaaatatgttttaattacaaaaatgacaatacccagttaaaaaatcagcctctcctcctcatgagagaacacatctttgtccagccacagctttctgtgcctagttacttttccatttccatcttattattttattttgagatagggtcttgctctgtcacccaggctgcagtacaatggcacaatcacagctcactgcaacctctgcctaccgggctcaagcgatctcttgcctcagcctcctaagtggctgggactacagatgtatgccaccacgcccagctaacttttgtattttttgtagagacgaggttttgccatgttgcccaggctggtctcaaactcctgggctcatgtgatctgcccacctcagcctcccaaagtgctgggattacagacctgagccaacgctcccggccatttctattttgtgtaactggatccaaactattcatgctgttgtgtggtcttttttccactcaacatggtcgggaatatctttctataataaatctcaacacgaccctttataacagctgtatagtattttattttatgaatgtaagaatttaagcaaatcctgattgatggacattaggatgttccaccttttccagttgcagacagtccctcttggtgcacttgtgctaagtacagcatagcactagggcaagttcctagacaaggaactgctggtcacaggccgaagaatgagtcagtagttgaaaatactggttctgggccaggcatggtggctcacccctgtaatcccagcattttgagaggccgaggtaggcggatcacctgaggtcaggagttcgagaccagcctggctaacatggtgaaacactgtctctactaaaaatacaaaatattagccaggcgtggtggcgggtgcctctaatcctagctctcctcctaagggaggagaatcacttgaacccgggaggcggaggttgcagtgagctgagatagtgccattgcactccagcctgggcgacaacagtgagactccgtctcaaaaataataataataaataaaataaaaaaagaaaatactggttttggagtcaggagtcagactacctgtgtttgaattccaggtcagctatttctagctgtgcaagttccttaaccactctgtgccttggtttccttgtgaatgagacagggatagtaacagaactatcatatgcaaggattaaaggggttctataattatacaagttatagaaattgcttagaacagtgactggcacagagtagtaagtactcaattcatgtagaataattattatttaaaggactgctacctcacagtcaactgtactctggaacagctcccaaattactgtcatcagggatcttaaatgcctgtttacccagagccttgccaactggatattgttaaacttttgaattttgactcttaagatagaacttttttttgagcttggttgaactttttattttagaataatttttaagtttacagaaaaattgtaaagatagtacaaagagttcctatataccattcactcagcttctccttagcatcttagcataaccaggtacatttgtcaaaactaagaaattaacattgcttcagtaccattaactaaactatagactttagccagatttccccagttttttattctaggttccaatccaggataccagattgcatttagctctttttacttttctttttcttttcttctcttttatttacttatttatttttgagacagagtctggctctgttacccaggctggagtgtagtgacgcaatcatagctcactatagccccgacatcctgggctcaagtgatcctcccacttcagcctcccaagtagctggggccacaagcaagcgccaccacaccttgctactttttgtattttttgtagagatgggatcttgccatgttgcccaggctggtcttgaactcctgggctcaagccatccacccacctgggcctcccagagcgctgggattaaaggtgtgcgacactgtaaccggcctcttctcttttttttgaatagtaaagttgaatacattttcagcaaactatgcagttcccctgtgcacccaattccccaaattttatcccgccctcccttcccatgtgcagtttgtgttacccctgcgtgtaggtcagcagatgtggttctgacaaagcagaaaacgaaaaagaacctctaaatgtgtgcgagaggaagcccaggtgttactctacagggccatttgggacagggggtggggcaagatggtggaagtctcagggctgggcggccacagacactcatgtgctggttccttctgcttcgtcccctcaggtctccaatggtgcagggaccatgtccgtctccctcgtggctgatgagaaccccttcgcccagggggccctgaagtcagaggactgcttcatcctggaccacggcaaagatgggaaaatctttgtctggaaaggtactggagacagggaaagggtcccaactggcctgtaggatcttggatgggatgttctgcagctcccaggaactcagctcccggggagtgtggagtgtgcctggtgcaatggaaatcagaagtcttgggctgaggccttggttttgcatttgacatactgtgtgatcttgggcactttacttaccctttctgggcctcagattcctgatctgggctaaaatgggtgtttcccaagtgcattataacgtcagttctctgagaggctaattggcatcctgtagaaattatgtagaaaacatctaactgtatggtcagataaattcatgggcaacagtggattttaaaatgttcgagtttgtttactgtaggacttttaacttgttcatttacaggggggcttttcatgaagatgatctggtttgggaaatgctaagctagaagttcataaactctttcggtactatcttgtgggaattctcttggaaaccattggcccagatgtttcccagaggccctgagatgttctgagaggacccatcaatatcctcccctgattctctaaggctcatcttggggaagaggacagaggagagggaggcagtaggaggacagagagaaagggagacggtggggagaaagagagagagagagacactattatgattattactctctaggccccctgggccctgggccagctgatctggaccttggccttggcagtgagaaggctgggactgaggcccagcactggctggccaggagctccttggcacgggaatgccctcagggtggcagcttctcactcactgagtaacctaggtcaagtaatttaatctctctaagaccctagcttccttatagatactcagaaaaagataacaactttttttattacttaagactattctgtgaattaaataatctatgcatagttctaagcacaaaatacatgctcactaaatggaccacagtagtgttgtgattggtgtcactggccagccccaggctggacaccaggagctctagtgagtggtcggctctgggggtctctggccttggctgtccacagtctaagaagagtagggagggaagtttggcagctccttctcctggactgttaaaggtcaggatgcagcaggatcccgggcctctaaccctccatcacttcctctggctgccaacaggcaagcaggcaaacacggaggagaggaaggctgccctcaaaacagcctctgacttcatcaccaagatggactaccccaagcagactcaggtgagtcttggaggccaggtaggatgggaaggggtgggtcctgtttggaggggatgggctggagtagggcgggtgtcccaccctcagtgtggatggggtatctgaggctcccctggggacccctgctgggcagcccagccacatcctgctcctctgcctcccctccccaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacaggtacgtttagggcgtggggtgggtgtgtccaggcccctccctcactttccccatgcactgcctcttgcttccccaaggaggtttctctctgaggtttgcacaactttggtagctgagattctttggtgttacttagtttttacagccaatgcaccctgtgtatcaggccctgagccaagtgtcttggccccaccttgccccgaggagtgcctggtctgggaggggagttgaccatagccacagacctgtgtgatcagtggaagatgggagggagcacaggggattgtgcagacacaggaagcagtgggggtggttggtcagggcagcctgcacagagatgggaacctttgggttgggtctcagaggaggagtagagctttgctgccggagaggaagagcggagagtgatgggcattccaggagggactcgctatgttcggaaaggagggagctatcccagggggctagtgctgatggcatccccagggaggggccttgaatgccaatttcaagggtgtagacttgatcctctaaccagtgggtgctagtgaggggtttttctttttattaaatcagacatgcaacaggctcagatttatgctttatctttttttttttttttaatagagacagggtctcgctatgttgcccgggctaatttcaaactcctgggctcaagcaatcctcctgcctcggccccccaaagtgttggaattacaggcatgagccactgcgcccggccacctgctttagaaactcactgtgaaaatgggttggaatatgactccaggatatcattagaagaaaaaaatcagttaaaaaataaataaaagaaaaataaaaagaaaactaagaaaatggattggaggcaggaaaatgaaggtagagagcttataaggagcttgttctaatactgtaggggaaagatgatgaccttgagactaagaaggtcacagtggagaaggggaagaggggtgtggggttcagaggtgtttaggaggtagaatccgcctcaggcaaacttgactccgttcctaatgataggaataacaaagtgttcatttttatatattattgtttttggtttggtgctagcattcatttgttgcttcagtggctagggagaatgcaatgaaaatatttcgggtggggcggtgtggtaagacccctggcagcctgactgtgagactttgggcaagttacataacctctttgagcttcactttctcacttgtaaagtggggtttcatcccactccatcaccttcaagaatgttcaaaatccagagattctaggattctgtttcccaggacttggacgactccgtgtctccatagctccaccaggtggcgctgccgggcctcgtgaccacttggaaaaagcagtgtcaccagaacgctgcggagacctgccagcaggggtcacactgaggttgcctcgtggtgtccctgcctctgcaggtgacctatgaaattcctggcaggcccagcacagtggctcacgcctgtaatcccagcactttgggtggccgaggcgggtggatcacctgaggtcaggagttcgagaccagcctggccaacatggtgaaaccccgtctctactaaaaatacaaaacttagctggccatggtggcaggcacctgtaatcccagctactcgggaggctgagacagaaaaattgattgaacccgggaggcagatgttgcagtgagccgagattgcgtcattgcattctagcctgggcaacaagagtgaaacctcgtctcaaaaaacaaaaaaaaaaaaaagaaaaaaagaaagaatccaggcagctcagtaacaatagaggtaatggtgatattagtaagataataataataattatgacaataagagcagctgccacctacagagcagtccctttgtgccgggccctgtgctagactttcacgagtaatctcgtttgagcctcacagtactttgaggtaggtactatgattatccccatttttcagatgggaaaactgaggctaagagtggttaagccagttgtctgaggtctcatggcccggaaggggatgaggggcctgatttggggtctgtgtctggctcctcccctcactgtactgcattcctttggagctgccttgacgatcctcagcgaaggacagacgggctggggcagggcatggtatgaggagcccaggcaggaaccctgacccagagtcccagccctgccttctagtggctctgtgagttgggcaaaccatttaactccagtccgagcccaagtgattaaaagttcatcccatggcctaaccacaacctaccacactgcggtttcctggcttgcctgagctggggggtgggggtgctgcacagcatctgactccagctttgctcctgcagatctggagaatcgaaggttccaacaaggtgcccgtggaccctgccacatatggacagttctatggaggcgacagctacatcattctgtacaactaccgccatggtggccgccaggggcagataatctataactggtgaggttctggggccattggtgtgtgtcgtgggggtactggctgggccctgagcagggctgaagacaaactgagggtgtgagggcctgaggtgggaccaccactccctgctgggagaggcttttgtccacagggcaacaccatttgcttatttctccaaacaactttgaaactcttcttaccaaatgattatacatctattgtaggatatagtgaatgtggagaaacaaacagaacatctcccacaaatccatgacaagtactaggcacactagggtttatcctcccacacatatttttcaagccaaaatttttttaaatttatatttgtttatttatttatttatttattttgagacagagtttttctcttgttgcctaggctggagtgcagtggtgcggtctcactcactgcaacctctgcctcccaagttcaagcaattctcctgcctcagcctctctagtagctgggattacaggcacccaccaccatgcctggctaattttttgtatttttagtaaagacggggtttcactatgttgaccaggctggtctcgaactcctgacctcagatgatccatctgcctcagcctcccaaagtgctggggttacaggagtgagccaccacacccagccccaaaattattttaaaacagagaatacatttacatggttcaaaaatcaaaacagaatataaaggtatttattgagaaatcttattcccacccctgtccctctctaccccattctccagaccccaccccttcttgggtaactgctttactctcttgcatatccttccagtaactcttcgtgaaaaaaaatacatatgcaaataatttatagcctggtccctcccttccttacacaaaaggtagcatactttgtatattgccctgcaccttgcttttctgactccattcttcctagagatcaataatgtcagtacatagagacagagagctttctcattcttttttacagttgcataatagtcctttgggtggctgtactatagtttatttaacaaattccttgatgatgcatacttgggttgattccagtctttctctattacaaacattgctgtgattagtaaccttaaacaaacatcactttgaacatgcagagacatgcctctagagtaagttcccagaagtcagattgctgggtcaaagagtaactgcacttgtcattttggtagatagcccccaatttccctcgatagtgttcgtagcattttacattcccaccaagcaacctgtgagagtccctggttccctatagtcacactcgtggattgtgtggtcaaacttttgggcgtttgccaatcttatggtttataaaatggtgtctcagtgtatttttaacttgtatttctcttactatacagtctaaaactttttgtctgattattgactgttggattttttttttttttttgagacagggtcttgctctgttggccaggctgtagtgcagtggtacgatctctgctcaccacaacctctgccccccggggctcaagcaattatcgtgcctcagcctcctgagtagctgggactacttgccactactcaccaccacgcccggctactttttatactttagtatggatggggctttgccatgttgcccaggctggtctcgaactcctctaagcgatctgcctgccccagcctcccaaagtgttgggattataggcatgagccaccacgccaagctggattccttctttttttaaacttattttgaaataatattagacacttgctgaaaagttgcaaaaatagtacagacagttctcatatatccattacccaatggaatattcacctatgttcacatcttacataacccttacataaccatagcacaattaacaaagccaggaagtgaacattgacacaatactacttactaatctataggctttacctaaatttcctcagttttcccattaccgtttttttttttttttttttttttagacagagtcttgctctgtcgccaggctggagtgcagtggcatgatctcggctcactgcaacctctgcctcccaggttcaagcaattctcctgcctcagcctcctgagtatctgggactacaggtgtgcgccaacacacccaactaatttttgtatttttagtagagacggagttcaccatgttgggcaggctggtttcgaactcctgacctcaactgatctgcctgccttggcctcccaaagtgctgggatgacaggcatgagccatcgtgcccggcccccactactgttcttttcctgatctaggatctaacccaggatcccacatggcatttactcatcatgtctccaaagtctctgaatctatggcagttgcccggtctttcctttttttcatgcccttaacacttttaaagggtactagtcagttattttgtagaatgtctctcaatttgacaaccccagacatttaaaaacagcttaattttttttttgactagataacacattcacctggtacaaaatgtgtgagaagactgttttaaaaattagctgcatcagcgcattaataggtcagattttgtttgcttatacgacgacatatgttggttatggaaaacttagacaatatgcaaagaggtgggatagaaaggcaaaatccccctaaatcttccctctaagagcaatcaccatggacctttttggtgaacatctgtgcagacctctctgcacgtgttcatgggaggcttaatcactgacatcttttcccacaaataggctctcgtaacacttgctattctgcgacctgcttttccgcccagagaaatgtcctggccacttttctgcatctcagatttgagtctcagagcatcttctctgtggctgttcagcatgggatgacccagccagtctcctgtgggacacatttagcataaggaaatccatgcgttgcactaagatctctgtaagcgggcaagatgctaggctgagagtggaagtgttggtgtggttcctggctctcgttgttctgaaagagtccccttccctctctatctgtttcattactggtaacagggagatgtgtaggtttctcagactcagggcaagggagaggctcagggctctgtgtgcaccctgatgctgaatctcacttccccttccaggcagggtgcccagtctacccaggatgaggtcgctgcatctgccatcctgactgctcagctggatgaggagctgggaggtacccctgtccaggtgagcccagcccaccgcctctctgggctgcagcctgagccttgtccttctcttcactcatctgtctgactctcatccatccattcgtttgtccatctgtctgtctgtccatccatccatccatccatccatccatccatccatccatccatggaacaggtatttatttagggcttccatgtgttccacactgcatctgtagccatggacacacagacacactgtccctgccctagtggactttgctgtcttgggtggtagtagacattcaacacacaggcacaccaatggctatgacagatgcagtgagtgaaattgacaagaccttgggagagagacatgggagaggccatgtggctgagcacggatgtggaaccagcatgcttgggtttgaatcctgtcctcacctctgggcaacgttgggcaagtcacttagcctctctgtgcctctgtgtcctcaaaataggggtaataacagtaccatcccacaagattgctgtgaggattaagagttaacatttgtaagcatttagaatcatgcctgccatataagaagtgcccccttatacatatgtgttaagtacaaggaggtaaatcctaggtaggatcctattggattagaaaagcccacccctgtcccaggaggggactgttcaactgggacctgatgcacgtgtaggagttgcccaggcagagtgaaggaaagcacattgtgggtaaagggtggtacacatgcaaaggccttgaggtgggagggggcattgggtgttaaagcaaggggaaaatgccatgatttgaggctagagaggtgctcagaggggccagaccaccagaggccatagtgacgatgttgaccttgatgctgagaacaacaggaagttgctgaatgataagtctgaggtgtagggatttctggtttaaaaagtcactctggccaggcgctggagggcagcagagctggtttgtggaaatataggggaagcggacaacaattgtgcttcctccgtcctacggtgggagtgggcagggctctagattggcatcgggggttcgtgccctgacctttgactatgatagactgggtgctgggcactaaatgagatgatgaccatcttagctcagtgcatcctgacaacagccttgggagtagcatccttggctgcatttttcagaggaggaactcaagaggttgagacacgtgcccaagttctcaccatcagggtggagttggggtctaagccctaactcagcggtggtgggtcgtggtgggaagcgactgccatacgcctgacgtacatgtgaggttttcttctggacatagttagccggggccacggtaaggtgccgcacacagggcaggagcagatgtgagggtgtacatcttccctgcctcactcccaccaccaagcccctgactgctgcccgcatctggggtgcactggctctgcaggagggggttttctggatctagaatgctctgttcttaccactccaccagcagtcatgcccaggcctgacgtcagcattctggaagaatgtccaccagcaatccctgtgcttctatttaagggaacatttgcaaacacaggctctcctggttcttggaccaggctgaggatcaggaaggcatgtcgtcatggagatggagagcagcccagcagcagtgccctggggacctcagacaatagcactgtctccacccttcctggaattctggtgtccctgcctgtgtgttgtcgggtcacattccatgccacacacagacacaagcatgatggcttcgtctggagggatgggcccagtgcgacatagaaggactgaagcctgcccccaaggtccctgactcgctctcctgtctccctgccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtaatttccaggtcctggaacacagaagggattggcctccctgaaacctcccagctcaatgaccagatctccaggcacaggaacgggggcaggggatggtgaatgacggggtaagaagcagctttttgtattttcctgccgtggccacagggttgtctgtcttagactcccccctgtttcaaggatacccagtgtcccttgcacactttgcatagtggacagctcactacctaccattctgtacaatcagcatgccattcctgattacgttccagttgcctactatccctttcacggaggaaggcacagatctggacttgattcccaggatggtctgagcagcctagaggggaatgggactctcacctcctttgttctgggcattcaacttctgttaatgcagccctgatttttagaatcatgttggctagtcacagtgcattagtgactcatgggagtcaaccaaggccatcagggtccaaagtctgtgccctcagctctgatgggctgtgttcctccaagtccccacctgagagctagtcctgctgcggggtctcctgggctgtgaggagggggctgagggctttttgtctggttcctgattaaccaagctgtaccctcccaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccaggtaggagccggggtggggggcctgctgctgtccggatgcagctattaagtttcccccttctttccttcagcttgggggctctaaatcctcccctccatcccacctgagggcctgtcccctaatgtatgttaaataaaagcagttgcattaaaatgagggctgtggccagagagagggaggtctccaggagctaaagaaaggagagcctagcctgggcgtggtggttcatgcctgtaatcccagcactttgggaggctaaggcgggcggatcacctgaggtcgggagttcaagactagcctgaccaacatggagaaaccccatctctactaaaatacaaaattagccgggcatggtggcacatgcctgtataatcccagctactcgggaggctgaggcaggagaatcacttcaacccgagaggtggaggttgcggtgagctgagatcacgctattgcactccagcctgggcaacaggagtaaaactctgtctcaaaaagaagaaagaaagaaagaaaggagagcccagtgtgggaaggagcagttggtctgtggaaggaggcggtccctcgctaggaagccttgaaaggtggtaggcagggctgatagcgtcagaggagcagtggtctccttgcatctctagactctccatggacagaaatgccaccagcctgctctgtttccagaatgtgggccgggcagctcttccttctgccagcctgcagtctttatactgttactttgagttcattcccacctgcttgatgcttaacagaaatggtgaagagtgacttggtctaaagcagctctgtccagcagaaccttctatgcagatggacatgttctgtatctgccgagtccaatttgacagccattagtcacatgtggctgttgagcacttgaaatgcgaccagtgggaattagtgggaatgaagaactgaacttttagtcgaatttaattttaatgaatttaaatttaaatggctgcacatggacagagcaggtatagtggaaagagtataggtattagaatcagacaagatttgtatcctggtcttaacacttaccatctgtgtgaccttgagtgagttgcttaacctctccgagccacaactgcctcattagctgagtggagctaatggtcctcatcccgcaatgctgtcgtcagcctcaagccaatagtggtcctggctgtgtgactactgccaagtctgccctctctgggcctctatttcgtcaccttccaattccctcaggcctcttccctctggatctcctgggatttttaggatggagggaggagagggagagcagttggttgcgcttgggcagggctggtcccagggtccgatgagatgggagagaggggtgatggcatcccttggcaactggcgtggcctcccctcacagatggcttctgggaggccctgggcgggaaggctgcctaccgcacatccccacggctgaaggacaagaagatggatgcccatcctcctcgcctctttgcctgctccaacaagattggacgttttgtggtgagcccctgcggaggtcacacctctgctttcccctcgggaggcgagttccacaggactggccggcagcaggggcaggagaaacagttctgatggtgtggcacagaggaaggggccccctgccagctgcagccagctgtgccactccctcagggggcagataaaggaaggccacccaggggagggaagacatctcactgatgctctttcgttccttcccagatcgaagaggttcctggtgagctcatgcaggaagacctggcaacggatgacgtcatgcttctggacacctgggaccaggtgggtgaaggacaggtgaaggctctctgtgccagagggagtgggagaaactagacttccagttctatgatcagttgctagaaggacctaaagggggcagtgccaggtgttgccagaaaagtctctaagggtactggaagtcacttcttctttctgagcttccatttcctcatctgtaaactgggagtggcggtacctcccttgcagatacactcaccttgaaagctgcaaaacgccctataaaggcaaatcacatgaccttcatcattctctcccagaccttgcaggagcgtgaactcttcctttaaatctgttggcagaggaagttgaacttagcagcatcttgtttgcaggcataaactgtccagtgtcacctagaggctctagagggctcctgcttctggtttgagggctctgggctctgtctccacttcatctcctagagaaggccattatgtaggacttggcaggggaagatgccattcacttactcaaccaatattaattgggcactgctttgtgccaggtgctttatgtttgagatgctgggatagagcaatgaataaagtaggcattttcctgctctcccagggcttacgttctcacaggggtgtcaggtcagtcacctttcctatcaaggtggcttctcccagagtcctcagagttacggagcagctggccacgaaggcataagactctacactacccacagggatgctcggaatccccagttggaagatcgggaccaaaaatgattgcagtttgagccattcagcagttgtcattgattgatccattggctacttaatctgtttgttcatctgttagggattcagtcagccaacatttattcagcaccatggtcttgcaggcaaaatgctgagtgctgagaatcctatgatgagcaaaatagaatgcctgccttcgaggggcttccactttagttgggaacacatttataaataagtaagagagggccagacatgttggctcacacttgtaaacccagcactttgagaggctgaggtgggcagatcacttgaggtcaggagttcaagaccagcctggccaacatggtgaaaccccatctctactaaaaatacaaaacaattagccaggcttggtggtgggtgcttataatcccacctacttgggaggtcgaggcagaagaatcacttgaacccaggaggcggaggttgcagtgagctgagatcatgccactgcactccagcctgggtgacagagtgagactccgtctcaaaaaaaagtgagaaaaatgaagtctgacattttattgtctaatgccattttatcaatgataggtgctctttgaagtaatattttagatatgcataaaaatagatgatacataaaaatcagctaaataatgtgtaatagaacttgtaacaagactcaaaatggtgatagtggtgggtgagttatttttattccaagccttaggcccattttgacaaagatgcacacagaccggcacatagtagactctcggtgcatatttgttggataaataaatgggtgagaatatgtttggccactcatttgttgaacgagtgaatgctgttcaagagataactcatggacctttagagaagaatctcaaactcaatgcctgatggtacctggttggcaatgttagcgaatgaagcaggctgggctggggagacgtgaaggagcagtggagtctgaggcaaactagaactgctcatctcaaaggggcagctcctgcgcagcttgactcaagtgaggtttgaaggcccaggctgctagatcctccaatttttaaagagaagttggaaatctagatttttatgtcataacggtttaaaaagacattgttggctaacacaaggtggtgggtgagcaaacaaaacatgtttgtaggttgccagttttcaacctctgttccaaatccttccagtcttagttcatgggctctgttagaaaggggagggctttgtctggtctgatacctggcccctccccagtcttcctccagccgtgaatttgatcagcactcctcatgtacctttcctgttgcatctcacctccaggtctttgtctgggttggaaaggattctcaagaagaagaaaagacagaagccttgacttctggtgaggacccgagtgcctgggggcggggggaggggtccgttgcttgtggggtgctgggagtggctcctgtacaggtctgggaatgagcatctttccaggggactgatggacaagatagggtggggacttcctcctctgtgggccagcccctcataaatcctgcctgggatagtgaagaacacatcagttccttcagaaaccctgaggcttctcgaagaaggctctcctctgttccaggagaaggaagggacagatgagaagtcacttcaagttcccagaatactcaggagctgaacttgtcaaggtttagatgtggcaaagcaggccaggcatggtgactcatgcatgtaatcccagcattttgggaggccaaggcaggaggatcacttgagcccaggagtttgaaagcagcccgggcaacatagtgaaacctcatctctagaaaaaatacaaaaaaattagccaggcgtgttggtgtacacccgtggtcccagctactcaggaggttgaggtcagaggattgcttgagcccaggagttcacggctgctgtgagccatgatcgcaccactatactgtagcctgggtgacagaatgagatggtgtctcaaaatgaaaaaaaaaaagaaaaagatgttgcaaagcagattcttggcagctgaatagatctgatttgtgagctgggaacccaaaagttggttcccatatcttccagtaggggactgcaagggaaagtaataagctttatgaagcaggagattaagccgtagccctgttccttcctgtgttcctgagcagggtggtggagagcccacgtgggtatcatgcctttaaaggaggatggtgcccagggcagggggtgggcagtagggacagtaggaccatagaccctcttctttgtcaactcctgtcctgagtcaccctctccctggtgtgggaggcactaagaattcctggggtttccttttcttgcacgtgtgtctgcagctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgtactctagtgtggctcgtttccttgtgcccatctgacagtgagagccggcgtcttctctgcctgtgtccctggtaattctgagaatggccagagaggtgcctagcatttgcctgtaaactagtagaaaggctacatccaccctgtgcgtgcatcctggtgccctgagaggcgatgccacagtgagttgagaggtgtgtagattgtcctgggggatacctatgctaaaggaaataaggaggggccgggtacggtggctcacacatgtaatcccgacactttgggagaccgaggcaggcagatcacctgagatcaggagttcgagaccagcctggccaacatggtgaaagcctgcctctactaaaaataaaaaattagccaggcgtggtggcacatgcctgtaatcccacctactcgggaggctgagacaggagaatctcttgaacccaggaggcggatgttgcagtgagctgagattgcaccattgcactccagcctgggtgacagagcgagattctgtctcaaaagaaaggaaataggtggggaaccaaggaagactgggagagccatcagaccctcgacgcaagtctgaccctaggtggagaaaaaagggagagaaggttgtgcggaagtgtcttagtggtcatttatttaatccaggaagatttggcaaagcttgtcggcagtcccaaagccaaattcagtgttctttttaaatttaatggtatagtcccatttttgttgttttttattgtggcaaactgtacgtaacacagtatttattttaaccacttgtatgtatttcagtaacattgcatatacagtgttatgtagccatcaccactctctgtacccaaaactttttgataatccccaatataaatgctctgcccattaaataccaattccccattcttccctattcgccagcccctggtaacctgtattttactttcagtctcagaatttgactattccagggacctcatataagtggaatcatacaacatttgtcctctgtgtgtggcttatttcacttagcagaatgttttcaagactcatctgtgttgtagcatatatcaacttttcactcctttttgtggctgagtaatattctactgcatgtctataccacatctggtttattcagccatcaatggactctttgttatttgtgccttttggctattgtgcataaggctgctatgaacatgagcatctgttcaattcaaagtgttcttgagccagagtcaaagtcagccagcaaaggaattgtgtgtctcttgtaagcaggcgtgccttatctgccccctgcactcagtctttgggaggcctggccttgggacacatgtgggatgaagttcaaagccagcagtcggagcccttatcaattatatgccctgcagtagaaagcgggcagggtgcatcctcatagctgccacatcctgtagcagctgcttggaccttccctgctgcctctgtttcccacagattcattctgctgccccaaagctatgtggagaaataactgcagcagctgccagcacaggagctgcccccggatgctctcaaagtttgcggtcttcagggtatgggaaagggactcttctgtgccttcttggtcccctgggtcctgactctccactcatgctcagcatgtcacacagtccctcttggatatttctatgttgtttcataatcttttctcctgggagactaaaccagtccaagaaacctgctggaggacattccccagtcctcccgctctgtccttttggtctcttctcaccttgttttccccccgtcttgttctgtgtcacctcccaccaccactccatccccattgagttatgatgtgaaagctcgcaagcatatgactgtaaaagaacagaaaccagcatgagggcttaaatgatgggcaggctgtgtgtttgtgtgtgtgtgtgtgtgtgtgtgtgtgtgtttacactgttgtctccaaagctggctgatcacccaaatt

SEQ ID NO: 15318 - DNA, 79595 bp, Human
ccaagtgctttaccatgaactcaactcaagccttggcctgtaaaacctgagagttattaatctagttcaggtaaggagtgaaggactaagggaaggcatcccagaagtgctgtcttaggtgatacctgaaggatgactataagttagccgggagaaaaacagaaaaatagaagtcctaacgacgagggaaaatggggcacatttgtacagggtagagcaaacacagagagcagcaaaagttatagctggagtgcccagatcatccaggccttgtggtccacattatctacaggatgcaggtgcccactctttctctggtctgcgttgcattctgtgcactcccttaccttggctattcacctggtatattaaaatgatctcctatgactctgtatccctagaccagcactagccaatagatatatgatgtcaccccaagtgtgagtcacataagctccttttaaattttcttgcagctacactgaaaaagacaaaaaggagaaatcaattgagaaaaaaaggacaaatcaattgaacaaacgtttttacactgttggtgggaacgtaaattagttcaaccattgtagaagagagtgtggtgattcctcaaagatctagaaccagaaataccatttgtcccagcaatcccattactgagtatgtatcaaaaggaatataaatcattctattacaaagatacatgcacacatatgttcattgcagcactattcacaatagcaaagacatagaatcaactcaaatgcctatcaatgatagactggataaagaaaatgtggtacatatacaccatggaatactatgcagcccgaaaaaagaatgagatcatatcctttgcagggacatgtatggagctggaagccattatcctcaccaaactaaggcaggaacagagaaccaaacaccacatgttctcacttagagctgaatgatgagaacacatggacacagggagggcaacaacacacactgggtcctgtcagaggggtagggtgggggagcgttaggaaaaatagctaatgcatgctgggtttaatacttaggtgatgggtttataggtgcagcaaaccaccatggcatacgtttgtttacctatgtaacaaaactgcacatcctgcacatgtaccccagaacttaaaaaaaaatttgcaccagtttgtgataatgtagcttcaggttttcaactgtttaccaaataaagcttcttagaatgaaaaaaaaaaaaagaaaaaagaaacatgcccttgttcacatagttgatagagaatagaggcagctccctggagcttcctttctggagttctggagaaacagttctttacccaaattaaaagtcatcatagttagcagtgttactgatctatgtgtgcatgtctaagaaaaacttaaaagaagaaaatgtataaatttttatatttgcatctaaatttatttaaacatgtctatcattcatccatttgcttccatccaaatatctctttctagctatccaccgttcatttatctattaagaaaagatcagggggaggggaaagagaaaaaggaaaggagaaagaaatgaaggggagatgggagagtagaggaaaaggaggaactgcatgataatgaggagacaaaggaggaggagaaaagaatgagaagagaatgtctatgccacatttgccattgtatagaagagactgaactttcttggaagaggggaagagggttttgttataagatgatgctggtgagaagcatgaagtcaattattaggggctggactttattgttgggggttttttaatgatccttgtcctaatgaagcctggtgtttacagccacctctagacagtttattttcattgtgcctttgatttttagaggcagaaggaaacatgggccacattggttggagatttaaggctgttttcagcatccaggtcccatccctgtcctctcacatgaaagctccacaaaccttcttatctacttttctttcccatccaggggaggaggctttgaccatgtatatggacaaaagtcgcctcgacaggaagtcagggaatgccactcaaagtgttgaagctctgcaccagctcgcatcatcctactttgttgaccgtgatggtaccatgaggaggcttcatgagatccagatatcaactggagcaatcaaggtacagctccggggtggatttgggcgacaggttctcaatacaacaacactgcaatgcaggcattctgagagtggatggacagatgtaatttctgggttcataaccatgtagctcgtgatgccctctgccagctgctttgactgatattgtcacataccctgtaattaatatcaatgtgcactgtcattccagtggccatatgtactgatttgctagagtattctggctgtagtcatggcataactatcaacagttctctcattcagtcttctgtatggagattatcagatcccctttctagagaagaaacagagactatgaagaggtaaatgattttcccgaggtctcagagatagcagcgattagattactgatgcctagctcagtaatattttaaacatctatgttttttattctttcctccccactcaccattttaaagatgggaaaactgaggctaaaggtttaaagcctttttctgagggttatacagttagagaataacttaacagggactagaactctgctctcaagaccagcagtcagcaaaagttttctgtacaagaccaaacaataattattttaggcatggtgggctgtatggcctgtgttgctattactcaaccctgctgttgtagcataaaagcagccatagatgatataaaaacaaatgggcatggctgtattccaatatgactatatttaccaaaacaggcactctgtggtttgctgatctaggctcgcctacaccagcaccgtccagtagtaccttctaagatggtggaaaggccctgtatctgtgctagccgagatagtagccactagtcacctggggttattgaacacctaaaatatggctaccaaggagctcattgtttaagtttattccattttagctaattaaaaattaaatggtcacattgagaaaagcagccctggactttcaattcagtgcttagagcacaggaactttaacaagattccattttaaacacaacaaattcagacagcctctataaagcgaatgtgggaggacatcctcgacataaaatgtttgctcttctgagggttttagtgcagatgtttccatctcaaatgttctttaaccagattatgcctgcattttacatctcagtctttactctaatttcttctaaagaaaatgcagacctagccttatattaagactttccaagatatctatagggaaaaacggtgaggataaggccaaggggtcttaccctgccaaggctggcagatgagtcagaaattgactaaggagagagaaaagtgtgggagggagagagttactgagcagggaggtagtaaggagagaaataaatcagaccaacaaacaaagggccagtttatccgaaaagaatcgcctgtatttgggagattatgttgttagggaactcagcacagagagatggatctttatgaagccatcggagtcagagtgctgcagaggcctggttttcattatcaccaaatggttctctcctcgctggatgggatgtggaattgagatattgaagctctgtcagaagataatcctccttcgtgtatcctagaagtgcagtctgcctccataggaggaatttctcagagaaattgcagaggccactcaagaaaccatttcttatggtaggcactgtcttctgcacttaatttggcccttggatttttcatgccatttcttgccactacctcaagaccaagctgtctaaaacttgtctcactattgggtctgtttttgttgttgttgttgtctttttgagatggagactcgctctgttacccaggctggagtgcaatggcatgatcttggctcactgcaacctccagttcccggtttcaagcgattctcctgcctcagcctcccaagtagctgggactacaggtgcgcgccaccatgcccagctaatttttgtatttttagtagagatagggtttcaccatgttggccaggatggtctcaatctcttgaccttgtaatccacccacctcagcctcccaaagtgctgggattacagtcatgaaccactgcagctggcctgggtctgtttaagaccagccactaacccgggcggagaagttttgcccattcaccattctccccagcagaggtatctttaggaaagtaaattggtaagttttactctctctcaataataaatatgttattatttttatataaaaataaattatttgtaaaacaaaacgaaaaatacaaaacctaattattccccatttactaaatatgactgcacccgaagtgctaaacccttcaaaaatataatctcttgaccctattttggtgactaatagcattactaacattttatagatggggaagttgaggcttagaaagagaaagttactgatccaaggtttcacagctggaaaagggcagagaaggtgcatgtggctgcctcccaagtcattgttccttacaatggatgctgtgtttttatagctgaatgcaaacttcaaaacaaccctaaataatgggaagcaaaggctaaataaatgaagaggcttcttttcatactaagccattcttatttcaaggttatctttttgaatagctgttcctctcttacccaccacctcaagtctttctaagacaatgttttggaaatgcacatccacaggattgggtcattttctcctgtggcagcacaatgcttcttgctaaaacttctttaggaaaatgggcatcgttttcttgttcttgcctaataatagtgtatatgtactcattataacttatagagccattttgtaataaggtacccattatggaacacatgccatgtgccaggcgtttagacccatcgtacctggtctcacaacctctctggaagagatttactagctttgatttgcagatacttagagaaattaattggcttccctaggtcccagggtaaatacatggcctaggcaggatttaacactattttttctgattccaaagccaatgcttttgaaatataatgtgtcaacttctaagttcatgtctacttgcagccaccgtgtgaagtgagaaccagtggtaggaacaggcatgcactctgtatgcttgaccaccctgcttacctgtctactcagtgacagctgtgcttggtcccagacacaagcacgaagctcagaaagtgaccattgactcaaaccaggaggccttttctgcaggctttgctctgctggggcatgactctttggggtatgtcctagacaaggactgctgtctcacacctatcttatttgatatctactgcaggtcacagagacacgcactgggcctctgggctgtaacagctatgacaatctggactctgtgagttccgtccttctgcaaagcacggagagcaaactgcaccttcaaggtaggaagccagtggaaaaagtggggtcagttgggggaaacatcatggatgtgatatgtgggagaggggatcaggagggatggagtgaagggagaataaagaagaggaagcatagaaaatctaatgaaaactgcaaatatggaaattagacagttatgataccgtgtatacatatatatttagaattttttaacatatgcaggacagtaaattcatgattattaattagttttcagatagtaaggaaatgtgagctttaattaatttgtatttataaatatctacatttctttggtgtctgtatatgctgtatatgtcaagtttatgtttggggctccatatacattattttaaagaaaatatatcctttaaaatagtaatttcatctttattaattcacatcataaaaaggagaggagattgcagggaaaagttggacaaggctttaagtacacatagcactgtttttaaaaagcataatgtattatatcaaaaaaagtaaggattttaatttttcacatgtgaagactaagtgaattatattgcattaatacaacataatattaaactggtactgatgtttataaagaatttccaataatatgtaaaaataatgtgatataatgttaataaataaaaggtttctgatggaatgggtggcatgatcttaataatttaaagagataataaaaataggcagggtgcagtggctcacacctgtaatcccagcactttgggaggctgaggtgggtggatcacgaggtcaggagtttaagtccagcctggccaatatggtgaagcccagtctctactaaaaatacaaaaattagctgggcgcggtggtgtgcgcctatagtccgagctattcagaaggatgaggcaggagaatcgtttgaacccaggaggccgaaattgcagtgaaccgagattgcgccactgcactccagcctaggcgacagagcaagactctgtctcagtactaataataataatggccaggcgcggtggctcatgcctataatcccagcactttgggaggccgaggcgggcggatcacgaggtcaggagattgagaccatcctggctaacgcggtgaaaccccgtctctactaaaaatacaaaaagttagccaagcgtggtggcaggcgcctgtagtcccagctactcgggaagctgaggtgggagaagggcatgaacccgggaggcagagtttacagtgagccaagatcatgcaccactacactccagcctgggcaacagagcaagactccacctcaaaataataataataataataataataataatgtagcaagaaaatatgcccaggtattagaagagcttacttctggatctctaggttaccgatgatgtattttaggcatctaatttcttttctaacttctctacaatgatcatgtattaactttagagtcagaaaaaaaaatgacatgctttaactttgagcagactaaaaatgtgaccttctagaaaggtatatgataaaggtgattctgaatgtcagtgggaggaagttgggttgagattggcaggtaaagctaagaggagactaatgtgacttttattttctggttccttttggcaactctttgattcatgctcccgttacagaaggtggttagaaaatatcttctgttttctaacatgcatggagggcttggtagtgtcacttgagggcagtgaatgaaaatccctcagggaaattcaggccaagaaagtggtttactattaaataacaaaacacaacacactagaaacttaaatacatggagcgtaaccctgccctctttagcagaaaaaagagtagacagaaaagagtagcagaaaaaagagtagacagaaaaaagagtagacagaaagatttactaatgcctgttaagaaagtagataagaaagacagatcttccttgtgtgtgccagggttttcaatgtgttagttcatgcgatacctgtagagactgtgtgaagtgggagccaggatttgaatccaggcagtgaagctccagtctgtgtttgatcaccctgctgtgcatactgagggtggaaagattgtgagttataattggaacagaaatagaaggaattaatgacatattcctaccaaggaaattactgagatcttagggacatttagaggttgatttacctgaagccaatgaagcttaaggttcaaggattctgcaccttccaagtacccaccttttctcattctaaatacacacttgatttcctatctaattttgaatttattttttaaataaaacagctagtgtataagacttatgttctccaaaatctagatctgccatgataacattattagaaggatgctgtgaatggaaagggtggtagcaggcctactgtcctaccctagatgggttagagtacacctggaggattggatccgtgtttgagcatcacactccaggagggatgttgagaaactgcagtttttcttgagaaagtgttttactatgataaatagtaaaagaaggttaaattgaagcaaaaattacttgctgcaggtatctaaaaggctgccttgcagaaaagataatcaatcccattaatattaataaaatggaccaatcccaatctagtaggaagggagaagttacaaggatcccagcttttaactcaatgtaaaatggatctttctagtacacatttatgaccaaatctggaatgatctgctgaaggatgcagtcactccctgttgtcagagaattataagtagattatatttggtgcaaatgttatagagattatttaagcatcagttaggttgggtgattgaggcaggtggttttaagttcttctcaacactgattctaggattttatgaaaatgatgaattataaaacctttattgagactaactacatgccaaagccaatactagaccccaggcatataatcataaatcagttcaagtcaacaaatatattttttgaagaactcatgttggtaatgagatagacaaaaaaaataaagtcgtgaacaagacagacattgtttctgccccaaggaaatatacattctattagagaagatgagcttcaaacaaacaagagtaggcataataaattttaatggagaaaaagtataaggtttatatggcacgagatagcatagggacttaacgtaccagggagtcaggaaagttttctgccaaaaagatatataggataagacctgaaggatgaataggaggacagaggcatggatagagaggcagacagaggatctttatgaaggggtattcaaagaaataagaaactcatgtgaaattaaagcacagacatcaatggtgagaaagacaagataatctttcaagtcctagaaggcttctgcagcacattaatgagttgaaagttaatttgagagcaatggataccatggaatggttttttaaaaagaagtagcatgaagagattgatattttagaagatcattctgactcttgtgtggacagttaattagagggggtggattagaggttggtgacatttagggggctactacagaactcaagaggaaatgccacggatttagaccatgggggtaccagttgagatggacagaaatggagcaatcccagagttacttaggaggcattatgacgaggatttagtgaaaagaccatatagaatttagacaattgggtgaatggcttgtggggatgagatagaaaggatagatgggcaagtatctatgactcaagataatatataacctaatagtcataataaaataagacatggcattatggggattcagaaaagggagtgattcattctgtctgttcagattcattctgtctagaggagtcataggaaaaaaaatatctgaggaagtatcatattctcctagtggaaggcaaaacaaaagtacttctaaaatataagacagattatctcatgatttttgagtgagctcatttttattcagtaggatgcaaaaaaacactaagtataagaaaaaaaggctaataaattggatacattaaaattataatttatgttcatcaaaatactattaatattataagaatatgagccatagagtggaagaaaatatttgtaatacatgtgcctgacaaagaacacttatagaatacagaatatacatatttttaaaacttctgaagtcaaaaagaaaaagggaaatagtcttgtaagaaaagaaaatgaatgaaagacatgaacaagcacttcacaaacaagagtgtcaaaatgccaaataaacacttaggtgctcaactctcctagtcaggaaaaaaagtgtaaattaaagtcacaatttaatataacacagcaatgagcatgactcaaatcaaaaagactgacaatatcaaggagggacaatgtgaagcaatgggaacttaggcacattgcttataggaacacaaattggtacaatcacttcggaaaattcttggcagtgtctacaaaagactgcacgtgtccttggtcaatgacccatcaatcctgactcctatgaaaacatgctcaccagaagacataaatgttcacagcaactctatttcaaataactccaactggaaacaacccaaatgtccatcaacaagaaaatggataaataaattgtcatacattcatacaatgagcttactatacagaaataagaaagaataaaccactgtttcatacaacaatatggaagaatcttacaaacacagcattgagtgaaacaagttagacgtaaatgagtacaggctgtgggattctattcctagatgggtgaaaaaaaagtaaaaacaaatacacggttttaggagtccagagagtgttaacctttagggagaggaatggggtagtggctgaaggggtgagagacatttctggggatattggtaatgttctgttttttaaatccggttggtaatacatggatgtgtttgctttgtgaaaattcaaaaagctgcacatgctttatttgtatgtatgcatttctgtgtatacaatacgtatctatttaggttttatttaataacatgtcccatgttgacatcctctgcaaagaaagaacatgaataaaggggagaggcatgggaaagtgggaggtggttcagcccagctggaggacaggctgcatgaactgaggttagaggagccaggaatgacaatagatattatttttttcagtgcttcctcatatgccagagattgtgctaatttatttttattagatttatttttgcttatttatgtatatttttaacttgtttttattttataattgtatttattatatttttaatcctcaacatgattcccatgaagaaggcataaataacattctcatttttgcaggtgaagaaaccagggcctagagaggttatttaataagtggctgaactgcagttttaactcagcctaacttcaagcttcttcaaatgtgtttcctctatatttctctcttcctcttctcattcctttgaatgaggctgggagggcagattctgcagaaggctactttggtggattgagaacaatatcaatggcactctaatgactttcaccttgtgatgtttcatgaaatgtttattaaaacaaggcaaacgtaaagcaaaatagaaaaaaaaaaagaaagaacaggattggaggagattagaaatgagaaagaaagcatcatgagaatgatcagaggctattagtagtcatagcagtaacagctcaaatagtggtaataacactaatggcataatgataacttcttattttcatacttctctttccaagaagcccattgaatgttttaccaacattgtcatgtaatttaatctagtatccatatggcgaagtatacagggagcaaagctgtgcctcagtagctccctgatgtggaaagggatgcagagagaatattttgctgaaatctgtggatgatacagaaatttattctttcatacatttactaatttatttatttagcaatatttacagagcaccaactgtatggtcaggtatgtttttaaagccagatatacagcagtgaataagataaatgaatcattttgagcttataattgatgtgtggatatggcaaaagcagacaataaataaaaaaacttctttataatcagagaaataatgaaggagcaggtcatgtagaaacttgtagaacatggcaaaaactttatatcagattttactctagatgcaatgagaagcaattgaaaatttaggcagagaagtaacttgacctgacttagattttaaatagataactacagctattaagtaagaaagactgtagagggcaagaacagttgtaggatatcagttgttaggaggctgtcatgtttatccaggtgagagaacacagtggcttagatcatgacagttgcaatgaaggtggtgagaggtgactgaatttatggatgaatttttaaggttagcctgacatgatttggtaatgaactcaaaagtatttgtgagagagagaagtcaaggatgaccccaaagttttgcctgagcaactacaatggtagaattgtcacattgctatgatgagactggtaaggaccagttttgatgggacatgtgaaaatgcgttcaaacctagttgagttggaacctacgtttgacaaatctattcgatatccaaatgtagatgttgagtggaagacatttgaaaggtaagaggagaaaactgaaaatataaattaggatataaatactatttaattatctgagattgaacaagattactttgggagagagggtagatagagaaaaaaaaattcagttattgtgccatggagaaattaatgttaaaagttgcgatgatagaatgatgatgaggaacaagaaaaggaagctggagagtggccagaaaagtaagaagagagacaagagagtatagaatcttggatgttatataaggaaagtttttcaaaacagagacagcagtaactgcgtcaaatactgctaatagtataattaaagtgaggactgagaactgaggatgatatttagcaacacatgggtcactgatgacaaaggatgttttcaatggaattctgggggtgaaattctggagcaaattcaagtgaaattcaagggcaaactctacagagtagtattatagtaaatggcacaatagcttaaggtgatcaggagtaaagtgatatttttcttttctttttaatatagaagcaacaaaacttttgtctaatgttgagaattattctgtagagagggaaaaattgatactgcaaaaatgggaggaatggttttacaatcaaagtggagcaggcaagagtgaatagggtcttgtgcataactggaattatttgccttagataggagcacatattcttggcagagagggaaaggagaacctgagatcagaggctagtacaatttgtacatgtgataatggagacattttcttgatctttatttcttgattgcctatcatagattttaaattgtatgatttttcagattttaatacctctgaaattagaatgctttttattattgatgatgtgtcttagtttaatttggcagggtattattttcttagtatacataaaacagtggtgtgttttatagtaaatatcatcttagatttgtagattcaatgtcataaggtatttcccctgaaaaattgagtgaggtcattagcttattcccaatttccaaaaggtaaggatgaatgcaaggaggatagagatcattaggagatgggagggtaggccagggaagggagatggggtcaaagaccactaacttgaggtatcgtctgccctctgcctgaatctccaacagggccacccgagacttgtgttttgagagccttctccaaatcttcacattcaaatggtctatctggtttcttggtcttaaatcatttatcttccttctcttcatcctcctcttttttcttcttcttcccatcttcttcctcttctttgaccttttctttttctatctctgcttgaaacctcagctccttctagactagaagatttcctatcactcatgcacccggactctcttcatgcctaaaatgacatcctcactctcttctattgaatgtggcccatctctcaatgccaagcacaaatgtcccctcatcagaatcattccttctccaccctctgccttggttcagctccttgtctcatcatctctcccttccccagatcagtacaatgagggtcaaagcagccttcttgttcagatctcactcctgctgatccgttgactcacagcagccagcgtgatcttcttaaagccaaatcagattctcgcttccctcctcacagcccttcacagcctccgtgaaagttttggtatacagtttagatttcttaacttaacaccaggctgttcaaatgcaagccttgccaatcttcttggctttgccttatgctatcacccaacatataccatatccatgctccagacccatgccatttcttacatttcactacaggcatcttttgaaaactattatttttatttttttattgccctgcacttttacacagcctttctccaattcctgaacttttcatctctctcaggtaagcttctctaaactcccctccccaggccattagatggtctgcacaacttcttctctaggagttgccacacaatagtatcatcatccttttattaatctgactctccaattgtcctagattcttgtttgataagaaccatctctctctctggcacaatacacagagactgatatatagacactgctcaaaagatagttgctgtacgactgtgtgaatgaatacatgaatgaatcactcagcccatagtgaactctgttttcttctttgaacccttacacttcttatcccacatgatactggattcagttcaacctaatgaccatttcctgagggcctactgtatgccattctctgtgctacattgcatgcacagcattcttcaaaagggcatgtgtttttgctattgctttggatgttacatcttccaggaagggtcataccattgaattctccaaatgccacctcttctgagaagcctcctggcttcttttgcttctctgaccttctacattatgaccattgtcactctctttcttatctaaggagatacaatgtagaatagtggtttcaagaaaaggccctggagtcaaacggaccttagttccagtactagttctaccatttgctggctgagaggtttcagataagttactgcagcctccgagcctctattactaacttacttcctatggttgttgtattatgcatgtaagaatatacattatgtctggcttagattaagcattaaaaaaagttaggtattatttttaccacctctatcaatgtgttacttgcaaaatatttgctttatttatatttgcatcctccatggcatatgtgcttggccaatatcaagtgctcattaaatatatgctgaatgaataaatgcagtgttccttacatagtcaggaactcagcaaatccttccacaaaaaccacagcaagtatttatggtgtgccaaatattaagaacaaccactgtgttagtcaaagtggaggatcacagtctaggggattaaaccaaatacatatacataaaaagtgtacttggcaacttcaaagataatctcagtttgatcagtttatttatgaatcaatcaagtaattaatatttttctcaatggatctttattcaatatacatcagttcacccctttgtattaatcttcccaagtcatagcctattaggactgacgcttgcctgaaatcactccatggtttccccacattcgtggggtcccaaattccctttctagcttcagttctaaagcccattggaacaatggaggtgggactttcctagaagaggcaatgataataaccaacacgcgcaatcacgcagattatctttcctccaactcaccctcttctttcccattcgtctttgctcagcagtatcctctaccagagataccttgcattcccatctctactcaatggcattctacatagtcctcaggaaccatttaaaatggtatcttgcatgcacacatgcacatacacaggactggattaaaatgtccctcctctcatcccattataactctttgattacccctcatttacagtatgatttttttttttattttactcaccttgcaacatattcatttatgtttagttttctatcttttctattagattagagtataggcctctttaaaggcaaagatttttccttgccaattttacatttcgtaatatttaatgtagtgccatgggcataggaattatatataatataattcctatgtgtgtgtgtatacacgtacatacatgtatttgctgaattgctgaattgagtttttgaatataattggtgctagactgacagtggaagataatgagataaggaagattaggaggaaggggaaaggaaagaaaggaagagaaagaagtgtggaaagagagaaagggaaggggaagtgaagaagggggtagagggagaggacagggcagagcaagaggagcagtctgatgaagagtagtgtcggtaatcccatttctcagtagctagacgtcacagatggagcgaagatgactattttcaaaatcatcttgcaacaaatagtagaaaaagaaagtgtaggagaaatgtttaaaaataacatttttttgagatgctatccttcttagacattgagcttataaccactagcccatttatccatcccaccaactaagagttagggatcatgctccccactatacagatgaagaaattgaggctcaaagaggatgaaaagacagagagtgaataggtctcctttttctaaagccccctcctctcccacacgcccatcactttatgtggacttgtaacctcagggtgatacactaagtgattgttgccagtacctggtctcagcagcagctttggggtgaatcatctttgttaggaattagtctagagtcacaagcaatggctcatgcctacagcctctcttgtccagttagcagggacctggaggcactaatgggaatttatgttcctggcttcctgtggctctgccgatgaggccctttcaatgaaagagcagtgcctttcgtgtcttcatgaaaaatgagattactgatttccacccagctagctgcatccaactgttgcttttactttatgaacataggagcaccttgttctatgctcgccagaggagaaggattcttctcaagaagaaagggattgaggatatcaatcaaagactcaatcagaaaccgaatagaatgaggaggatgggcagagaagatttaattagaaatcggatagaatgaggaggatgggcagagaagatttgccagtgataaagactagttaattaggcctctgagcttccttaggtcttttaatctgtaaaatgggaataagaacacatgtatctcagagctattgttcttcatttatttggaaatcacatagaaagcacctgatctaaaaaccaagagggttcataaaataagaatactaacaataacggctattatttgtgaataattatcatgtgccaggtatagagctcatttctttacatgaatatttcatgtaaacctcaacacagtcccatttttcagatttgaaaattgaagctcacagaagttaagtaactaccttttagagcaggaatttgaacccagatccactcagtgctggtattcttaaactctacataattttgcttcccaacctggggcatatatataatagtcatggtttttactagatcaggaatttatatagccctttccatgtgccagcaccataacctttctaggttctgctatttactttagacagtctgtgattttcctaaaattacttgccaacttgtgtaggtgtgaccgatttccataattattctcatattctgaaatggatctataaccggagaagacaaaaaaaaaccctagaatagatgatactaggctttgcagcaacccaggagtatatgactgtaaaaagagctgcttctgacctacagaaacctggaatctggagggaacttaaagactcagacttgggcaggaaggagtaaagaattctaagcaagcacaaactgatggggtataaactgatgctgagagaaggagtatcagggagttacttcttggtatgtagccatgtggggctataccattcaaataaacttgtggccaagtacgcagcatggaaatcgtgagagataaatggttgatgtggcaatttggtctatttaacaaccatgtcccattagattccttgtcgatctcattgattgtgcagaaatgaggcatcaggatggccaaaacctaaataagttacccatgataattagtttattgactccatggagatatggtgcctgtttattttttaagatgattgggccacttcttatcttcttcctaacaacttaccttagaattaagctctccttttgcactgtcaacaaagcatttttaatgtgcctctattatattccagatacattctgtcttgtcttatgtgtacaattgtacacgtctgccactaaattgtaactgagatcgctgagaggagaaaccatatgctttttcatttgttcattatttgcttctctttctcatagtgtttagcttatagtagatgctcaataaatgtttacggtttaaagttatttgaactgtcgaatcgatttgttttgaatcttatttgtttattgttgcaaaatatacacaacataaaatttaacactttaatcatttttaagtgttaaatttagcaacagtacattcacaatgttgtgcaaatatccttactatttctacaactttacacaacccccaaaacaaactctataccccctaagcagttattctctatttccccttcccttcagcccctgataactactaatctgctttctgcctctatagatttgcctattctggttgcagtctgccctctatacccttgagttccatatccgtgggttctgggtctgtggcttcaaccaaccagatagagactatttaaaaattaataataataatacaacaataaaaagtacaaaaagttagtacagtgtaacagcagttacatagcatttacattgtattaagtatcataagtaatctagggattatttaaagtataaaaaaggatatgtggagcgtatatgcaaatactatgctattttatataagggacttgagcattcatggattttggtatcagagggtggtgggagggtgggattctaggaccaatcccctgcagataccaagggataactgtatttcaaatcaatggaatcatacaatatgtggtattttgtgtctggcttcctccattttacattttcaaggttcatctatgttgtagcatgtatcagtacttcattccgttttatggcagaattaatacttcattgtatacatatactacattttagtttttcatttattggtcaatggacatttagggttgtttccacctttgactactatgaatagtgctgctatgaacattcatttacaagttttcatttgaatgcttgtctacagttcttttgaatatatacttaagagtaaaattgctgaatcatatggtaattaaattaaaaaaagatttggtgtaaaaataagtgtattttgtggcagatttcattattacattattgttcgtttcctctaagaggattatatacatacagtgcatttccatgtgactggcagcactgcactgtgggaggctctgtgactttccattttagtgacattggccttgtccatgtgatttgctttggacaatggaatgtgagagacatggtacatgacacatttgggcaagacactttaggagacattgtctggcatggcttttgctcttttccctttatcataagaatggcatattcctgaaaaaaggctgcacctttagcctacatctgaaatgaagaagacatctggagcagagccaaagcacagctgacacgaaatatgagcaacaaatcaacctttgtggttataagccactgggattttgaggttattcgttaccacacagtaatttagcaaaagtgccctaatattaaaacactggattaaataacataaaccacatttatttactgcaggacttctcagtgtcttgactgtgctaatatgtattatgagtctaaagaggtgaattaagtacagagttttctgaatgtatttgggtttgggcatatttgcagatttgtgattctgtggcatacaacttggcaaatgctggaccatatatactattcaggttcaatcctgtacaaaatgactttcccaaactcctctactattataaaagttagagaggtcttcttttttgttcctatgcaaactcgtgcatatgtatgcatatattttattgtcattttacatttataaatctttttctagtgccaaactagagccccatgaggccataaaccatgtcatattcactttttgtatctctagcatccagtatagaactggcttaataaagtggtaaatgaaaggactttcttaatagatgttcaattgagtactttaatttttgcatacctactatgatctagcactgggcttgttaccttggaaagaatgcaaaaaaaagagataaagttattgtcctcaagaatcataatctatagcaatggatccataacaaattatttgctgaagttagtggccaagtcttttagcaccattgttctcttaagaatatctttgtgcctatgtatttttttactcagatctttctgagcacatgtctgtaactactgagatgaaatttaaaaagcctcgtgtctcaagctgtaatattgtgaaagaagatacaggttttgctaatgagggatggctgtagagatggggcatgctaaacatagaagacagaaccacagtcctctctgaaacacattctgtctaaaattgccttcattcaaacacgtactctgggtactcaatactgtgctagatgacagggaaatggtagatgaatgagctgtgttttgcattcaggaagcttatagagtaggagagacatgaacatgagcacacatatgatactgtaagtgtcccattgggatttgaaatatgtgcaaggtgcttttggttgccagcagagagactacctgagaccacataagacttctggagaaaggaatagaaaacagggcaaggtcagaaaataatgtcacttaaacaactaccctgtactaagagctccacaagtgctatttatgttattttattttcaggttcattgacatataatttacatacagccaaatatacccttttgaggtggactcttctatgaatttgacaagcatattcagttatgtaacccccaccacaatcaagatataaaatagctcatttaatttttacactagctttatgaaagaagctttgataagaaaactggggatcagagaagttaagcctcttagcttcttcaaggtcaaacagttagtgagagctgaaggcaaaatgtgaacaggagagaacttggcatgcttggagaacagagataatggtatggcaggatataacaagaaaaagaagggagatgggtaagagaataatttgaagacatcagctgatccagggatcaggtagcacagactcttacaggtaccaaatttggtttgtatcatgacttctgtgaagaagcttatatttaaattgaaccaacctcttcttaaagcttcaagaacatgttcatgttgaaattttatgaaattgaaaaaaaaagtatgctggcttccttatccttggtgatttcataaattaagctatattatctttttttgaagttaaaattctcatttggaagtccctctggcccaacccctctaatcagtataaatcctttctatttttatttatttatttgttgtcttatctccctcactacaaggtaggttccatgacagcaaggattgtgtccttgcctttcctagttccttgtcttttctctagaacctagaacagtgtctgcacatgatggatgccttattgatctttgcttgacaaatgaataaacaacagcacagagcagaatcatagaaaagtcaggttggaaaaaatcttgatggtcatctagtagaagagttggcaaactttttctgttaggaaccagataattaatattttaggctttgtgggccgcatgttctctgtagcaactgctcaactcttttatctgcatggctgtgttccagtaaaatttgtttataaaaatagactgcaggtcaatttggctatagtttgtcaactcctgtatctgttagtataagctaggttatgctgtgctaacaaacaattcctgaatctcagtgatttgccaaagtgaatgcttatttcttccttatgctacatggtggtcacagtactactgtgattctgctcctccgatggcccctatctggaacattgttggacttgtaaaaagagagattgatgagctcatatgttgttttctatagctttgtttggaaaagacacacatcactcgcactcatatttcattggccaaaacatgtcatgtgaacttgtttaagtttggagagtggggatgtgtagttatctctaagaggggacattataagaaggagcactgaatgtgggtcaatgataacccaccctaccacctgccatctgaatctttgatggaaccaagatttgtttgtgccatgtcacctttcaaactctgcttccacacttccagtgttggggagtcctctgctaccaaagcaacctgcttcatcctttgaaacgtctgattgctgaaaaggtgattttattgtgctgaattccatatacctgtatctttcacctaaggattccaaatcttcttaagatcctgcagagcagatgattttatttacaaacacaaaagattactctaaccaggaggggacatttccgaattcttatatcaaggaagcaggaacccactcaccaacccccaggtatctgcctttcctcattttccagagtgtaaatgacccatcatggagacagagctgaacttctgaatgagatcatagccttttcgccctttctgcacagtttcacccggtgaattattgtcttattttcattccactccaatgagctgtcagcgatggatactgtaattcacagcaatagaaacacaaacagatgggtaattgacctgcatgccttcattacactggagttcagcatggctgttggagccataaagtcctttatctgccagtctgaaatccctgggctttcacaaggaaggggatcaggctgactttttgcaaaaggtgcagtccttgctgttgttctcctcaccttgtgcatttcggaaatggacagaatttgacaagcagaacttagtggtacaagacaacagctggggctcctataaagctcagagatatctacagggggcacattctgatacaagaacaggatagaaaaatatttatattcaactaaaatagaacctgtgttttttccttcttcccttggcactgtaagaaatcgtgtatttaatatctaatgaaataggtcagaaaagagcaaatccatcaaaaataccactgtattaggtaattaggatatagaataaaacaaaataaagcttaccaaaaacaacctatgacaatgcatggtctttgccttgcataagaaaggcttagattgacccaaattatgccctctgctatggcatactgagttcactttctttatctacctattcagaccatgctcatgtttcaagattcagcccacatcccacagccattacaaagtcttccatattcattatttccaggcctattttctttcgtcttcataatagatcactgacttattcaatacttgaaatacatttataaaaacctactatgtgccagacacaatactacttttaatgttttaatcatcaatcaaggactttctttcccgttcttgaattttttttttgctttagttttcaatatctgagtaacctctctgtttctttaggaggtgggaagcatgcattaaacctcttatttcctccaacaattcctaatgtactacttgttaaaaggagaaacaagctgagttcctgtcagcaaaagagcagaatcaaagtcagcgatgaagattgggctataatcttcaggtcttaggttcaccttcagcttctgttgattggatcttctttcccagttatcttttccagatattcttctttccccagcctcacagagcatggtcagttgatccaagtgcctgctagcaatatcatcaatgttgttgaaggtctccagagatccaacttgagggtcccctaaagttcttctgttacttgagtactcccagtggttgaaactcaataacacagtgagccccatttttttcctgagtctcagaatcccatcttataatgaataaagatctttcttgtactataagaaatgctatttcctctaaggagctcacagatttctgctttgtgtcacccttcccttcaaaattttgatctcttgtgtgcaagtactctttcttttcttttctagggaacttgtaagcaaacaaacaaaagaagacgaaccttagtcagaaagaaatgtgagggccaagttgattctcagctggaaggagttctatgcccgtggccttttccatgctcttcccgctgtctagactactctttctgtggatccctcatcccctagtgcccttgtatccattaggtctcagcttaaatgctaccccctaggagagtggagagtgcttttaacacccctaatccagtccatgctgagttcattgttctttccctgtgttccctgaaaaacttgtacttctcatagaatactggtttcattgcatccaagcaactagtttacatctctttctctctctctctctctctctctctctctctctctctctctctctcagtaaacagtaagacctacaacaagagggagttgtctgcctcattcaccctagtatccacagcacagctgcctggcacatagtagggcttcaggaatatgtgtgaaagaagggaagcagaaagatgggaagaaagaaaggaaagataaatgggaagaaggaaggagggaagaaaatgaggaaagaaggaaaacaggaaggaaggaaggaaaattaatagaagaaaaatgatggagtgattaaaaacgaagaccaataataattattttaatcctcatataagaaaatgcattcttagcatgttttatactggctcaaatggtgctattcaaggaggatttttcaagaagggttcaagtttggtccaggtaatgaatgtgatctgatatctagttaaatggggggcaacctaacatttgttgaacacttaattatgacagtgtcttggtctgctcaggctgctgtaacaaaatttcacagactgggtggcttacacaaaaggaaattatttgtcacaggtctggatgctgggaagtctaagatcaagtaccagcagatatggtgtctggtgagggagggactgcttcctggcttgtagacagctacaagctgtctcttctcccatctcttccttttcttataagggcactagtcccatcacaagggcaccacccacatgacctcatctaaacctaatgactttcctaagtttccggcttcttataccatggcattgcaagtgagggttttggcatatgaatgtatgtatgcaggggacagggagcgcaaacatgcagtccatggcagccgagttgtggcttaagtttatgccttttctctctttgttagtatacaaggagattggggtttcaacctcatagccaaaaaaaaaaaaaaaaaaatccctgagtttcagggggtataaaacattgccagaggtctcaactgtgctggagccaccacaggggttgtaagccaggtcaccctcgagtgtgtcagaactcaagttgaattcctagattggagtcctggttctgttaccttagttgtgagactttggccaggtcacctgatttttaaattctaacacctcagaagcctcgtgaggcactttcttttcatcttggagaaggaagcgtttaaagttcaaagtcaacacttcctccttgcaggaggaagtgtttaaagttcaaagttcctttgactgttagggtgcagtggcttatgcctgtaatcccagcactttgggaggccgaggcaagtggatcatgaggtcaagagctcaaaaccatcctgaccaacatgttgaaaccctactcgggaggctgaggtaggagaatcgcttgaacccgggaggcggaggttgcagtgacctgagattgtgccactgcactccagcctggtgacagagtgagactcggtctcaaaaaaaaaaaaaaaaaaatatttatttgatcaacaaatgagtgcctggagcctacactgggcttgaccttagtttatactctgggggcccttagagggcagacaggtcccttcttccctagagcctactctctaatggggatgatagaaaaactattagaaataaaacaaattcaaaagataatttcagccaggaattaatcctatgaaaaaaattgaagatgccttttaacctgggtctgggagggtctggattataggacaagggatcaagcagaaatctgaggagagaatattcggtgcacagggaaacgcaagtgcaaagattatgggaggaacaatattgatgtgtgtattgcaggtactgaaaaaaaggcagggtttttctgatgtattctcagtacagaagagaatattaggagataagaggaaggagggaggcaaggaaatagagatatcccatcatgtgacacagagaaagagaaataatatctcagcacacaaagactgtatacaagctacaaaaaatattgtgagatgcacctgtcgaaggtgaattgaaaggaaaaagaatgaggcacaaatcaggaaaagagaaggaagacatcttgggtgttcccacatatacattgcccacatgctctgcagaacagtgaaacattccattttaaattataacaagattattttaatatataaaaagattgggagaaaaatattccatatgttcagtgtgggtgagttgatgttcaaataaaactctcaactattgcctgcctgggttttctaaggcaaaatttatatgcttggcaataacagtagcccttttctctctcattttctcagttttcttttctctctctctctttctctccgtgtgtgtgtgtgtgtgtctgtgtgtctgtgtgttgtgtctttgggaactgtggggacagaatatttcaccccagccggcagctgtatatctttcaaacagtggtttcacaagccaaatccccctccaaattatttatggttcccattgaagcaggcaggattcaggcgcccatgtaggagttcagcactgggcctctttgttggacacaggccatcaggagacgactctgtctgtgactgctgtgtgaacctccgctgccgtagaaatggttatgtaactttaaacagtaatgacattttacagaaaagtgctttttaattgctatgtcttcattgttctctttcgaaattgcccaggagattctgcctccaagacagctcggcatgttctgagtttccatttttaaagagcagccagttttgtattttagctgctcccagaaaacccccaaccccaaacttcatctgttttcagttgcattaaatggggtaggtaatactgccttttgtatccttgccaaatggaaaaatgatttgacgcaattttctataaatgctctccccaaattccttttgggctgggaccaagaatagaatattttatcccctacagaagggagaaagaaaatgatgagcaagctagaaaaatagaactgagaatatagtctgtagagttcctttaagcaacagaaacttaaccccgatccatacacccagttgcctatgggggattgggatcagctaaaaataaatttggctctagaagagaaaatggtgatatagataaaatgactaaaagaattgtagactcagaaagaattgcacactctgaaagaattgtagactcagttcagaagggactttattcttgatttgttttacctcacgttttggtatgtgtgttatgcccttgtacagtagccctcccaaacagtcactcaaacccatacggactcattgctcatcaatgtggagctcactcagtctcacagcagcccgttgttcaactgtatagcttaatctgctagaatcccttccatgcatattgacatatacacctttctcaacagccctgtcaccaatgctggttcaacaggcacagaattctaaaccctcctgcttatcaaagctctgcaaatatgtgaagactgccttttgattatacacccacacctgtttttctttcattaatcctgaaggttttgttaaacctttaaccactttaatcagaggagtggcatcatcatcaatatcgtcatcgtcatcacatcaaaaataagaacagacaacatttattgtttgcttgctatgtgccaggagcttttccagataatttgtaggcattctttcatgtagtcctctcaataatctttgtacatagatactaagtggaacctaacaggcaggctgaatattttgcttgagatgacttaggtagtaagaagaggagccagtgcagccctgcccaggtttttgaccacaccgtgcagtgcagccatgcccaggtttctgactacagcatgcagtgcagccatgcccaggtttttgactacagcgtgtggtgtcctgccataaggcatgctggaggaatcatcttctttcccacaatgtccctctgaaaatattctcttttagctgccatgtgaagacaggttgaaaggatggggcttatttaagtatatataaaacctgaagaaaatggaaaaaagataaaaatctagaaacaactgtgaatagaaaatggaagaaatgctgaccttgttgagcaaatccctgatgagttggattaaggagtgtccctgaagcataaatgagaaaaaaaataatccaaataagaatacagttctcttttacacagtgagtagtagaaccattacctcatattggaagctaaaactgtttgcagctccaaatgaggtggagagaaatgtcctaagcgaaagtgccctaatgaattaagttagcccagatctgtccttctctctgggcaccacagacaatagaccactctgctgacttttcataggtaccagagtagtgctcatgtccaaataaatccttctctatcattggctctctgtattaagactttgaatattcaagtataaagagaggatcatgagatgtaatccagagtgctaatcctgtaaccatgggctggtcacttcctattggtagaccatggcttcctcactgttagagcaaagaagagaaaattaattatctagtgatgcttgtgtctagtgatgtgttagtttttatgttacagtggtcctattaaattatatcactctaattatgttactcgtacccttcaaaactaccaatgtgtacctatgatccacagaataatgtccaaattccctagcatataataaagccctttgcacactggcctctgtccctctctacagctattttctacagcacgagcacctccattcatccaagttcatttcttcactaggaatttccagacacatgatgcctttcctcttttaagaatgtccttcctgttcttcttttaacctagtgttctcttacttgcttttcaaccagcccaaattctgtctcctctatgaaggtttccctgctatctaaacaatgttatttgcagtcttctgctgttcatttgcctcatatggctctctctgctataggtctataaagccatgttatgatgatgtgcgtccatgtctacacctgctgattatattgtaaactccccaagggcaaggattgtgtcttttttttttttttatctctacaggcctagtgcctagctcagaacttgtgtttcataaatagggtttatataaatacttaaggaaagcacttgaggaaataaagaataataaacaataatgttatattttcaataagagttttctccacaaatggaaaaggtatataccatatgtggctctagcctcagtcctactataacagaatagagtatgcctttcagagatggccaaagtcatgacctgagaagtttaagtaaaagtgatgcaactggaagcctcaccaataataccctgtctggatctaggttggcccagaaatatattggttccaatacacagggagaaatgtagcagcttcagattcctatgtatcacctttggaaattgttaatgaaacacctttttttaaacctttctgttttcccttcttgctattctcacacaggtcttcagataatctttcctcagtatctgcaagagaagtttgtccagtcggccttgagctatatcatgtgcaatggggagggggagtacctgtgccagaacagccagtgtcgctgccaatgtgccgaggagtttccgcagtgcaactgccccatcacggacatccagatcatggagtacacgctggccaacatggccaagtcttgggccgaagcttataaggacctggagaattcaggtagagagtctcactcagtgccactgcatgagtggccttgagccaagtctgaaagggagctaatctaactggaattaggactgctgcaagggaaagttcagtgaccctgaccctttcactttggagtgtccagatgcaagtataatagctgtcacagagcaggcactcaataaatctcaactgaataaaattaatgaatagcataatccagtttgtggtcatatgatgtattgtttctgtcgtacccagaagacagaaagaataaatctgcataggaagcctctggagagggaagagtcagaggtagttgtattgattccttgggctgtgtatgtgtgtgtggatatttgtgtgtgtatgtgtttgtgtgtgcacccacacacttctgtccatctctataactagataaacatacctctatgtgtatatttatatgtgcatatgcatagagatatagatatccaaagaatctacagactatcaaagctcaaagtctcttttctggtatcttagttattttctgcctttcatagttcagaaaaatgagtttcaggggtggaaagacagtcatccaagctcctaaagtggatgaagtctgaagtaggatctctaccttcatggacatttgagttttgttggaaagccaggcattaattatgtaaccatgccaatgattaggaaatgtcaaggatacgtctgtaaaaagggaggagttgctgtgaacaaacgatgtagagttgggggtcaatgtggtcaaggaagtctaccttaaaaaagaacagaaatggaagtatctgactatggtgcagatatgagaaggtgattacaggtagaccaatgggaggcacaaagggcctaggagagagatgaccatgatgtgggttaaggagatggtacaagttgtaaaaactggaaatgtgcagatatgccaacatatttagaaggaaaaaatggcagagcttgatgttagattgtctacaagagttgaagagaaaagggatattgaggtgatactcataaacctcctttagataggcatgttagacaacttgatagatgttgatatctttcattgagctagaacaccctgaaagatttggaaagaagaccatgtgctcacttttctataggataagcttgagaatccttgagacttccaagaagagatgccaagcaggtacttaacatataatatgtgctcaagtacctgttaaataaatggactcatgcaaaaaagcattcctgtctttacaacaacattatatttcttaaatctgttataatagccaccttaaaggaagtactaacatttctgaattacagagaagggaacacctcctctataatcctcctgcaagacccagtgttttccctagggttgcacagttagtaaatggcaggattggtaatggaattcctgattccaaatctagtgctcacagcagatttggtaacttaattttactttgtcccccaggcctgaggttccctcatctgataaatgagaagacatgtttgtgtttttaatatttgagtttattcaagtctttagacaagaaattatttgatcaagcaaaatcttacctaggagccactgtgtaccacagataaaagcagagttctatggaatagcatttgaaaataactggtttctgtgaactctaagccctaacccagctctgggagcccagaatgcatcagggatcctgctcctacagtgctgtacagctcaaatggaactgtggatgccttataacgacacccattagtccactgaaaatcctgggagcccataaaagagaaaagttcatgatggaaatgtactatgatgattatttggccccaaacaaaggaagcatttgataaaatgcttttgcagaaagatttggctgattactacaaaaaacaaaaacaaacaaaaaaaaaacagagggaatttaggctatatgcacaaggagtaagactctttagcatacaatccttattcccaaggaaaagaaaccactttaagtggatggatgaggaaacacagaaaactgagatgctgctgaataagctgaacaggccaagaaaatgatttatgtcacactttctccccaaaaggcatacactccctctagatctcctgtgcttctctatttgaaatggttttaccctttaagacaaatccattcatccgtatgtgcatcacagccttgtgcatatgagttttcctttggtccatttttagcccttaaccttcgctactcagcccaggtgatttggagagattaatgaccagcccaaagtaaaagccattggttccttgatggctccagagtgtgggtggccaaatagggcctagtttctatacataaatggcagtctacatctccttgctaggggattcgttgtagtacttctacttttattcaagaaagttggccaggtgcagtggctcatgcctgtaatcccagcactttgggagaccaagaagggcggatcacctgaggtcaggagttcgagaccagcctgaccaatatgatgaaaccctgtctctactaaaactacaaaattagccgggtgtggcggcacatgcctgtaatcccagctactggggaggctgaggcaggagaatcgcttgaacctgggaggcagaggttgcagtgagctgagatagtgccatttcactccagcctgggcaataagagtggaactgtgtctcaaaaaataaataaataaataaataaataaataaataaataaataaataaagttaatgtatttaactcttaaattctattttcttatcagacccaaatttgggttcattgaaggcctgctttcccctttgacatccacggagccctctgcaagataagctttatgttttccatgagaggagagtctagctgtcccaaacagaacagagtcatcagggcctgtctcctgccttcagccagctcactgagtcaatcaatcagtgtagagtcttgtgtcatcctgtcaatcttatgctaccatcaaccgagtactttctgtgtctcaggaactagttaggtagatgcagtcctatgccactatgtcattctcagcatttggattagatactattattcctgttagcagatggggaaactgacgccttgagagaataagggtcccacagctgttcagcactcaagatgtgactccaactcttgcctgtctaactgtctataattaaatgcctgagttttttctaggagtcagagacttctattttttatcaccttttatttactgttttctcctaatgtactgagcctcgggattgccctttttatgtgtcgagaggaaatataatatactaagtaagaacacaggatttggagccagactcaagtcttaattctcctatctactggccatttgaccttgggcaacttctctgtgccctattttctttaaaatgggggctctaaaatacctacctcataggtttgctataaaatatggttatatatgttaggtgattaggactgtgcctggtgcctgtcaagagctatgtaagcattttttaaaataaaatgaaagcataaatgcatagtatacctaaaatgtccttggagcttttataacatgaagtgaaaagtgttaggctgaagatttataatatttatataaatccaaccattggccttttttcctacaaaatgatcaaccccttgatatttttaattttccagggatggggtgatagggattagaattacaacagattggattattagattggaaaacagaaactcaggacacagacctggatcttgtcatttatcagccacgttacctttaagaaatcatcttcccattttgggcttcagttttcctattcatagaacaaaagagctgaactagataatttctatggatgtgccaagttgacactctgaaactcagcatcacaaactgaggcagaaacttttacctgggaggcccaagagtttgtcaccatctcttaagctggagttttttgaaatgtgagttgatgctagatgggacacccatacaacttcaaacaacactggatcaccgggtggggaagttgatccatttcagttctctgtggaacctgcagattacatcaaaaagtttcagtttggtgctagcatgcctttaacacctaacacttgctaattgcctgcatttcaacatgagagcagtcatggaggtttgatttttttagcaggcaacagtgtctgactagaatttattaacattatcttcaacatatttatttttatagctaccatcttctgaaggcatgcaatagtgattttctttggagaattcaataaacattttgttttccttttttttttaatttttttgagacagagtcttgctctgttgcccaggctggagtgcagtggtgcagtctcagctcacttgacctctgcctcccgggttcaagcgattctcctgcctcagcctcccgagtagctgggattacaggcacctgccaccacgcctggttaatttttatatttttagtagagatggtttcgccatgttggccaggctggtctagaactcctggcctgttatccacccgccttggcctcccaaagtcctgggattacaggtgtgagccactgcacccaaccttgttttcaatttttaagtgaaaaacaatgatttgattcaaataacatgttaagtaaatgtaataatatacgaatattactatgaggttggtattccgacgccagaagtttgggaagccctgtcttaagcaagaatgcggtatgcagattcccttcataagaaagcatagtagcttttgccctttctagtaggggcaggacagactaatgcaatgttctatggcccttaagaaaaaaaaattatgtttgcaggcctggtttattggaaagtgacactaagcattcaaggccactttagatgggtgttatcatgcttagcccttctctctcggcctttgtctctcactagatgagtttaaatcatttatgaagcgcctccccagcaaccacttcctgaccatcggaagcatccatcagcactggggcaatgactgggacctgcagaaccgctacaagctcctgcagagtgccacggaggcacagagacaaaagatccaacgcactgcccgcaagcttttcggcctcagtgtacgctgtcgccacaatcccaaccaccagctgcctagagagaggtaagtgttgccaccacctccacctctgcaggcacctacctggcgttagctacattatcttgctgcagagtgaaatgcaatgcagatggtgcatttgtggggtggcaaacaggacctcgcatggtccagaccaacaattttctggattgcctctgggtcctcacctactggctccacattgtttcagattccacattgtttcctgaatgtaccatgaattttcagcctctgtgttctgtctgattcacctgattgaggaggggaacactagccctgatagttatgtggcattatcctggctgttaaaaatatatttcatatttaattttaaaattactgagcaaagccaattttagcatccccatcttaatggtgaaaaaactggattaactaattaatcattcgccaccttatttatgaggtcctttgagcagagccaggagtgagtgacacaaataacaaaatgtaatacaaaatgtcaggagacacttgcggggtcattgagtgcagggtcctcacctgagagagtgtcaccttcagtgcctggctaccttgcttgcctcccctagttccagccatgtcctggatataccgggtattctgctagatggtggagaatacagagatggacaagacagggcccatgcctccatagaattagggtttactactctctcaggggcacagaaggaaggagccaggacttgaatccaggttttttggactctattcttccggggcatttctgatctgcagctggtagttcctactgtagaggtgcctccagggtttctaaaagggcatcacaagacagcaaaagggcaggttggggctctctctccaccctgcttcagacagagcagctctgctcttatttgttgcatatttgggggttctaccttcaatttagttctaagaaaaagatccactcttaaaaagaacaagtccattcacattcacctagcataccctgtgtcagtcacatatttatatatatgattgttaccctgttgtacaaatctggaaatggaagctgagagaggtcaagtaatttgtccaaagctacagtgtaaatcagtggttctcacttgggggtgacgttttccccaggggacatttgaaaatatctcaagacaattttgagtatcgtagcaagggttaggggtattattgcacaggcagttctcacaacaaagaaatatgtgacttcaaaagttgctggtgctcaggcttagcaattctgatgtaagagagacaagatgccagctattttaggttgatgcaaaagtcatcgtggtttttgccattattttttaagttttgccattacttttaagtaacagcaaaaaccacgatgacttttgaaccaactttaataaatctataaatcaaaatcttatcttcctaactagtctgttctactggcactcaacatttaacaacggcagtcttctaccacagtccatccacctaattaccccgatgaggtgcacccttttttctctcgtttttcttgcgtcagagctaatgctgctattccctccatgaagtctttcctgattgtactagccaatacagaaagcttcttattctagattcccactaatctaaaatcctttccttagcatatttctctctctttccccccttatgaaacctcctccttgtacagacattcaaactcatctctgttttccctattccctccaaatttgagcccactgctttgcatctagcttgtgataattatattgttttgtggatcaaatagaatttcttttgccagtttcttgttgcaatgctgctgaagcagggactagaaaaggtcacaaacttactttcttgtcgagcacaacagatgctcagactgctaccacgagcaagtctctgaagaagcttccttttagatccatcacacatctgccatgagacctgcatcgagcactgtgggaaattcagaaatgcacacagcgaacagtgctgtggaagatgtcttgtagagcaggagtggggaggggttcttttatcaatcagaccccatatgtattagtttatgatggttgccataactaagtaccatggactcagttgcttaaacaatagaaatttattttctcatagttctggaggccagaagtccaagatcaaggtgtcagcaggcttggtttcttctgaggcccctttttctggcttgtggatggttgtttttttctacctgtgtttccacgtagtctttcctctgtgtgcatctgcgtcctaatatcctctctctctctcttttttttttttttttttttttgagatggagtctcgctttgttgcccaggctagagtgcagtgtcgctatcttggttcactgcaacctccgtctcccaggttcaagcgattctcctgctcagcctccccttgcgagtagctgggattacaggtgtgcaccaccacacccagctaatttttgtatttttagtagagacggagttttgccgtatgggccaggctggtctcaaactcttggcgtcaggtgatccacccacctcagcctcccaaagtgctaggattatagatatgagccaccatgccctgtgctaatatcctctcttaagaggataccagttatattggattagagctgacctaaatggcctcatgttaacttaattaccactttaaagaccctgtctccaaacacagtcacagtttgagatcctgggggctaggactttaacatataagtttggaggggtatgtaattcagcccagaatattataggaggtagcttttgatcagatctttaggtgaaaaagctgtgcatcccaaggagcaacgaagctcgatgcaaatctgattgaggagggccatgtttgaccatgataagaattcaaacaaataacctctttcagttacggtgattgtcatctcagaaaatggagagtaagatccaaaggtcccaaagacattaggcaggcatatttattaaagttgagtgaaatctccagaacaccaagcatcatcagatatgctaagttcaagggaagactcgagaggattttagaaggagggtagctggataggtattacaagggaagaaggagggacaaagctgggtaataggagtaacactgggaaaagtcaaggagtctggatttgtcctaccactagtaagctgtgtgtccttgggcaagtcacttcaccatgctcagtgcaggtgtctgcatctttgaataagtctctgctctccttctgcaagtcgtcaggtgtaaatagctaaaaatgctctaccatcatgggaccttcaaagaaagagctcacagtgttgccgtctctcctactaaggaggagaaaacctgccctaatcatcatattcttctcacctggagaggatgtctggcgttccaccattagcaggtcactcaattatattaatttgaggaattttgagtgctaggtaccgaggggtaggagcacacagacactaggctctgtggctaattcctctgaagccttcccaggagagatgaacttccttggacgggctgtgggctgcttcctgacatctgaatctgaggctttaatgagtatttctcacaccgcagggcacctctctggcatggagcagtgtcggacagaggtgctaacactgggaaccttgggccacctctagctgagcaagctggtatttgcaaatgaactgattgcatggtttcaatgtgtctgcttgctgaagtctgtggaagatgagtgtgctgagcaggtgccattactgcagcaggtgccacagagatgtttacttgtctcacaaacaggtggctttgttaaggtaaggtgggagagggaaagagggaacaagcacagggccttagccacacatggactggtccgaatcctggctccatcacttaccagacacagagctttatgtaagtcctgcacctcatttgtgaaaggggataataacacttgccttcaggttaagtgtgatgattaagattttaaaatttaaataaccttggtaaagtgcctgaatcagttaaaaggaagggaggaagggagagagtaagagacagaagggaaggagctgtcacttagtatgtgtattctaaaggtcaggcactgttctttagcatcttatatgagattaactaatttcttcctcactacagtcttatgaagcgatactgttaccattcctattttacagataaaggaactgaggcacagaaaggttaataatgtacacaaggtcaataaatgttaatttattgttacttcaaagaaatgttaagatttagatttagtgagaggtcaattatagctgattaaaacttggcttcaatgcttgctagaaacttaatattggctggaaggcaaaaggggtattttggctctctattggtgtaaaacaattcaccccaaaatttagtggctcaaaacaacactatgttattatctattatgaatctgtatgttgacttggtacagctgaggatatctctagttggctggggctcttgtcatctgggggcttgactgggctgcatctccacaatgacactctctcagagccagttgatgctggctgtcagctgggggctcagctggggctgtcactggagtgcccacacaggacctctccacggggactggacttcttgcagcatggcagctgggctcagagagggagtgtcctgagaccaaaagaaagctgtgagacttttacacagcttagccttggaagtcggagagcattatttgtaccacattctgttggccaaaagcctaacctggcttcaagggtgtgagtattgggaggtgcagttcattatgggggcaggggacatatattttggagatgaggtacaatagcaattgagtagaattggagctagaggtgactatcagatatagggaacataagattaataataataacaacaataatgaagcaatagcagttacttactgagcagctagaataacaagcaatagagttgtctatttgtaaagattctggagttagactgccttggttcaaattccaacttcgtcacccggttacattgtaagtctggaggaagttactgaaacctttgagcctcaattttcttatctgtaaaatggagctaataatagtgcctacattataaggttgttttcaggattaaatgccttaacctacataaatttcttaggacagtgagtagaacatggatagcactcaatacatgttaggtattgttcttattctttttcccccaagaactgatagttggcatataaatttcttggcactcagtaattagttacctaatgaaattgagcattggtgacatatattttttatctaatactcatgccatctctgtgaagtagatgctcttggatcatttatgggttagggaactgataaggcagatgtaattaatttatccaaggtcacatgggcaggtaaggagcagattagatttattttgctgactttactgttggacttgatggtcaagatcactgtgcagagcagcaagaatgcatgctgtctaagcagtgggcagtggcagataggagactgcactgggtttgggacgccctggtttagtgtatggtaaagccaaaggcagggtttgctcgtcaaggttgagggtagtagaccaacattgaaatatatatactgtagtgtgctgagatgcaggaaatggccctgaacatggagccctgaattaactctcaagcccaagcagaaacccagaaagacatgttccctgtaggtaaccagaagaggcctggttcagtgcagtccaactcagcatacatttcctgaaagcttactatgtgccaggctttggaagcatgaacataagtaagattcattccactccagcgcccagtgcttgttgagaggacagcaacaagataattccggaccacacctgttgatggggaccagtaatgggtcgaccagatatttattgggtagtcattatatattaggttctgtttgaggatctggggatactgtgatggatttctgttagcccgcaggagagctgaccctagtgtcagactgcagctggacatatcaagggaaggcagggacccacagtaagattcctgtggcttgtcttgccaccaggagatccttacactgtgcagttaaaaagggaaagatggactttaagtttggtctcagctattactggacactgagactttttaagccttggctttatcacttataaaatgggtataataatttctgattgcctatctcagagggtcactgtggggctcaccaggggtagtgtataaatttgtgaactctgaatgctgtagaaagggggctatgcaattgggatgaacttgaagccaaacacatcaggatgggaatgggaatgggctaagttcaggttcatggcaacatttaatagttaacacttctaaagcatttaccatgcaccagccacagtcttatggctttcatcttatttaatcactgtaacaaccctatgaagtagcgctaatttatcccactttatgaacagagaaattaaggcatagagatgttaaatgacttgctgatgattaaatagcaggtagaagacaggcttcaagcccaccagaatcccttcttgttactcctctgctattctaccaatctccgagacaagatgatccaaggtgtttaagtgacctgccaagactaaaaactgcattgcatagtggtggaaattgcctgtcatggcaaaagggagatgaaggaaggacggaagggagggatgcaggagagaaaaggaaggaaaaaaagaagagagagggaaataaggtagaaaggaagggagggaggaagaaaagaagcacaaagtcatcttgggcaatgctgaatttagctggttcctgtgcaattacataaatgtttactaaccaccttatcttccaatctcgtgtcagccactgaaaggcatttaaagatacaagcaactgtgcgttggtcctccaaccatcattatctagcctctgggtgtgctaaaaagacattgtttcatgaagccagagacctaagttcaagtcctattctgtcctgtgtgggctggactaaacctataactcacactctggagagcactgggtacagaaatcgtgccttgcagaggtgaggtacaggttgagtagtgaaaaaattgtacctcaccttaaacgagagcagctctttagcggttttctttgtggaaattctgaattaaaattcattcaagaacataaggtaatttttctttctttctttctttctgttttgctaaaacaaaaacaacaagactcaattatctctgaggtccttctcaactctaagagacataacatttacagagaatgagagtaatagttcaattcaagactattggtagaaggtcagtaattgaatctttgagcagcattgctttcagatgatgctaattagtcaattttaatgagtagcctatagttcaaagtaaaatcttcttttgcctgaaattacaatggccttttaactaagtctcccagaatctactctagtcactttccaatctatgttccatggcagtcagaattcaaattcaatcttgtcacatccctgtttaaaactttttggttactacttactgcttttaggagaaagaacaaaatcctcaggtggctgacagatctgccatgatctggttcccacctaccccttggctgggttccacaccatttcttgtctctctcagtgacaggacagttctgctaattttctttgagttaactaaatgtctaattccacccactcccagtagcccttcatttcaaaggattcacatgggctgctccttctgcttgaatgtgcttccttttttttcttttgttcttcactatggtagcttctacctgcccttcagatctcaggctcaaagattccttcctcaagaacatggtccctgcattgaaaggctgtttcaggacttattttatatgcttccttctcattctaattttccaattgaacccaagttccagtttaccatccagtttaccagtatatcttttttcttttctttcttttttttttttttctttttttttcttgaggcagagtcctgccctgtcacccaggccgaagtgcagtggtatgatcatagctcactgtagtctcaaactcctgggcttaagtgatccttcagcctcagcctcccaagaatctggaactacaggtgtgcaccaccatacctggctagcttatctaatttttttgtatagccagagcctcagtatgttgcccatgttggtctcaaacttctggactcaagtgatagtccctccttggcctctcaaagtgctaggattacagacctgagctactgcacctgactactgttttccctttttaaatctatttattaatgcctatctctcctatgagactatcagcgcacacatacatcttttctatattcttcataactttgttcttataacttcctaccacatgacctgtcacacaatagccattcaaaaaacttgttcaatgaatgcacacatagattatttgcttctccgaatatgccacaaatgcatgttgatataatcttctgcaaattgagttccgtgttcgtatataaagtgtatgtactttctacatatgttgaatatatttagattatcttcctcattcacaaatgaagaaactaagatctaagggaggtaagtgacttttccagggtcactcagggaatttgtgaacagatcgtaaccaaaattcaggccagtaaactgacagtccagacagtttagtaaaattgaaactgcaaatggcgattgtcttcaactgacttgaatccaaatcctgaagttatttcttgttaagtctattactttgggaaatgttccctactgaagaaaaaaaaaaaaaagaagaacaagaaaaacagacactattcaattcaatgaaatgagataaaattcctagcatcaagtaggtgtttaaggtcagtgtgatttgatatttcttacttatatctggctatcacctgggtttttttaaagattagagtattgtgaagcaaataagatccatggaagcttaacttgagggcagacagtagaattattagcattttctgatgatgcttggtctttgatttctttttacttcacaaattcacatggccttgacccagcagtccgagccttagccaagcacaatgtaattacccattgttgagatgaaaatctcttgggggcatcaacttcaggctcagatgctggggccgtagcttctgaactcatgtcagcttttaacatatttccttctccatacagtgtttaattggtgtctatagaaagactctggctaccaagataatcgttatctctattctgatgaccctcaatattcatactgattttgattcttctctgtgaaccctgtacttatttgtctctggatttcatctccatagactcctgcagtggggcggagggatatggcttcttatattttattgaactcaagtcagtttcagtttattagactgacagtcccggctctgtcatttattagatgtgtgacctccaaaagtctccaaacctacctgatccctctgtttccccatctgtatggttaggataataagaatagctaccccacagagttgatgtcctagtcaattcatatgatatatgggaaaattcttcataacttgtaaagaaatatacagatagaatgttaatatattcaaggctgggcacggtggctcatgcctgtaatcccagtactttgggaggccgaggctagcagatcacttgaggccaggagttcaagaccagcctagccaacatggagaaaccccatctctactaaaaaatacaaaaatcagcctggcgtggtgatgcacacctgtaatcccagctactcgggaggctgaggcacaagaatcacttgagcctgggaggcggagattgcagtgagccaagatcacgctactacactcaagcctgggcaatagagcaagactgtgtctcaaaaaaaaaaaaaaaaattaatattttcaagagcacagcagtagtagaccctagatatttgatgacataaataattgatgacaacactttctatttccaagaagtggatgtttctgttgggtaaaataaagcacgagcctatcaaacagaatgtaatcatataataaagaaaaaaagaacttaagaaccttaggacttcagactctctagtctgacagaccaaagtgtgtgactgtcatttactattgatagtacttggcatagtattaaggcattcaggcttcaattttctgcatggcgtgatggagagaaaaatagtagccagccttggaaagccaataatagaacacagatgccagggttaacacatagcaaaatggcaaagcatggggctctttgttggacgaaattggaaccaatagtttgttgggtaattgaaaacgtgaagttaaactaggaaatcctaaaatgtatacatgctatacatatatgaaccattttattttaacttaaaaacatataaatgcacatttcttggccagcctcttgaagtaaagccaaaatcttttttgagggtagtggtatattctatttaacattctactggtgttcctgcataaaccataccataattgcgtaacatttcaaacctcggtttattcaaagtggagcaacagcttagactcttaaaaaacaaatgtttgcagatttttttgttacttcccctttatttaaatcgatagtcatttttgtcaataacttgtctttatagaattttcccactgaattcaaattagtttccacagaaaaaagcaattcacatttcattgatttattttagttttaatttagttatttcataactttttagctatattagaagatataataatagcaaatgcaacgggcataaacaggtttgggaataaacgaaactgactttcagctcgtatgcttgttacttggtggaaatagaaacgtggaaatgtaacccaccagacaagagtgttcagtgctccatcagcttcacacaccacatttatctgatgggaggaagagtcattttcccaaagttacttcatggaggtcaattatgagaacttgtcccacttgacagagaagctgtgattcctagtaacttgcaactcttagtggaacaacttgctcaaggtcacctattatagtaagaaaaaaatgatgataataatacctgtcatacattgaccatttattatgtaccagacagagttgttgatgctttacatatattaatgtgtgtaatccttatgacaaccctatcaaaaaggttctactatgcttcctatattatagacagagtttgagtagcaaagggaaatgctgcaagagaagagagtgagagaaatgcattcctgctggggagactggaaaaaatactttcctctgtccggattactttattcatcctttaattttcagattcatccctgatttcttaggaatatttggtctgactcagtgaaccaagttgcaccatcctattaaatgcctttactgcatcttctgtttcatttttttctagcacttgccatatttgcaatgctgcgtttaaacccagacttcccctacttgaccacaaattcagtgaaggcagataacttgttttccttgctaaccaatgtttcctcagtgacgggtaaagtgcctggaatatcacgacatagcctttgctgcactgaagtgaggggacatttcacatgggagctgagggatgattatgctttgtacttgcagtgaaaagaatgattttccattcaagaaagcaatacgtacctatgaagaatagagtgtgggattaattttatccagaaatgtcaaatcagaaatcagaaacaggatgtaagtcagaattaaatacctgggctttggaaccagaggactgaggttaaatattggcaagcaatgtgctgagtgtcctctgccctgagtgtcctcatctgtaaaataaggataatatctcctccacaggtttattgagaggatcacccaagacacatattcactgttcctagcatgtagtaagtggtcaataaatattagcacttagtgcaattgtccttattgttattgaataaggttagacctttatgttgggaaattatggagggattaaatatctagtggtggagtttgcatcttatcattaaggtgatatgaagccagagggaaaaataatagaagggatgctgtggtttagtaaatgttctctgatagctattagaaagatgaattggagaatcgatgggatctctcttttgggtgtaagaggattcagtatttcttctctgtgctgatatgatctgtggattaaagcactgcttcccaaactgggattggcatcaccgtcacctggagtactttctgaacatagattactgggccttgtgtccagggtttttgattcagtagaactgaggtgggtcctaagtcccaggtgatactgatgccactggtctaagcgccataccagacttggattaagtctgtcttcactgccttaaatatggtcacatctctttctatgcacttggtagaaactaagcaaaaatgagttcccctaagtgaatcctataggactttgaaaaggaggaaaataaggaagtggtatctgtttgaataagtttagaaaatgttgaattacaaaaaaatgctaaataaagaagaggtcaagttttcatatgtttcaaatttatttggccataaaatctttctttttgaagtttttcaagagattgggctcctcaaaacacagctttggaaaaaaaagtggtttacaccagattaagaagctatgacacagattatttggtgtgataccacaggttgtcatattcccttcttgtcagtagagatcgtcatctttcagtaagtcttctttgagttgagtttctaacaccttctgcttaagcagatgctaatggctttgtctccctgcaggtaccacccctgctgagaggtggcacgactgctaaccagcagctgcagaagtaacagcaggaaggtgctccatttctggtataattaggaaataaatttaccccatgtggcttagggacattcctaaccttaaaaagtaaactattaccaagacaaataccttatgtatagattactttaaagtttgcaaagggctttcacactgatgatgttatgtgatcggaataaccagtggatgagttagagtgaggatcagtcggcctccccgtttacaaaggagaaaactgagactgacagaaatgaatgacttgcccaagattataaagtaatactcattatcctgttgccatcctacataggcataggcctcttttcttgtcaaataatatttacattaatatttatactgaatcttcatttattcattcattcatttattcattcaacaaatatttagtgaatactcactaagtgccaggcgggatacaagtggtaggggggtgagcaagacaatgagtgcccctgttcacagacagctcaagatctagaagatagactacctagaagataaaactggcccagaattggtttggcatccatgatttactttagaaacctgaggctcaggaaggctaaatgacctaatattatgaaatcataaaattttgtacctgaaagaaacttaaaagattgtccagtctattcttatcattttcttaaggagtaaaatgaaacagagtgttttgtccagaataactatgttaatttttattatgtagcaaattaccataaattaagagacttcatgtagatttattatgttatagtttccaggggtcaggagtttaggtatggtatagctgggtcttcactttatgcttcacaggctgaaatcaatgtgttggacagaccaggctcttaccagtgggttctggggaagaatccaagtccaagctccttcaaggtgttggcagaattcagtttcttgtggttgtaggactgaggttactgtttccttgctgtttgttgctagggattctatgtgaatggctaggggcccttctccaggccttgcacaaggtcctcttcatcttcaaaagaataaagatgcatggagtccttctcacacttcagacttctccaagttctgccaaagcgagagaaaactctctgcttctaaagggacacatctgattggattaggtccactaagataatcttcctctgtaggtcaactgtgttatgtaaaagaacacagtcaccagagtgctatctcatcaccgttacaggtcctgggaattagagcctggaaccttggggaggaagaaggcatttttagaatgctccctagtacagtagcatagttcgggaataatagaatgaaaaagagataacctgagttctctttggagctcataacatatactgttctgaatatatattgctgtataacaaattgacccaaatttaggggcttaaaataccaattattatattatgttcctgatttgtggatcagtaattcatgctggaagttgctgggcaattgtgttctatgtggagttgattgcaatcactcattggtatttagctgggagcaaagctggcttggaagtccccagaaggcttccctcacatgtctgaagcagagatggccagaaggctggcctcagctgggcagttcttcctttccaaggtctctccgtgtagtcctacagcagagtggccagactgcttagaatggatctcagaggtacaaaagggaattttccaagggataggaggtgaaagctgccagtctcttcaggcccacacctataaactatgtgaatcacttctggcttactacattggtcaaagccactgtaggatcttcccagattcaaggggagagtacatagacctgttgtctttacgggagaaatagcaaaggatttgtggccactggatacatagagtaggtttttcatttgttcatttttccagtgtaaaacattaatttttttgcaagcactttattttttgaaaacaaattgtattgtgtgtatttgaggtttacaacatgctgttatgagatacatatggacagcaaaatggttactatagtgaagcagattaacatagctatcatctcacctagttactttcctgttacaagagcagctaaaatctacctatttaacagcaatccccaatgctgtattaattctgtaaatgtgttcatcctacttatttgttattttgtatcctttgacctacatttctccatttcctctctccctacaagcagagtaaccactatttccattatctatttctctgtctctgtgtatttgagctctttttttcttttccttctgcatttaagtgaaatcatgcaatatttgtatttccgtgtctggattatttcacttacaataatgttttgtagatctatctatgttgtaacaaacagtaggatatcacacttttgaagctgaataatattatatcatatacatatggtcagccttccatatctgtgggttccacatccatgaattcaaccaactatcgataaaaaaaattttaataaaataacaatgcaataataaaaataatacagattttaaaaatatagcattataaccatgtcatagtatttacattgcattaggtaatataggtactctataaatgttttaaagtatacagtaagacatgggtaggttatgtgtgtaggttatgcaaatactatgccataaaaagaaacttgaacatcatcagattttggtatttttggggggttgaggagccagttcccagtagatactgagaaacaactgtgtaccacattttctttatacatttatttgttgataggtatttagtttcttcccttatcttggctattgtgaataatattgcagttaatatgggagtgcagatatctttatctgtgctgatttcatctcctttgggaatatacccagaagagggatttctgtgttgtatggtagttctatttttaatttctttaggaacctctatattgttttctataatggctgtaccaatctacattcctaccaacagtatagaaaggtttccttttctttacaccctcaccaacatttgctatctcttgtcttttttataatagccatccttatgggagcagggcaatattgtatagtggtttcaatttgcacttctctgatgattagtgctgttgagtaccttttcatattcctgttagccatttttatgtcttctgtggagaaatgtctgttcaggtcctttgttcattttttaaattgggttatttgtttttctgctattgagttgtaagagttctttgtaaattttgattattaatctcttgtatgtggtttgcaaatactttttctcagtctgtaggttgccttttcagtttgttaaatatttcctttgctgtgaagaagctttttagtttactataggctcatttatatttgtttttgtagcctgagcttttggtatgatatcaaaaaattcattgctaaggccaacgttgaggagctttctacttatgttctcttctaggagttttttgggtttcagatcttccaatgaggccttttatccattttgaattgatttttgtgtatgatgtaagataagggttcaatgtcattagtctgcatggggaaatctagttttcctagcaccatttattgaagagattatccttttcccatagtatcctcttggtgcccttgttgaaaattagttcaccatttatgattggatttatttctgggctctcaattgtgttccattggtctatgtttctgtttttttatgccagttctatattgttttgatcactgtaattttgtagtataattttaaatcaggaagcacgatgcctccttactttgttcttctttctcagtattgctttggctatgtgagttttggttttcttgagattactttttctatttctgtgaagattgacatcgacatttttatacggattgttaaatcattatattgctttgaatagtgtgaatatgttgataatattaattttccccatccatgaacacagaatatcttttcatttatttgtgtcttctttaatttctttaatgttttgtagttttcagtgcacaagtctttaacttccttggtcaaatttattcctaagtattttttttgtaaatgagattctttttaaaatttctttttcaactaagttatttgtgtgtagaagtgctactcattcttgtatcttaattttgtataattcaactttatttaatgcatttattctaatagttttttgtggggggatctttggggttttctgcatattagaattatgacacttgcaaatagagtttattctacttcttcctttctgatttggatgcttttttatttctttttcttgtctggctactcttgctagtacttccagtactgtattgaatagaagtggtaagagtggacattcttgcctggaattgaatattagtggaaaagctttcagttgtttcctgttgattatgatgttagctgtgggtttttcataaataccctttattatattgacaaacttttattctatagctaaatttatgagttttaacaagaaaaaatgtttaactttgtcaagtacttttttctgtatcaattgaggtgatcttatgattttaatcttttattctgttaatgtgatacatgacacttattgatttgtatatattaaaccagccttgcgttcctgggatcaattccacttggtttagatgtgttgttaaattcagcttgctaatattttattgaggatttttgcatcaatgttcattaaagacattggcctgtagttttctttttttgcagtgtctttgtctggcttagatatcaaggtgatgctgcctcataacatgtgtttggaagtattccctctagctctattttttggaagaatttaagaagtattggtaacaattattttttgaatatttggtagaattgagccatgaagccatctggtcctgggcttttccttagtggaaggtttttaaatattacttcacttcaatgtctttgttagtggtctgttcaggttttctttttcttcctgattcaaacttcataggttgcattttccaggaatttatccatttcctccaggttatccaatttgttggcatataattgttcataatagtcccttatgatcctttttatttctgagacatctgttgtagtgtctccactttcatttctgattttatttatttgagtttccttattttttttttttttagtctagctaggggtttgttgattttgcttagtttgtcaatgaaccaactcttgggtttattgattttttttccatgacttttgtgttctgtatttgatttatttctgttctgatcgtcattatttccttccttctgctaaattacagtttagtttcctcttcttttactaactccttaatttatttgggatctttcttcttgtttattatttattgctgtaagcctccctctgataacttcttttgatgcatcctataggttttcatatgtcatgtttctactgttatttgtatcaagatatttttcagtttcccttttgatttcttctttgacctattggttgttaaggagcatgttcttttatttccacatacttgtgaatatttcaagatttctcttgttactgatttctagtttcataccattgtggttggaaataatactagatataattgtaatattattgaatttactaaaacttgttttgaggcctaacatgtgatctgtcctggagaatgtaccatgtgctctagaaatgaatgtatagtctgctgatgttgaatgaaatgttttatatatgtctgttaggtccatttggtctaaagtgcagttcatgttcagtatattttggttatttttctgtctgcttgatctattcattgttgaaaacagggtgttaaagtcctctactgttattgtatagatatttatttattccttcaggttcattaatatttactttatatatttaagtgctccaatgttgggtgcatatgtatatttatatttgctatgtcctcttgatgaactgatgcttttattgttatacaatgaccgtctttctctcttgaaataatttttgacttgaagtctattttatctaatgtaagcatagcaacccctgttctcttttgactactatttgcaagaaatgtcttcttacatcccttcactttcagctgtgtgtcctttaagctaaaatgggtctcttataggtagcctatagttgagtcttttcttttgtcaatctactcagccactctatgtcttttgattggatatttacagttaatgtcattattgatacggaagaatttactactgatattgggtaattgtttcctggtggtttaatagatcctttttttcctttcttccttgtttacctttgtggtttggtgattttctgtagtgctgatctttggtttctttctttttctcatttgtgtatctctgtaatattttttttctttgtagttactgtgaggcttacataagatattttgtagttataatagaccattttaagctgataacttaaatttggttgcatataccttttacctttaccctccccccaactatttatatttttgttgccacaatttatatgttttatactgtgcattccttaagaacttactgtggctacagtcatttttggtcattttaacttttaactttcatactagagatttgatagatttatatatcactattatagtcatgggatagtctgaatttaattatgaatttacctctaccagtgatttttatgctttcatatattttcttggtagtaattgtcatccttttacttttagttgaagtacttcccattttttttaaagatggggatcttactctgttgtcctggctgaagtgcagtggcatgatcatagctcactgtagcctcaaactcctgggttcaagtgatcctcccacctcagcctcccaagtaggtaggatgacaggcacataccaccatgcttggctaattgtatttttttatgattatttttaaaacttttgtagagatggggtctcactgtgttggccaggctgctcttaaactcttggtctcaagtgatcctcccctctcagcctccacagtctttgagattacagatgtgagccaccatgcctggctctaaacattttttctaaggctggtctagtggcgatgaatcttctcagcttttctttgtctgggaaagactttatttcctcttcatttctgtgctaggtgtaatattcttgattgaaagttttttttattttttctttcagcactttaactgtatcatcctattatttcctggccttttaaaatcatttctatgatgtctttgatattttgattataatgtgccttgtggaggacttctttgggttggacctatttgggaacctatgagctttgtgaatctggatgttcatgtctcttccaagacttgggaaatgtttaacaattatatcgttaaataagccttctatgcctttcttcatctattattcctcttacactcatcatgtaagtacttgtttgcttactggtgtcccataatcccatatactttattcactctttttaatttatccaatttttaaattccccctttactgggctattttaaaacacttcccttcaagtccagactttctttcttttacttgatgtaggcagctattgaagctcttaattttgttttttaattcattcattgaattattcagctttaagatttctctttggttctttttaatgatatctttttgttgaatttctcccagatcttgaagttttattaattttattgaattatctgtcgatattcccttgtatctcaatgagttttgtttttaaagatcattgtcttgaatgcctttttaggcaattcacagtttccattttggaggatttgttattggataattattttgttcttttggtggtgtcatgtttccttgttttttcatgttctttgtgtccttatgtttatatctgtgcatttagtggacaatcaccgattataattttatagaatagctctcatagaaaaagacattcccctgcagatgtgtcctatggtgtcagttgggtaaggtgcttaattctggttctgggtgggcgcactggtgtagccatcatgcaacttcttcagttgtaatcaatgtcagaaatttctgtgggtaccttaatagcctagtctacaagactttgtggcagtggtggtggcaaggtagattgttaaggttattggcaacaagggcttcagggatcctgttgttctcatttttcccacagtgtgaagacttagctgaattgaattcctttcggagttgggtataatataggtaacaggcagccatagtggcactgttttccaggacacaggtgcttagagtggcaatggaactggggtcctatgatcagtgtcttgttgaatactgtggcccatgtgacatgggtgcagctttactttcttagctctcccaccaagcagaggattacgattccaaggcacttcagtagctcaggcccagatggcagcgatgtaaccgtgactctgatcctgggtgtcaggacactgcactggtatggctcccggaaggaagaggtgtttcagtggctcaggttctggggagcaggatacaattgcagtttgggttggagagccagcagggcacaaagacaactcgggcatcaggagagagggtactgcttagtggtgactctggaccctggaatggtgggacataacagctacccaaatcctctgaggcgctgtagaaacaagaaccaggaatggcagggcgtggctgtggcttgggctctagggttcaaatagcagtgcaatattggctttactgcgcattggaggtagggcctctcagtcgtgcatacttcagagggctggtccagatccagggcagtagggcactgtagcagtttgacatagtggacaaggtgatacagatcagccaaggctgtgcttccctgggggtcaggtgctgtgtggactcaagcaccagggttgtggctgctccctgggccaaagctccaattacctgagactagttggttcaggtgctaagtgtgcaaggctgctctgccagcttgggcatggcttttctgctgggctggagcacctggtctccaagggatagaacaccaccagggcttaggcatgcggtcatggctgcttccatgtgtcaaagcttcagtttcctggggccaaggtacaggttacttcaggcatccagaaagtgaggcttctctcctgacttgggtgtggcttctctcctgggccagagtacctggtcgtggaggggcagggtgccaaattgcagctgttccctggccaaagcttcatttccctgggggtggggcaacaggctggtttaggcaatgaggggacacagctgccttaccttcccagacatagcttctccactgggacagactgcctgctccaccgagcctaggctgtgaccctaacatctgagcccaggcagtgccctgggctcaggtgccaggagcagggcacagcaacaaatgaaatgggggagatggagtgcctcccaggcagcttgttccccatgggtaaggaactgcagcagcttggctggggaatggagcactactgtgtatgatcatagtgcaatgatgtcagtgcctcagggatggagaagcgcagtggctactggccactagagaaaaacacactctagcagggctttgctttcaaaatgtcacagtgcagtagcaggttgaataaaagggtcgggagtgggatacaacgtgggcttcttttctggagtagtacagctgtgcaaactccaggcagttccctaaactgggctcagggcccatgaagacttttcccttcagggagagggctcacctggttctgagctaatcctgaccggggagaggaggtagcagagacaagatgttttgtttccttctctatagagtcatcctgcttttctgtgcctcacagggttttcaccacccccttactgtacttcagtgctctccgttagtcactttagtcaaaatttagttgtttgttcattgttttggtccttttttgtgttgggcaacgagtgttagccacctctagtcagtcatcttgctgaccacaagcctgtgataattttagtacaaaggctaatgcactcttcagagatgttgtgaggaaatattttgttatgcaagattgtcctttaaaatctagtcaatcaagattgttgtttagtggatttatcttaaggtttcagccgctgtctaggtgcatattttgttgttgtgtgttgtcattgttcttgttaatgtttttttggtgttcttgaaagctggtttaagtgggggcgaatgtaccataaaatactattattctattatttggagaggggtatagatagtgtgggtactgaatgagggaagggaggggatgctaccagttggtgggtattccagttatgatataatccccaatgtgcattctaggactggggaactaccaccggaagtacccactggacccactgtgagatggacctgagctaaaactccattcatcatctgacttccataaactcttattctgattggtagaccacagtgatattttacatctcctggaattaatgtcagtttagagccagtgtgcaaaagtctttggaaagcattattatttccttttctcactcagtatacagtcacccaggtaagatgttataggcctgtttggagaaggctaggaggaagattaacagtataaattttgggaagtgtgcaggcttcttcctcaaggggaagattctggttctgggcttccaggtactactcgtgtgactgcaagcagattacttaatgtccctggactctgtttctcatctgtcacagggaccaggccttgcctaagtgttatttagctttaaggttctggaattgtcactataaactcataggcagctctccccaggagaagttgctactttgatagtccctgactactgatttttgtgtgcatgcatgtgtggagtggggagcagggggtataatttgagcaaccaagacttattctgagtgtgtattaaattgtcctataaataagaggcacaagcccacaatgtgaagtcaggctagctcagggcatctggctgtcaatcacaagtgcttacaagtgtccttctaactatgtggcaatgaagcttttagctgagaatatcttcggaactttctttctatttatgggcaggaaaaaaaaggtagtgaggtccaaaatggtggcaaccgagggtgtacaatctaggtgaggggcaaggagatgtgtggcagtggctgagcttcactgcgagtgctgtccggggtgtatttaagtcaacactagtaggaatctctccatttgcacccatgcttgttattctgcatttgtagcaagtagggcaattgactcacttggctgatgcaaggcaagaaaataagcatctccagttcctttctgttgtttttggttttttctttttttctccccccctgtggctcggaagtagcttcctgtttggaatagaatctgtaagctcaggggatttagtcaaaaatagacataagtcttataatttctatggactgcttctttttaatcccctgtcagagccatcacccaattctcctgtctacctccaccctccacgtcctgccaacaaactcacgcatgggtgagttttagtcccagtgatgtgacaagtcactagtgaccatcaggaagttacttcccttctctgagcctcagttttttcatatcgttacaatgaaatgatactctctcaacccagcctgggacacaaatcaattgtgaggatcaaaattagagaacaaacagaagagcttcagaaagttggaaagtgatatgaaaatgtcatgttttgctgccttattaatatcattctgattgttttaaaggacaatctttttggtaaatattttactaaagtattacatacgtacagaaagtggaaacaacataaatgtacagtaagatgaatctttacaaagtgaattcacacgtatgaccagcaccagatcaaaaactaaggcattctctgtactgtacagccccccgtgtcttcttctaagccttatcaaccttctccccaagggaattatttttttccactgcttcatccagtgtaggtcagttttgctttatatatgaaatgaactctttgtgtctggtttctttcaccttttcatctttctaaatggagatattcctccattttgttttgttttgtgtagttgtggctcactcattctcaaaaatattttattgtttatatagaattctcttctactgctgatggtcatttgactagtttggcattattccaaatagtactgcaatcttatacatgtctttatatatgccttttggttgtgtacatattaggcatggaattgctgggatgtactgtattcatatgttcaacttactggctattttaatacatacttccagttttctgaatttgttgatgcaagttttgttcctagcagtagcctaggagagtttcaattgttccacaaccttgatgacttagtgcttaccttctttttaattttgtattctaattttattttgccatcctgctgagtaatatatcattgccagtttaatttgcatttttctgatagtgaatgaagtggagattcattgcatattgactttttgaatatgctttttgatgaagtgcctgtccatatcatttgcctattttcccttttggttatctgaattttgctcactgatttgtagttgtttacgtattatcttagtctgttcaggctgctataatgaaataacaaagactgaggagcacataagtagcatgaatttatttttcacagctctgaaggttgggaagtccgagatcaaggtactggtagattggttgtctggtaagggcttttgggttcaccttctacctgtgtcttcacatgttggaagaggcaaggagtctctcttgtgtttcatttatgagaacactaattccactagtgagagctccactttcatgacctaattagctcgcaaaggcaccatcttctaatatctttaccttggaaattgaaatttcaacatacaaatttgggggaggggtatacaagctttcagaccttagcatgtcttatacatacaatctcttgttagctagaggtattgcaaatatattctgtcattgaaagttgtcttttcattctatggtatcttttgatgaatctgttttaatttttgtatagtcctgttaatcaattatcttcttttacggtgagcacttttaagaaatctttgcctactttcataaagatgctcccctatattttctcctaaaagttgttttgttgatgttgttgttttacttttttcatttagatctgcaagccatctgttttgatttaggagtacagaggaagttaagtgtcaagatttattttgtttaatatggatattcaactgatccagcagcatttgttgaattctttcccactctgagtttttaaatctataattactgatttcagagggatcatttactatgtgagctcaagagaaacacagtttatttgcatgagagacagtgtgtacctactatatgttagaaacttaatgcacatcatcttatctgagcctcagaacaaccttgcaaggattgtattattattccattctgtagttgagaaaactgaagcttagaaaggacaagcaattaactcaaggttaaataatgagtagcagagctatgactcaatactcctttttttttctttttggattccaaagctcatgttagctctttcttcttcaagtatcttggtgacagcattcattagaactgtggagactgaataaccaatgagttgaagatattaggctatgatcaactgggctgttttagtaaccaagaggaataattttactgaaggcatttataaagcatagttattccttgccctcagtaacaatcatggttagtaatggtcagtcattacttcttttcactggaaatctctctagagctttgcatattccatcctagctcttaagacaaagtgaaaagtagatgttaccttccccatttgacagataagaatactgaaggtcaaagaggtcaggtgacttatttaaggtcaaatagcaaggccaaatatccaaggtcaaataggggtagagcagggcccagcacttatttaacttactctctcacctgtgatcaccgcttctcactgccaagatcatagatctagatgaccattattgtacttcagggttaaggcccactagaccctgggtagtcccctcttatttcatagctttttggttgaagtctgttattatacagtctaactactgcccaagaagaataaaccactcttgtagccctccaccagggagtgtcctgctgtttttagcctttctgtcacccttgagaagctccgggcgccttccttcacttgtcttcagcacattcatgccccaaagcaaaatgctgaatttgaatatgcagctgatgttgcctgtcacctccttccagacacagaactgtgtaattgcaaaaattgtttcgtaatcctcctcaattaggctcctgacaacctaattttaaagaccctattggattttttacattgatgctcttctccttcttccttcttccatcttcctctgccctctccagtaagacctattaccttcactccacaattgaaaattagaaaatagtttcagcatgacaagggaccgtaacattttcttttggtatttcttccttattattatgagctacttaatgaggctgtgacaccatgtgaagaactgagagaaggaaaaacaggttattaaagcaatgttagaaactcaaagagggtaatgattaaaagctaaatatttatctgggaaaaatagtgaacagagtgagtctgatggccagttataattcatactagcacatccatagcatttctgaggctgttttcagcggaatctcaagtattctgacaccactgacttgacgtattcatctcttataaataccacttctttaacacacacacacacacacacacacacacacacacacatgcacagagagagtcacacacagcacaactaaagaacagcgcatcatcagaaacctaaaaaaacaactgtttgtcttctcagtttagtctgtggtctgtggaatacacattttgtggagtcacagaattacttgggcacccattacagtgtcaaagaaatgccaaggaaaaagcaaagggcataaataaaagaataatgcagagctccaatttcatttttttccatttcctctgtacttttaaatacacactcctggtaggcaaatgggagttatggattatagctttctattttaacctagatctgtttttcttcctctctccttggcactcgatttgtatgatctcccctaaaatgccactggccccacactgtattcccatcttaggcaaaacctccaattaaaatcagcagggagtctgcttgaattaggaaccccagcctgggctccccagccagggggttctgaaagggagatgtgtacctttgaaagcactgatgggaagccctgggtgacggagactgtcctcgaaatgatgagcgactccatgctgtgtcaccaggagacctgtcaggttgccagaaattcctggctgaggcaaagacagaacctgcaggggggcagctgaggtgttaacatggtccagagcctctttcttctccagttgggggtttagagggcagggaatatagagcatgggcattgagggagtattgggtttggacccaagaattctgaactttgctctgctactcccatgctgtgtgaccaaggtgagtcgcagtctctctgtggccttcaatgccctcatcggtgggataaaaatcacaagggaatcctatctcatggggttgatgtgaggataaagtggtaactgccatgatgtagaaaacacttaagaaacactgatttttttgacctcagcaaccaagtctctgtgttcaggcctaaacgtgagaaagaagaacattcccaaggtttcttcttgaagtttccctgcttctaatggtcaaaactgctttattcagagccagtgtgggtacctatcaatcaatcaggctccagggttttccagtttagaaatgaaaatgcaacttccttctttctcctactttctccttccttctctcctctcagccccctatcagaatgaattgaaatcccatccaacagaaagatgctgatttggatgtattgcatctcagctttggctgcagatggaagatgctttggatccttagggacagagaaaagcactttaaaacctgcttctccctgcctcacactgactggctttcagtggggttgtgtcagcctttgtgagaccctcccctctgaagcagcctattaagctgcttctctgttgccggggttgaggaaggctatcaccaactagcctgggaagtggtatttatagattgcaatccctgctatccctgatccccagcatccccctatgcacttgtcgggagccccaattatctgtgagtggaggagagggaccctggcaggtccagaggaagcaaggaatgtgataataggcccttcacaggctcaaactttcagtatttttccgttatttcaatttatttcttttcttgtgtcttgctttcttcttattactcaccatatcattataattttacattatgatacctagaagagagtgcactgataacttatctgagatcacaaaggtactccacattcagataccaaattttgtgatctcagacaagtcatctcacttctcaaggactcatttttctttgcctgtaacatggaggtggtttcatgtgctgttcagggagacagtgtgaagaacctccagcactatgcctggtatacagtgagaactcaatagttgtaagtcactgatgctctcagctggtttaggacactgcctacaattgaaccttgtagagtttatgactatccatgataactactgagagaactggctggagataggggaggtataggagattgatttgattgagggtttttcctcattattgcaatttgcttgtattcaaaagacacacacacacaaacaatgaaatgagctttttgtggttctaatctcaaaatgaaatatggaaaagcaaaagaaagtttgttgacctgggggatcaggactcactggtaacattgctttacctctctgcccccactgtctctgcagttggcctctctagaaagggaggagaatggacaactagcccacccttaaatggcccatccaatagttgaattaggaacccccgcctgggctctttcccaaatctgtgagtgagttaacacagatgatgccttggctgcatctctttgtctctatcctacccactctaatttcattccatttcatcctccctgtccagggtctcctccatagcctgtgtctgctcatttgctccacatttccccaccatctccaacaccaagtccttttctccacttatcacccttccccactctccacctttcccctctgttttctttcctctttccctcagcctcgtgctccctgctccccgtgaacaccacctgctttctaagtcctcttgctgtatcattaatgccttctttgatacagcccacaacctcatgattattctgaggtcaggagatgcaggtgccacgcagctcgcgaatgtatctcagaggccctctgtccccaattcctcctgcctgacagggctggaatcctaatttgccactagccccgttgcttattgcagcatcaccaggaactttcatctttttatttccctcaccgaggattctgagagttcagccacaatgaagcattgattcaaggagtgggggctgtggtccttacaaagggtcccaatgatgagacacgagaaagggggcgctctacggggttatagaatgccttgcagatgggaacagaggaactctaaatggggtactgtcctgtcacttggagagggagtgacaggggcaagtgtgggccatgtgaaaggggcattttgaaatgacgctctcgtcagatggaaccacgcaatcagggccgtgtggagggcccctgcagctcacaaaaatatcagatgactcatacccaatattcagtcaatgttctggtttgggaggtgggagccacatagctcattattattccagctccgtttcctgaaggctgggcctgctgctgttctccaggctgtaataggattggtctcacgaagcagaaactggggaggcctggagctgtgtgggtggatggtacggaaaacgaatactgcagtcctgaggggagaggtagaagtttgtttttccttttttaaatgaaaactaacaagaaaaatatgaatattctttatgcattcattcatcaaacattgattcactcagcaagcatttgtagagccagcctctgggctaggtgctcggagaagaagggacctctcctctcaagcctaagagcctggaggggaaactgacaaagaaacgaggggtttcaatacagtgttttgaatactgtcagggaggttttatcgccaggtccgggtggttctgtggatttaaaaaggagagggtttcaaggagcccactaattattccgccattttttcccagccgataagcaactcatcgaaagcaaagcatgctgggaagccatttcaacagtatccattttcaaatggatataacaaaatggttttcctcaaactccagagcgatagtgaaatccccgagagtgtctcaataccttcaaaggaagagcttattttctgggataagagtactttttattattaccttttccgtaattgctctgtgccaggctcttttaagcactttaaatatattatctcactgaatcctctcaccagctgcctaagatgggctttattatcctcattttagatattgatactgagacttaaaaagagatgaagtgacttgatcccggttatagaatgcagctttgaactcagctccgcttgggccaacaaccatacttttcaacattaggctctactgcctaattaggctcttggtgtttgtggtttggggattgtggctcatcagtggaagtgatagaatagatggattgttaacacttcctaccacagagagtacaatgcaaattagcttctgtttctagttttataaaatgaagatcaggaaccactgagagcatcatcgtcatcatcaccatcaccatctccacagcacgacagccttaggaaaggtgctcttgactctcgcttgacagacaatgcaaaaagccacagctgtgagccaggagactactctgattgtttgtttgactctgagcagtcctttcacccttagcttccattgccatgtctgtaaaatattgctgacagtccctttgcaggaataacaaccgcttttattgagctcttaataagtaccaagtttggggttaagccttcacataaaaattcatataatcctcacatagctctgtgtggtgggaatgattaggaaggtgaagaaaactgcccaacattacctcagcttgcaggtggaggagccaggattttcagctgtctctgactgacctcaagtcccaaggtatttttagggtgttgctgtgaggctcaagcgagaaaattggagtgaatataccctgtgcagggtaaaaagtgctagacacacaagagtttattggtagcatggaagacagccaaagggtgacttgaatggaaaaaaggaaagatgagaggcctctaagctgactgccttgcatatttgttcctactctgatgctgcttcttatctgatggaatatctgtcttcattagaatgttttggtggctgaaatcagattatagactttggtatcatttatagtgttgagggcctgtggggagggggcccagaggctgcaatagaaatcaactgaatggagagtttggagctctggaaaaatgcagggaaataacccccccttttttttattatactctaagttttgggatacatgtgcagaacgtgcaggtttgttacataggtatacatgtgctatggtggtttgctgcacccatcagcccatcatctacattaggtatttctcctaatgctatctctcccctagccccccaacccctgacaaaccccagtgtgtagtgttcccctccctgtgtccatgtgttctcattgttcaactcccacttactagtgagaacatacagtgttttgttttctgttcttatgtttgttagtttgctgagtgtgatggtttccagcttaatccatgtccgtgcaaaggacatgaactcatccttttttatggatgcatagtattccgtggtgtatatgtgccacattttctttttttttttgtcttttttttttttttatactttactttaagttttagggtacatgtgcacattgtgcaggttagttacatatgtatacatgtgccatgctggtgcactgcacccactaactcgtcatctagcattaggtatatctcccaatgctatccctccctcctccccccaccccacaacagtccccagagtgtgatattccccttcctgtgtccatgtgatctcattgttcaattcccacctatgagtgagaatatgcggtgtttggttttttgttcttgcgatagttgactgagaatgatgatttccaatttcatccatgtccctacaaaggacatgaactcatcattttttatggctgcatagtattccatggtgtatatgtgccacattttcttaatccagtctatcattgttggatatttgggttggttccaagtctttgctattgtgaataatgccgcaataaacatacgtgtgcatgtgtctttatagcagcatgatttataatcctttgggtatatacccagtaatgggatggctgggtcaaatggtatttctagttctagatccctgaggaattgccacactgccttccacaatggttgaactagtttacagtcccaccaacagtgtaaaagtgttcctatttctccacatcctctccagcacctgttgtttcctgactttttaatgtttgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccacttgttgatggggttatttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttgtcttcagttgccattgcttttggtgttttagacatgaagtccttgcccacgcctatgtcctgaatggtaatgcctaggttttctgtctaacgtttaagtctttaatccatcttgaattgatttttgtataaggtgtaaggaagggatccagtttcagctttctacatatggctagccagttttcccagcaccattaaatagggaatcctttccccattgcttgtttttctcaggtttgtcaaagatcagatagttgtagatatgcggcattatttctgagggctctgttctggtccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccagtatggccattttcatgatattgattcttcctacccatgagcatggaatgttcttccatttgtttgtatcctcttttatttcattgagcagtggtttgtggttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgaaacaatggggttttctagatatacagtcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatatcggctgtgggtttgtcatagatggctcttattattttgaaatacgtcccatcaatacctaatttattgagagtttttagcatgaagggtggttgaattttgtcaaaggctttttctgcatctatggagataatcatgtggtttttgtctttgtctctgtttatatgctggattacatttattgatttgcgtatattgaaccagccttgcatctgagggatgaagcccacttgatcgtggtggataagctttttgatgtgttgctggattcagtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagcgtatgtgtggaggaatttatccatttcttctagattttctagtttatttgtgtagaggtgtttgtagtattctctgatggtagtttgtatttctgtgggattggtggtgatatcccctttatcattttttattgcgtctatttgattcttctcttttcttctttatgagtcttgctagtagtctatcaattttgttgatcctttcaaaaaaccagctcctggattcattaactttttgatgggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtggggatttagtgctataaatttccctctgcacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgggtgggagtctaagtctctttgtaagtcactcgggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgattctttatccaatttgccagtctgtgtcttttaattggagcatttagtccatttacatttaaagttaatagtgttatgtgtgaatttgatcctgtcattatgatgttagctggttattttgctcgttagttgatgcagtttctttctagtcttgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattctttgctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcaaggagtatctttgtggcattctctgtatttcctgaatctgaacgttggcctgccttgctagattggggaagttctcctggataatatcctgcagagtgctttccaacttgtttccattctccccatcactttcaggtacaccaatcagatgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattctacacgtagttctcgagccttggttttcagctccatcagctcctttaagcacttctctgtattggttattctagttatgcattcttctaaattttttttaaagttttcaacttctttgcctttggtttgaatgtcctcctgtagctcagagtaatttgatcgtctgaagccttcttctctcagctcgtcaaagtcattctccatccagctttgttccgttgctggtgaggaactgcgttcctttggaggaggagaggcgctctgctttttagagtttccggtttttctgttctgttttttccccatctttgtggttttatctacttttggtctttgatgatggtgatgtacaggtgggtttttggtgtggatgtcctttctgtttgttagttttccttctaacagataggaccctcagctgcaagtctgttggaataccctgcctgtgacgtgtcagtgtgcccctgctggcggggtgcctcccagttaggctgctcaggggtcaggggtcagggacccacttgaggaggcagtctgcccgttctcagatctccagctgcatgctgggagaaccactgctctcttcaaagctgtcagacaggaacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaatcaagcctgggcaatggcgggcgcccctcccccagcccgctgccgccttgcagtttgatctcagactgctgcgctagcaatcagcgagactctgtgggcgtaggaccctccgagccaggtgcgggtaatataatctcgcggtgcgccgttttttaagcccgccggaaaagcacagtattcggtgggggagtgacccgattttccaggtgccgtcagtcacccctttctttgtttcggaaagggaactccctgaccccttgcacttcccaagtgaggcaatgcctcgccctgcttcagctcgcgcacggtgcgtgcacccaatgacctgcgcccactgtctggcactccctagtgagatgcacccggtacctcagatggaaatgcagaaatcactgtcttctgcgtcgctcacgctgggagctgtagactggagctgttcctattaggccatcttggctcctccgccacattttctttatccagtctatcattgatgggcattttggttggttccaagtctttgctattgtggacagggctgcaataaacatcgtgtacatgtctttatagtagaatgatttataatcctttgggtatatacccaataatgggattgctgggtcaaatggtatttctcattgtagctccttgaggaatcgccacactgtcttccacaatggttgaactgacttatactcacatcaacagtgtaaaagtgttcctgtttctccacaccttctccatcatctgttgggaaataacccctttctaacatgttctaaaaaaccaccatgaggatcatgtaagatcatcaatagaaatcactacatgatttctagcgtatgataaaatataatttgtttttgttgaagttggtagatgttatacaccctcatgggaggaatctgtaatgggggttgaaacatgtggtttaagtaaacaaataacccctaaggtctttttcattgctgattgtttacaatatgttgtcatccagaaggggtatttgagtctagacactttcatttcctgaatcacacttttctgggactagtgtataatggaatcaaagagctggaaggaccccaaggaacatttactccaaccccttcactttgcagatgaggacattgaacattaggaaggtaaagtacgatgtcatgcagctggtttgtggcattaggaggagctacaatgtagttcttacgtttatattcgatgcccttcctgtattgtcactgctccatccagtcctttcatctttttggcagctccagttcgcattatcagttggataactgtaactcacagacccactcatggtagctaaccttctccaattttcctttatctcccaggacaattcagcagtggcttgcaagggtccagtcactcctctactgtaatgagaatgggttttggggaaccttcctggagagccagcggagctgcgtgtgccacggcagcaccacgctgtgccagcgccccatcccctgcgtgataggcgggaacaacagctgcgccatgtgcagcctggccaacatctccctctgcggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcagtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccacaaaaatttgtaaaatgtaattaatattcaaagaaaaggaggaaaatcttcatttgttggaaatgaaaacgttctagcaactgtataaaagcgttgggcatgtttgttatttctatactcactctgtcatgaagaagggtctcagccttttgtggagcattgagggagttgcttcttaggcctcaggtgctgtattgggggagaagggagaaagcatatgcaatgaattgtaaagatctctgctgtgcaggtgctaagattaaacactaaaaagaaagagagatatatgtaatgtacaactgacactgccatttttcctttttggaggaaatggacatagataaagaagatatttcttcggttaagatttattccctctttatgcttaattaattccttgtgtgtgtttgttttctcttctttttgactctttctcacacaggggtgggaatacagtgacaatgctatcttacccatagggcatctttcattctgaatacattaaaactaatgcaagctggccagtaggtgggattaggagggggtacattcacatagtcacaggacaataagtaattttggatatcagctcatcaaactccttagtttgagaaagaaataataggctcagagaggaatggcatgcccatgattacacccagagttactgcctgaatgagggcttgaccctcactttctgactcccttggcagtgcaccttcttccaaattacactggctgcttttgtattttctccttcaacatagttgccaagggatgaagttttttttcagtctgaggttgtttgtttagagagagagtttgaagaaatttctccccctttgctttctaaaaaaaaaaaaaaaatttaggtttcccagaaattctttctatattaaaggtaaagttagttagttaagttttagtttaaataaaatcagtgaccaaaaaacagggtaagttttagtattgcattggtttgccagacagaattccctaagaagtctaaatatatataatctcctttgataatacatatgcacatctaccacctatacacccactcccgttccccacacacagaaatataaacactgccacttccttggcatctgtgaaagggtgagaggccttatgagggttaaatcaggatgatagactaagaaagacagctttaacttgggggttaaatcaggatgaaagaccaacaaagacagctcatttgaaagcagttctgtaaaggatttggtcaaacatcacttcttagtctccagaaactctgagttcatctttttgctaaggtagtgcttgcaagagcttcctcctgagcatctggatcctcatttctgcattggaagagaaatgcagaatcacaaaattttaaggttggaagagaaaatagaactactgtgatctaaacttctcccagtgcaaatctcttcatcattgggaaatcaccaccattcactgactagatcataccagggacagggagctagctaattagctctatcttccactttctttgaattattaacattatttcacggaagaagagtaatagctcccattccagcttgtgttataaaccagatctaattggaatatccttccatactttgatcagctttgcatatttcacccactggctccagttctgcaatgtgcatttccttcttatggtaatgtcctcctggataaaatacacagacctgtctcagaggttattgaagtctgtgttagcaggacacaaagtgaacaccatctctagtgtagcttattttaaggtgaaagaatgggagggtttcaatgcatagaggtaaagaattatctactttgtctaagtgtgtctgggaagaagattctttttttttttaagaatggtaaattccaactttaatatttcagtttttagtatgaattagcatatgttccataccaactttcacagggtggcatgcactttacactgacataggtatttggacctcagattttgagaaggttcagtgctcatttaggttgaaaatcctttatgccagaggtcacatcacagcttatccatcaagcatgaaatttggcagaaggccagtcaatgaccaaacatttctcaaacacctagcaggtgaatggggcatgtccaaaatacacagatttgaaaggaaatcattcatgcttttgtgccagtcataaactaatgaaaaagacagacacataaaccaatttaaaaaacaacaataattattgtttaccatgatcagtgctttcatgcagtcaggcacacagagaggagccctgaaggaggtgttaactctgtttatggggttggaaaagcctttacagaaaggacttattcattctaagtgtagaa

SEQ ID NO: 15319 - DNA, 18970 bp, Human
actagatggtcttcctgctttggcctatcacacatctaaggtcttaagcctcttcctccccaaagagaacctacagaaggccagcaaatgcagctccatccagaggccaaagaaattagatttggtaagaaggtggaatagacaagatttggccaagattgattggatgaggagtgtgtgaaggagaagaagtcaggaatgttgctggcctttccagcttggggcagctgttgtagtggtgtgtcactcagtttaagagtgacaggtcaggaagaaggacccatgtggaaggtaaagtgaggagttttagttgagagttgctgggtctgaggtgcctctgggatatccaagtggagatgttcagaaatcaactggaaactcagaagaaagacgtggactagaaataatggatttgaggatcattagcaaagagatggtaatgaaaatcggtgaaatcatcctcggagagggaatggagtgataaaaggatcttgaagaaaaccctaaggaacagttaagggaaggagtgagtaagaaaaaaaattgcagagagaacaaaggacaggctagagatgagaggaaaacctacctcctgcaaagttcaagaggagtgacaaactgagaagcatactggattcagcaaagaagtctgcggtgaccttgtggagagcagttttagtggaactttggggacagcaccagattgcagtgggttgaggagtgagtgggaggggaggggttggagacagctggcggggacattttttcgagctgtttggccaagaatggagagagataggatggtaacttcatagaattgggagcttttttttttttttctatactaacggaggagaggaagaaaattcagggacaaaaggaaataataaagccccgggggaagaagcgagatggaatccagtgcacacacatcggattgttcttcagacaggagggacgcatgtgtatgttttaactggatgcaacgaggaaaggattaaattggctggaagcttgattgttgggtagttctcgcttatggatactgtttcctcttggaagacaggcgatgagtaaggatctcgttgaatgaatacatgaatattttcccgtagctagtcaaagtctagggttaccagcaggacagaagaagacactgtaggccgggcgcggtggctcacgcctgtaatcccagcactttgggaggccgaggcgggcggatcacgaggtcaggagatcgagaccatcctggctaacacggtgaaaccccgtctctacgaaaaattagccgggcgttgtggcgggtacctgtagtctcagctactcgggaggctgaggcaggagaatcacttgaacccgggaggcagaggttgctgtgagccgagatcgtgccactgcactccagcctgggcgactgagcgagactccgtctcaaaaaaaagaagaagaagaagaagaagaagacactgcattttaggcaagagtccggtgggaagcaggttgagactgactgagaggaagtaaccatgggagggctgctggtccactgaatgagagagatttttccagaacctcatgctggggctttgatttaggaatccccttcctcctctagtaagtctgccttccctggcctatggcttacgtctaaagcctcgagcctcatcgttcccaccgaggaccagctggaagccattttgattatgctccaccacgaaggaggacaatacagccccgcccagagccaggcgcgcccccgcggcgggccgggtgcgcgtgtccgcgcctcttcccgccggccgggcgggcgcctggcccaggacgcggtggcgtgggacggggggtgggggtggttatgtaagcgttgcgcgctcccgcgaggcgccagccaatgggaggcttcggctactcgtgctcgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgacgaaaagcccaaggtgagctcgccgccggccccttcgcctcgccgcgcggtgggggtcatggcgcgggccggggtccggccagagcccgccgctggctcccagcgctttcccgggccccccacggggccggccgcggctcaggcccgggcgctccgcgccattttcctccctccctctcttcctccctcccgcgccgaaggaggccccgccgctctctcccgcccccggcggcctccgagtgcgcgccgggcgcgagttgggcgggcagaaagcggacgcccgcggacccaccagccccgaacggggattcttggcccagccggccggcgcgcgtgaggaggggcgttagggcgcgcggggtctccaccttctgtcgaccccgcgtcgggtgttgcagtctccgaggcggcgaggagtcctctgggctcgggcttcacctctcgggtaggaaccgcgggcatctggggacccctgcctggggccgcggcggcggggcgagggttcggggcgaatcaatgggctgcggacgggcaggaacctggatgcccgcgggccgccgtcctgggcctgggggtagggggattcccgtggagtatttcccactttaatagcctcaggggcccgaagggggaggggcagcggcttttccctgggtgccaacgaacccctaatccgcgaacaccatgtggtttcatgaagttggaggcacaggtacgagcagagagactttgtgcggcttaacttttgaacgcggcttttgaggcacccggagacttcccgggaggacttggggacacccatcatcggggcacacgggacttgctgcttttagtttggtggcaccccccgcctcccgcgcctttactttctggagcgttttagggctacagaattgcttctgcactcgattttggacaactttaggttgggtcgaaatctacaagaaacaaatcaggataaaactgtgtatttgacccatgacaacaaagggggggaggggagaataagtgctcttaaccgaaaataaaaatgaagctgctaatagaggagaacgttaactgtggtcctgactgagtattaccgctgttccggggggaatcgggatattcttcgattgttttttttgtttgtgtgtttcctttaatggagattggatttaggttattaaactgagtttggtaactttttaatgacaacggtaatgagttttgaatggcaggctgtagatttattgttttgtttcttgcagttgtacttaaagtgcttagaaaagagaagggactctatttttaacttttttggggggtaaagtattttgggagtgatatatgtcattttaggaagtttaacttcaagagaacgttgcaatacactgaataggacccaactttaaacatattgttgctactgatagtattgcatgtaggcttttccgtatctgacagctatctaatactgttactgcaggatttttcctctttcacattgatttcagcagctgaaaacagcagtatgccgttttagcatacagtatgagaaacctgttgatttttgaagcaactagggctgctgctgctttataaaacgtgttcgttgatcacatttcccaaattatacttttatttttcttttaacaggaaggagtcaagactgagaacaacgatcatattaatttgaaggtggcggggcaggatggttctgtggtgcagtttaagattaagaggcatacaccacttagtaaactaatgaaagcctattgtgaacgacaggtgaggaattcatatgtgtacttccactgaataaaactatttttaaaaatcttattttcatgggaacaaaaactagactagcacattacagtgactttttgatgggatgaatatgcacttggcacgtcagttttgtcgtgcacttggtatattgatagctcgtgaaaacccttaggatgatttggttagtattatatgtggttccagtcctgtgccagaaatccatcaaattatatttacaataatttttttttaccaaggaaatgtaattttatgtttataagaaaataagagtgaacttggtaaaattacttataagtcttttattattttattttatttttttgagatggagtttcattcttgttgcccaagctgaagtacagtggcctgagctcagctcactgcaacctccacttcaagcgattttcctgcctcagtctcctgagtatctgggattacaggtgcccactaccaggcctggccaattttttttttgtatttttagtagagatggggtttcaccgtattggctaggctggttccaaactcctgacctcaggtgatccgcccgcctcggccttccaaagtgctgggattacaagcatgagccaccgcgccaaaccaagaagtcgtttttttttttttttttttttttttttttaagctgcgagtctcactctatttcttttaagctagaacttatctaccttgtaaattgtgttttatttttgtttttgtttttgatggagtcttgctctgttgcccaggctggagtgcagtggtgcaatcttggctcactgcaacctctgcctcctgagttgaggctattcttatgcctcagcctcctgagtacctgggatttcaggcgtgcgccaccacgcccggctaattttgtatttttagtagacctgacctcaactcctgacctcaagtgatccgcccaccttggcctctcagagtgctgggattacaagcatgggccactgtgcctggccccttcagattgttctaaataggctcaaaatagaataaggcttaaacctatgtaagttgggaaattgagtttgagtttatacttgaaagatcagtgaagataaaaacttcctttaggcctgatgcagtggctcatatctgtaatcccagcactttgggagactgaggcaggtggcagttgacatcagcctggccaccatggcaaaatcccatttctactaaaaatccaaaaaaattagctgggcgtggtgttacacgcgcataatcccacctactccggaggctgaggctgagaatcccttgaacctgggaggtggaggctgcagtgaaccaagatcacaccactgcactctagcctgggtgacagagcgagagcatttcaaaggaaaaaaaaaaaaaaactttagaatgtttgaagtatttttatgcctagtgtatttacaatgtaataagaaaatactgtgctcataattgatatgtaaaccttcttgtatgtagttccttataaagataccttttttttttttttttttgagacagagtctcgctctgttgtccaggatggagtgcagtagtgcaatctcgactcactgcaacttctgcctcccgagaccaagcgattctcctgtctcagtctcccgagtaggtgggactacgggcgcacgccaccacgcccagctaatttttgtattgtcagcaagatggggtttcaccatattggtcagactggtcttgagctcctgacctcaggtgatccacctgcctcatcctcccaaagtgctgggattacaggcgtgagccactgtgcccagcaagataccatatactcttatttgaagaattttgctgaaatcaccctacatgaacttatgaattgtgttaaataatttataaactggcatcttctatatttgaacactagtgccccttcaggatacaggggaattttaaaaggtaatccttttggagaacttctttagcaaaactgcatacaaaatagaaaatcataggctgggcgtggtaatccagcactttgggaggccaaggctggaagaccagtctggacaacatagtaagacctcatctggtttttttgttttgttttgaggtggagttttgctcttattgcccaggctagagtgcagtggcgcaatctcggctcactgcatcctccgccttccagttttaagcgattcttctgcctcagcctcccaagtcactgggattacaggacctcgtgaaccacccgcctcagcctcccaaagtgctgggtttacaggcatgagccactgcgcctggcccagacctcatctcttaaaaaaaaattaggtggttgtggtggcacatacctgtagtccaggctatttcagtgacagaggtgggaggattgcttgagcttggcaggtctaggctgcagtgagccatgatctcatcgctgcactccagtgtgggtgacagaatgagaccctgtctcaaaaccacaaacaaacagaatcatgcttcagtttggtggttttgaacagtattcttttcttttttttttttttttttgagagtctcgcactgttgcccaggctggagtgcagtggcaccatctcggctcactgcaacctctgcctcctgggttcaagcgattctcctgcctcagcctcccaagtagctgggactacaggtgcgtgccaccgtgcccagctaatttttgtattttttgtagagacggggtttcacaatattggccaggatgatctcgatctcttgacctcgtgatccgcctgcttcggcctcccaaagtgctgggattacaggtgtgagccactggtgcctggccttgaacactattcttatgcatatcttatttaacttttctgcaattgcaaaattttgcctttttttttttgagacaggcttttgccctgttgcccatgctgaagtgcagtgggaggattatgatcatggctcactgcatcctctgcctcccaggctcaagcagtcctcccacctcaggctcccaggtagttgggactataggcttgtgccactgggcgattctttttttttttttttttttttttgagacggagtctcgctttgtcggtcagactggagtgtagtgacataatctcggctcactgcaacctccacctcccgggttcaagcaattctcctgcctcagcctcctgagtaggtgggattataggcacctaccaccgtgctcggctaatttttgtatttttcgtagaaacggggttttaccacgttggccaggctggtcttgaactcctgagctcaggtgacccacccgtctcgccacctcggcctcccaaagtgctgggattacaggcatgaagcactacgcctggcttttcttttcttttttttttttaagatggagttttcctcttgttactgaggctgaatgcaatggcgcaatctaggcttactggaacctccgcctcccaggttccagtgattctcctgcctcagcctcacaagtagctgggattacaggcatgcaccaccacgcctggctaattttgtatttttagtagagacggggcttcaccatgttgatcaggttggctgctctgaaactcctgacctcaggtaatccacctgccttggccttccaaaatgttgggattataggcgtgagccactgcacctggccaccatgcaaattttttaatttctttttttttgagatggagtcttgctctgttgcccaggctggagtgcagtggcatgatctcagctcactgcaacctctgctcctgggttcaagcaattctcctgcctcagcctcttgaataactgggattacagcgcctgccacctagcctggctaattttttgtatttttatttatttaattaattaatttttttttttttttgagacaagagtctcgctcttgcaatggcacgatctcggctcattgcaacctccacctcccgggttcatgcaattttcccccctcaacctccggctggagtagctgggactacaggtgtgtgccattgtgctcagccaatttttgtgtttttagtagagacggggtttcaccatgttggacaggctggtctcgaactcctgacctcaggtgatcttccacctcagtctcccaaggtgctaggattacaggcgtgagccacaatacttggcctttgtttttaagtagatgatggttatatactgtttttcatcccttttatgccactgatacttactgagcagcacctactatgtgcaagggatagactgtgtaactaaaacagtctaggttcctatatctcctgaagtgtgttttttagtaagacagtaagtaattacagatttgggtaagtattaaaggaaattaaaaagcggtgcttttttaaagctattccaggaagttcaagggtgtaggttggggcattttaggtcggttttgttgttgttgttgttgtttttgatattgaatctggtctgtcacccaggctggagtgctagggcacgatcttggctcactgcaaactccgcctcccaggttcaagcgatcctcctgcctcagcctcccgaatagctgggattacaggcggatgccaccacactcggctaatttttgtattttcagtagaggcggggtttcaccatattggccaggctgatcttgaactccagacctcagatgatctgccttggtctcctaaagtgttggaattacagtgtgagcccccgagctcagactggagtctttaaatgggcatttttttcctttaaatttcctgttagtggccagccaggcggatcacgaggtcaggaaattgagaccatcctggctaacacggtgaaaccccatctctactaaaatacaaaaaattagcccagcatggtggcatgagcctgtagtcccagctactgaggaggctgaggcaggaaagtcacttgaactccggtggtggaggttgcgttgaactgagattgttccactcactccagcctgggcgacagagcgagactccatttaaaaaaaaaaaatttcatttccttgtctaactcatttaaatgcatatttgtctcaaggtatgttctatttaacattatagtagctgtgtctgaaaagcagtaaagctttctaaaagaatgacttactggctgggcgcagtggctcacacctgtaatcccagcgttttgtgaggctgaggtgagtggatcacttgaggtcaggagttcgagatcagtctggccaacatggtgaaaccctgtctctactaaaaacacaaaaattagctgggcatgatggcaagcgcctgtaatcccagctactcgggaggctgaggcaggagaaccactcgaacccaggaggcggaggttgcagtgagccaagatcgcaccactgcactccagcctgggcgacatagcaaaactctgtcttaacaaacaaacaaaaacaacaacaacaaacaggccgggcacagtgtcttatgcctgtaatcccagcactttgggaggctgaggtggtcagatcatctgaggtcaggagttcgagaccagcctggccaacatggcgaaaccctgtttctactaaaaaatacaaaaattagccaggcatggtggcgcctgcctagtcccagctaatcaggaggctgaggcaggaaaattgcttgaacccaaaaggtggaggttgcagtgagccgagatcgcgacactgccctccagcctgagtgacagagcaagactctgtctcaaaaaaaaaagaaaaggaaaaaaaatactacatcttactgttcactgaaaatgagaggctgggcaccatggctcactcctgtaatcccagcactttgggaggctgaggcggacggagcacctgaggttaggagttcgagaccagcctggccaacctgatgaaacccagtctctactaaaactacaaaaattagccggttgttgtggcgggggaccgtagtcccagctactcttgggaggctaaggcagaagaatcgcttgaaccaggaggtgtaggttgccttgagctgagatcacgccactgcacttcagccttgacaacagatcaaaactgtctcaaaaaaaagaaaatgaaaatcaccccaaatctttttacctatagggtatgttaacatgttggcaattgtttatttaggtatttctttaatatattcatggttaaatatgcatgtacttttatgtaaatagaattctgtttctcttaatgctgtttattgcttttaaattctcgttcagggattgtcaatgaggcagatcagattccgatttgacgggcaaccaatcaatgaaacagacacacctgcacaggtaaaaaaatctctcctaattagaaaaattaccatttgtaattctttgaacagctgtgtttatgaatttgaacgtttagacactggagtataagttcttgtagagttcagagctttgggaagtatgaccagaggggaacagaaaggaaaataggaataggctcaggaaatgccaatggtttttattcatttatttttaattttcattttaattatttttttagggacagggcctctctgttgcccgggttgaagtgtagtggcctcattatagctcactgcagccttggcctcccaaagtgatgggattataggcacgaatcaatgtgcccaaccccaccagtggtttgtgtttgttttttgtgacggaatctcactccatcgcccaggcttgagtacagtgtcacgatcttgggtcatggcagccctcgcctgccatgcttaagcaattctcctgcctcagcctcccagagtagctgggattacaggcatgcaccaccatgcctggctaatttttgtatttttggtagggatggggtttcaccatgttggccaggctggtcttgaactgctgaccacaagtaatccgcccgccttggcctcccaaagtgttgggattgacaggtgtgagccaccgcacccagccaaatcctcaccattttagttctacatgctgaattgaaattctcttttacgtgtcttcatgaacaaaaaggaactaatagccctaattgccacgtcccatagctttgtttgacagggagagcccctgataataggagattttccagatccttactacaaaacgtgatgctctctgatcctttaactctttatgtaccacttcattttgttctgtcactttctgtaggatcagctggattgtcttctgtggcagaagctctttgtttctttttaccctttcaaagttccattaaatacttccagttttggcctagcagggtggctcatgagagccattttcaagattacaaagtgcttgtaatgccagcactgtgacgccaaggtgggcggagcacttgagtccaggatttcaagaccagcctgggcaacatggcaaaaccctctctttacaaaaaaatacaaaaattagccagggagcagtggtacgtgcctgtagtaccagctacttcttagggtgaggtggaaggattgcttgagcccaggaagtggaggctgccgtcacccaagatggtaccactgcacaccagcctgggtgacaaagtgaggccctctctcaaaaaaaaaaaaaaacgacttccagtcttgtcctgacttggtggctcacacctgtagtcctatcactttaggaaactgacactggcaggagggttgcttgaggccaggagtttaagaccagtctgggcaatatagcaagacctggtctctacaggaaagaaaaagagctgggcatggtagcatgtgtctgtagtcccagcttcttgggaagtttagtgggaggggtgcttgagtccaggagtttcaggccgcagtgagttatgatcatactactgcactccagcctgggcgatagagcaaaactctgtctcaaaaatagaagacttacagtttctgaaacatattttacaatgttgtgatagtagaaatttaaattggatcccatgtacttttgaatttcaactttatcacccagtaaaaactagaaagtgataaatgtggcatgaagcagcacatccagattgtagttttgttgataatctttgaaaattggaaaagcccctgagttgtactgaaaagaagaatattttgaagacatttcaactggtgacagtctctcaaaaggaattacgggccaggtgcacttgttcacacctgtcatcctagcacttcaggaggctgaggcaggcagattgcttgaggtcaggagtttgagaccagcctggacaatatggtgaaaccccgtgtctgccaaaaaatacaaaaattagccaggcatcgccgggcgcagtggctcatgcctgtgatcccagcactttgggaggccgaggtgggcggatcacctgaggttgggagtttgagaccactccgaccaacatggagaaaccccgtctctactaaaaatacaaaattagctgggtgtggtggcctgtaatcccagctgctcgggaggctgaggcaggagaatcgcttgaacccaggaggcagaggttgcagtgagccggagatcacgccattgcactcgagcatgggtaacgagcgaaactcaaaaaaaaaaaaaaaaaatttagccaggcatgatggtgcacgcctgtagtcccagctactcaggaggctgaggcaggagaatcacctgaacccgagaggcggagattaaagtcagcagagatagtgccactgcactccagcctgggtaacagcccctgtctcaaaaaaaaaaaaaaaaaaagaagtctgggtacagtagctcacgactgtaatcctagcactttgggaggccaaggcaagttgatcacctgaggtcagcagttcaagaccagcctggccaacatggcgaaactaccccgtctctactaaaaatacaaaaattagccgggcatggtggtgctcacctgtaatcccatcccagctactcgggagattgagccaggagaatctgggcgggggaaaggtgtcagacagtcgaggttgcagtgagcgcggaggtcatgccacttcactctagcttgggtgaaagagtgaaaccctgtcaaaaaaaaaaaaaaaggcgcaattatggtatgtagccacaaggaggagctaaattctattgataaatgaggctggtacaggaacctcattttttaaaggcatttacagtttcactgtaaaacttcacatttggataattttgttttagtagatagatgacaggcttgtttggttttaaaagaaatagtaaaaagtatctattgtgctatactctcagttattagaatgtatttcctgtctttaagccctccttacccaccactaaaacgggattatctgctatagtagttacaaatattaaacaaggagttatttgtttggatccgtgaccttgaggcattttaaaatcttcaggttgaatttgcaattcattttacttcattttgaagaatttggaattgattcgttttagaattattctcccaatatttgttagatagcaggattgtgataaattaaaacatcttagcaggcctcctgcctccccagcttttttttatttttttatttttcgagacggagttttgctctgtctcccagactggagtgcagtggcgtgatctcagctcactgcaacctctgcttcctgggttcaagcgattctcctgcctcagcttcccgagtagctgggattacaggcgcccaccatgatgcctggctaattttgtttttattttatttgtttatgttgtttttattttattttctgtattgacggagtcagtacaaaattagctgggcatgatggcgcatgcctgtaatcccagctacttgggaggctgaggcaggagaattgcttgacccgggaggcagaggttgcagtgagccaagattgcgccattgcactccaccctgggcaacaacagcgaaactccatcgcaagaaaaaatagaaaaacacaaatgtagtcatacaataagctgctttgctccttggggtgtacttttttttttttttaactgccccttacagagcatggctaacttatatagtcagtgcaccgagttggctgctgcttagttttaaaattgtgtttttagcctaacactgtatctactgtatcttaaagatattttcatttctgtacatgaaaatcttattttttaacggctatatggtatttaatatctgagcatactatgttttattaatttgggttttttttttttttttttgagacctggagtctcgcactgtcacccaggctggagtgcagtggcgtgatctcagctcactataacctccacctcccaggttcaagtgattctcctgcctcagcctcctgagtggctgggattacaggcacctgccaccatgcccagctaattttttgtatttttagtagagacggggtttcactatgttggccaggctggtctcgaatgactgaccttgtgagccaccacgcctgccgtgggttttttgttttggtgttttttgtttttgtttttgttttttgagacagagtcttgctctgttgccaggctggagtgcagtggggcaatcacagctcactgtaacctccacttcacgggttcaagtgattctcctgcctcagcctcccgagtagctgggactacaggcgtgcgcaaccacacccagctaatttttgtatttttggtagaaacagggtttcaccatgttggccaggatgggtttgacctgttgacctggtgatccgcccaccttggcctcccaaagtgttgggattataggcgtgagccccggcgcccagcctaatttgggtttttattgagatttgttttcagtctttgctaagcagtgcagcgagattctttaaacatatcacccttctgtgggccctcgacacagacatattcagctttcatttatttaatttttttgagacagtttcttgtcacatgcaatggcatgatcttggctcactgcaacctccacctcctgggttcaagtgattctcctgcctcagcctcccaagtagctgggattacaggcgtgcaggcgtgcgccaccacgcccagctaatttttttgttttgttttttgtatttttagtagagactgggtttcaccattttggccaggctggtcttgaactcccgacctcaggtgatctgcctgcctcggcctcccaaagtgttgagattacaggtgtgagctgccacacccgcccccccccacctttttttttttttttgagaccaagtctcactctgtcaccggtgttggagtccagtggcacaatcttggctcaccacaacctctgcttcctgggttcaagcgattctcctgcctcagcctcccgaatagctgggattacgggcacatgccaccatgcccggctaatttaaaaaatatttttaggccgggtgcagtggttcacgcctataatcccagcattttgggaggccgaggagggtggatcatgaggtcaggagatctagactgtcctggctaacacggtgaaaccccgtctctactaaaaatacaaaaaattagccaggcgttgtggcgggcacctgtagtcccagctactcgggaggctgaggcaggagaatggcgtgaacccaggaggcggagcttgcagtgagctgagatcctgccactggactccagcctgggcgacacagggagactccgtctcaaaaaaaaaaaaaaaatttttttttaatagggatggggtgtcaccaggttggccaggctggtcttgaactcctgacctcaggtgacccgcccacttcagcctcccaaagtgttgagattacaggagtgagccattgtgcgtggccctagcctttttttctctttttttgatacaggatcttttgctttgtcactcaggctggagtgagctggtgtggtctcagttcactgcagccttgatcttatgggctcaattgatcctcccacctcggcttcctgagtagctgggagtatggacatgtgtcaccatggctggctaattttttttttttttcctttttttttttgtagagatgttgtctccctatgttgcccaggtggtctcggtctcttgggctcaagcaatcctccaatgttggcctccagtagtactgggattacaggcatgagccaccgcacctggctaatattctgctttttactcaaaaactaagttttggctgggcgcagtggctcacacctgtaatcccagcactttgggaggccgaggcaggcagatcacttgagctcaggagtttgagaccagcctggccaacatgacgaaaccccatctctactaaaaatacaaaaaaattagctgggcatggtggcggatgcctgtaatctcagctacttgggagactgaggcaggagaattgcttgaacctgaggggtggacgttgcagtgagctgagatcacgccactgcagtccagcctgggtgacagaaatcctgtctcaaaaaaaaaacaaaaaagttttatctaatagtcataaaaaaggaagccaagtgaaaaattacttaaaccaagtgtgttgatacattaagctatgagacatctaaaataatgaaacttggaacttagtggaacatgtacatgttttcagcatacttaaacccaaaaatcattaattttcagaacttaatcagtgcttttacatttgttttttcttttatgctagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccccattcctttattgtacataaagtaactggtatatgtgcacaagcatattgcatttttttttttttttaactaaacagccaatggtatgttttgattgacatcaagtggagacgggatggggaaaaatactgattctgtgaaaataccccctttctccattagtggcatgctcattcagctcttatctttatattccagtaagttattttgctctcactgttttaacaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaatgagctgttttctttattctgagaaatattaaatagaaaattgaggcttagaaaaaacataaataggcctgcttagaagtaacatttcaagaaggaaataaagctacttggtgtttctgacagactgatactgatgccaaacaaagaataacagttttataaatatcaccttgttccaaaagtttctctaggtcccatgttaatatgcaagtatactagcagaaaaattgggccatagtatcgtggatttccaggtattttctgtatattaagtgaggcacggagcatagggtatagggtagcacatgtggcaaggaaaaagttctgattttgcctttgttgctgataaaacactgaaccattctagcctgcacttatcataagtaaatactccctaacctaaaataaagttttcgttccttattcaaggattttttttttgagacggagttttcctcttgttgcccaggctggagtgtagtggtgcaatttcagctcactgcaacctcagcctcctgagtagctggggggtcataggtgcatgccaccatgcccagctaattttttttctatttttagtcgagacagggttttatcacgtatgccaggctggtctcgaactcctgaccttaggtgatccacccgcctcagcctcccaaagtgcagggattacggcatgagccaccacgcctggcctattcaagaatattgagggacagaaaatatctatatatatccatcctcagaaccttaaatatacaggtcactacagtctttattattttaatttttgtttcttagggtttcttttggtggtggttttttgagatggagcatcattccgtctcccaggctgtagtgcagtggcacaatcttggctcactgcaagctccgcctcccgggttcacgccattctcctgcctcagcctcccgtcttaggtctttttgaaagaggttatgcctctgttgcctagtctggagtggtgcaatggtgtgatcttggctcactgcaacctccacctccaggtcttaagagatcctccctgctcagcctcgtgagtagctagaaccgcaggtgcatgccaccacagctaattcttgtattttttatagagagtgtttcgccatattgtccaggccgggctcaaacccctgatcttaagtgatctatctgccttagcctcccaatgtgctgggtttacaggcgtgagccactatgcccagcccctttttaattttttaaaaatgtttatttttgagatggagtttcgctcttgttgccccaactggagaccaatgacatgatctcagctcactgcaacctccgcctcccgggttcaactgattctcctccctcagcctccggaaaagctgggattacaagcatctaccatcatacctggctaattctgtatttttagtagagaaggggtttctctatgttggtcaggctggtctccacctcccgacctcaggtgatctgcctgccttggcctcccaaagtgctgagattacaggcttgagccactgtgcccggccaaatttttattatttttaaattagaggtggggtctcaccatgttgaccagtttggtctcgaacttctggcctcagtcccttgtcttggcctcccaaagtgttggggtttcaggtgttagaccccatgcccaaccactacagtttttgtttttgtttttgtttttttttcagacggagtcttgctctgtcgcccaggctggagtgcagtggcgcaatcttggctcacggcaagct

SEQ ID NO: 15320 - DNA, 6491 bp, Human
ctcaggggattctgtaagactcatggaagaataatggcgcaaacagcaatattttaatgttagaacggtcctctgaaaagtctgcccgaaacgctacaaagataattgtgcagtaacttctaaaaactctactgggacaggaggcaacaaaactccggatcagcgagagctctgtttatccgagggtgctgagcctcaggccccacggagattcccttttcggcacttggaggcctgaactcaggtctaacctttcgtgtgcgcgctctgatactcaaccaccgttcagtctccggaggctgttacaactgtccccattctacagatgaagttgaggctacagcttagtgttcttggggagggagggagttggggggagagagagacgcttttcctcataaccttaaacaaaagtacttaaacctaaagcaactgaaaaatgattttctttcaacaacggtgtttcctttggggtcaagttctttgatctcatctacaaaaccaagaagcgggacaagtatttttctgcaaattagaacggggcgttcccctcccccatcaccccaattccagaggacgtcaatcacagtggacgcagcaccgcgagcggaaatgcggagagcatcggggctccgcatgtggggcacaatgaaacaagagcagccccggccagaggtccagtaaagcggaaagacggtcccgcccgcacacccctccggaaaactgaagcgtctcctctgacccccaaggtcagaaagatttattacttccttcgagagggcgcagccacagacccactagagagggcgggcagggtgtcggaagccagagaacggcgctccgcgtcctcccaccgctccagggcgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgcacgcagaatccaactctctggcagctctcggcaccgacgagctccagatcccgcgttcgcatcccggcgctttgcgcgcagagctaagccttcggacccgtggactgcagcccccgcgcgtcgcggtaaagcgggtcgcgtctccagcccccgaggcgcagcgacggtgggagccggctcggcgttgggggcgggggcggggccggcgaagggggagggctgcgcggcggaggggaggagccgcggcgacagacggcggcgcgcaccaaccgggcgccggctggcaggagccgcgcagaggctggtccgagcgcgttgcgggcgcccggcgtaaggggagtcgggtagcagcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtgagcggaggaaccgggcagaaccgagggtgggcgttacttaggaggaggaggctgggagggagattggggcgcatccgctcactccgcttcccctcgcaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcgctatggaggtcatctgcaatagtatggctaagacgctgcagacagccctgcagccccctgactggctgcagggccactacctggtggtgcggtacgaggacctggtgggagaccccgtcaagacactacggagagtgtacgattttgtgggactgttggtgagccccgaaatggagcagtttgccctgaacatgaccagtggctcgggctcctcctccaagcctttcgtggtatctgcacgcaatgccacgcaggccgccaatgcctggcggaccgccctcaccttccagcagatcaaacaggtggaggagttttgctaccagcccatggccgtcctgggctatgagcgggtcaacagccctgaggaggtcaaagacctcagcaagaccctgcttcggaagccccgtctctaaaaggggttcccaggagacctgattccctgtggtgatacctataaagaggatcgtagtgtgtttaaataaacacagtccagactcaaacggaggaagcccacatattctattatagatatataaataatcacacacacacttgctgtcaatgttttgagtcagtgcatttcaaggaacagccacaaaatacacacccctaagaaaaggcaagacttgaacgttctgaccaggtgcccctcttcttctttgccttctcttgtcctctttctcctatttcttaccctgtcctccacctgccttccattttgaagtgggatgttaatgaaatcaagttccagtaacccaaatcttgtttacaaaatattcgtggtatctgtgaacatgttaagagtaatttggatgtgggggtgggggtggagaaaggggaagtggtccagaaacaaaaagccccattgggcatgataagccgaggaggcattcttctaaagcagacttttgtgtaaaaagcaaaggttacatgtgagtattaataaagaagataataaataatattctttttaatatttgcctccattactttggattcacctgtgttacttgtcctcagcttcagatagaatctccttcccctccctcgtttccatttttccagtctctttcctgaaaggcagctaaactgggtgggagcaatttttgcctccttggtaataacctgggggatgttttctcacatgtaaatctcagcctgttaggtgtccaggagtgaaacacatctttgtattctaaaggcagaaaccaaacagggcagtggaagaaaaagcacactactctcttcaactttgaacacaggaagaagcaactccttcaggacttgaaggcatttggtttttcattcctcttcagttaaaatggggaaccttgaagcagagaccaatgttttggtcctgaggctggttcagaaaaaggatttttaaaaaaagtatgtaatttttaaaagttctgatgattagaacacagacctcaggaaagtagcgtgaacatactgctggcgatggtagcagcttcgttggtttagcaaagtgacagaagtatctatttggagtgtttttctgaccctgacacggtatgtggaggtggatgaaagcagcgaagtttcatctgagaaccgtaagggttttcccttttcttacttgcttcccatttaaatcagtgcaagagagaatatgaatttataatgctttacttgggatgcctgtggaatatgttgcttttctttatcatgtttcctaaaagtaaatttgcaaagaaagtaacatgctgcagacagtataaggcttcagccaagagcttcttttagatatgataatgaattgtggtaaagaggaaatgaaaatgaactagtgtgtaggattttgaaatttggtattttccagggagaaaaccgttacattttcctgtagtggttatgatgttgtgtcctgaacccatttggtactgaaacattctgcagaatgttatactatgagaagaaattgtgaagcccaaatgggaacaagagacagtgtagttgtatatgacagtaaatacagtacaagttcactatcatcatggttttatttcactgtgattttttatgagatctctgaaagccaacatgcataggttaaatgctgagaattttattttagggaaaagatgataaaaataatctgtacgtggggaatattttaacacacaatgattcttaagtataattaccattgcaatacaaaatctagctacgctggtaagaattccaaggtaaagaagcataaaggtttaaaaaggggtatatttagaaatggattttataacacaatctagaatgcttatttcttaatttactaaaatagtttttagtattgtgtttctgaagccagattacatctataatacattgatcatgttttccatatttttgtggtagtgcctatgctgaattagcttcaccagcagtagaatatttgtaatagatttaatttaagaatactttaaagttaaatgaacaaaataaatactaatattggatggctatagatgaaacagatttaacaggaaattaagagagcagcattaaaaagcaaccactctgaataaaataaccatttataaacaaattttgtgtggcattagaatcagctcttaacaattgcggtgaaattcatgcctagttgttgagtgaaggattttcaagcagtgaattcattcttctttcagcttatctaaggacttggactgtgttaaagtagaattatgatgttttggatcttgtatttaaaacaatattagatgctagatagagcctttgcagctggcagagcatttgtggcctctgctcagatgaaattttaagctaaacaccaacagatcctctgcttgctctgtttgaacagggtttccgttcgtaatcttgttttgtagcagctgcattctctccactctgccactcctgtgctctgtaatttgaaaaggtgaattgttgctcctggagatttgtacctagctgcct

SEQ ID NO: 15321 - DNA, 74790 bp, Human
aagaaagggggcggcgggcgggtcaggatgtggcggagaggacaggaaccggccgggcggagggcgggcgcggcgcggtgcccaggcggcggcccagcggccgggtgaaggccgggtggctctgtgagtgccggtggcggtgtacgggcctggcgcgcagggggcgtgtgagcggcgagtacaggccggggccgcagaacgcatccttgcgccggcccggcggccctgccccggcctcttcggcttggtgccgaccgggccgcgagaggagacccgcgaatggctagcacttagccggtgcgtgggtcctgccgcgacccgggctcccagcacgtggggagcggcgggagggggagggggcggcggctcgggcgagcctgggagggcgcggggcgggtctgcgggaagtttgaggcgggaagagggactcctggaccgggatggaggccctgggagaggggggcaggtccgcgagggaggctgattggagcgcgctggatggatgagtgaggatggtttccaaacctctttcgagtgccgctttaaaaacttagcaggagcaaagcaactgctaaaagacagaggattgaagaggtttaataacttagggtagtcattgtggagacgcttgagaggacacagcgctgtgtgcgcttggagcttcagaactcagggttgtgaaaagggtctcagaggacttattcggataagggagatggaggggaaaggaagttaaaatgtacagagaaagccattttgagggacgaaaggaaggtgaaaaggaaagaacgaaaaggggagtgaactttttaaaggaagaaacgggaaaggcagtttgttaacatacttagattttttaagacttaattgttcagtaaggcactttgactagggttgagattaatatttaacattaggaataaatgttgagtagaacggttactttttagataacctgttcttgcagagtctactggacagtagtctagagaattaacatcctgatccagatgcagactttgctatcattgagttggtaacaatctgtttccctccctctcttgtggaatggaaataatcgtaggagtgaattctctttgctgaggtcggaggacagctctgctctcagttggctgtctcggtactttctggctggggaaggatctgacgtctccttcccccgcttcttcctctccctcccctgccagagatctcctttgtttattcgtggatggcttgtaggtgattcttcagtgttgtactgaaatctttaaaggtggaaatggtgtgtcttggttcattattcttgccccaaattttttacgtaaaaaatcagatatagtgtatattctattaccttttcaatttttttcacaaaataaaaaccaagtgcaaactggttaagtattatttaaatgttatcatcccactatccgtttacctgttaaataacacatttattttgagctatgcatttttgttgagagtatatggtatcttttatttgcctgttcctcccatgggagcgttttcagaactttctcactcaagtgtatgaagttcttggtgataggagtgagggcttgattaaaggtaacctcctcccacccccccccccacttcatttattcgaccaagttatctaataagactccgttatctactcttgggatgtatgcatatgttacatcgtatcaccttgctttaggagtctataaaaacattgttagttgcagttagtctctaaaaatcctttcactccacaaatattttaattttttctgtccgaagtatattagcagtagcatactaaattctagttagcagtcaggagtgtagttattacaagtctagatattttaagtatttaataaaaggcccccacttcttccttaacagctgtagtctaattggcctacgtagatttatacgttttagacagggcttaatttaccttttttctgcaggaaattttgttaatttattaatatattttctttaggtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaaggtaagtaagcactttgttatcaattgtttactatgaagagagttgaaaacttgacttttttctttattgttattgttgttatttagttttcctcataggtagcagagttttcaggttttcctcttagctatccaaatactaaaaaaattctgatatacgaaccttttttcataatacaggttttaattatatttttcattcagatacacagtagatcttaaatatagaaagtttttgtttacttaaatctatttggaagtttatatttgagctaataattaagctggagcatgtataatagatttaaattgttttgactgttagtgaaatttctagatgaaggcaataaaaattttttcactcatctttttctggcattttgtcttctatacctgtactgtccagtgtggtaaccactagccacatgtggctatttgaactcaattacaaaatattcagaatttacttagtcatactagatatatttcaagtgctgaataatcacatgtggctagtggctaccatattggacagcacatagaaaacattctatcactggagaaagttttagacagtgctgagccagacatttgttgaaatattactgtggcccttttttattttcagattggagttttaattatctgtgaaggagttaagagttcttgcttgggtcaagtgtttgcaaagaagattctttaaattctgtagctctcaaattttgagttatctgcacattagtttacaatccatgtagttatatgcattatcatatatagaaattaggaatgtgggcactggagtcaaactgtttgcttaccctatttctacctcttattagttgtgtgaattagggcaaattacttaatctctgaggctctgatttttgccccataaagaggggattaaactattgtttatcttatttaaagttcacggctgggcttgttggatcctgtttgtaatcccagcactttgagaggctgaggaaggaggatcacttgaactcaaaagttggagaccagtttaggcagcatagtgagactttgtctctaatttataaaaaataaaatttaaaaaaaatttgaggattgagatgcttcatgtaaagggcttaaaatattttctgagataatgagcactgaatatttgcttattgtaaccagcatgttttgtgtaacacaggatactatataaaaaaaacattaattacagtgatggagacatgggggtggacaagaaacaggaaagttttggcaattaggaagattaagaaaaaatgttagatagaaaactaaatagtggtatttgtatttgatctgaaacttggacttttctttttctttttttttttttgagacagagtcttgctctgtcgcccaggctggagtgcagtggtgtgatcccggctcactgcaacctccacctcccaggctcaagtgtttctcctacctcagcctccggagtagctgggattacaggcgctagccaccactcccagctaatttttgtattttttttgtagagatggggtttcgccacattggccaggctggtctcgaactcctggcctcaagtgatccacctgcctcgagctcccaaagtgctgagattataggcatgagccaccacgccaggcctgacacttggaattttctgaccttgctagttatactttagtttatcagctttcatacatactgtttggataagcaagaacatcatagagaataaaataaggaacagttatggaaagcagcattattacttgaacaagtattggtctaggagttatacaacctgagttgatgctatctctgcattaattaaaactcatatgattgcctcaactctaaggattgaactgatattgaagtttcattttaattaattacaaagtgcatcgtaaagtttcaaacagtaaagttttactagaatcaccagagttgaggtttaattaaaagacttttgaatctgagctttgattcaaatctctataggtatgttgactactgactatagttaagtaaatagaagagtcatattgtccacccacaattttttttttcttttcttttcttttgagacagggcctcactctgtcacccaggctggagtacagttgtgtagtctcagctcactgcagcctctgcctccacctcctgggctcaaacgattctcccacctcagcatcctgaaaggcgtgcatgccaccacactcagctaattttaaaattttttgtagagatgaggtctcaccatattgcctcagctggtcttgaactcatgggctcaagcagtcctcccaccttggcctcccaaagtgttgggattacaggtgtgagctgccacacccggcctcacattttcttattcatagttggaatggaatggttagtaggtagaaatacctagaggaaacaaaggaaccaaactattcataaaataggagataagactcgagagtaaatcttctagttggatatgcagacagatcatgtgctggtatattctgactacttacctgttccaatattttatatatttttctgccatatctaaagcgaggaggagtaataagtccaatttgatactacaggtgaaaaaaaattaaaccttgtggccgggtgcggtggcttacgcctgtaatcccagcactttgggaggccgagcaggcagatcacctgaggttgggagttcgagaccaccttgaccaacatggagaaatcctgtctctaccaaaaatacaaaatgagctgggtgtggtggcctgtaatcccagctgctcgcgaggctgaggcaggagaattgcttgaacccaggaggcagacggaggttgcagtgagccggagattgcgcgattgcactccagcctgggaaacaagtgaaactccgtctcaaaaaaaaaaaaaaaattaaaccttgcgaaatcaaatttaaggaatcttttacaatgcatactcatcttaaataattgcaaagcatatttctttaattattcggagttgttaattctgctatacaggttttgtgtgcttctgaaaagtgtggttatcaagttatctagtttttacaactgccttggagtttatcaggagagagaccttcttttttgccttcattttctttcttaccgctgctatactatgctctactgtcattaacactcaattcccactcccttccccagaagcttttgtcataagacattacaaagaagggagattgtgcctagttaaaagactgaggaggtgaactttagaggtagagggattttcttgcaaaaaaaactaaagtttctataactatgaatattaatatagagtaattttttttcttttttttgagccagagtcttgctctgtcgcccaggctgcagtgcagcggtatgacctcggctcactgcatcctccgcctaccgagttcaagcaattttcctgcctcagcctcccgagtagctgggactacaggcatgcaccactgcatccagctaatttttgtatttttagcagagacggtgtttcgtcatgttggccaggctggtctcgaactcctgacctcaggtgatctgcccgccttggcctcccaaagcactggggattacaggcatgagccaccgtgcctggcccctaatataattagattagaaatatactttgtttctaaagttgatattcattgtaagtagctttttaaagtaaattttggttttttagtggctagaattctataatgtatttttgcttcaaaatttcctttttcttttgtgaaagtttattaaacggaatagaattaagaaagaattcatttggcatttgcaggttacagttagctttctactgaaaaaaaaaatttttaactattctttctgtctggagatctctctataactattcactgaaaggaagaagaatacacaggaaaaatatgtctcttttgctatgctattgctgacagtcttgaaatttagttactaagaaatgtgggccaggatgcacctgtataacagttacagctcaacacaaagttttatgtaactgaagttaagctttttaaagataatgctggaagatttcaaagcatcaatttgcagctgtgtggatttgtggtggtatttgcaagcaaatttttcaaatcctggtagacttttttttagtgtgtgtgtggtttgtttttttttaattgagatggagtctcactgttgcccaggctggagtgcagtagcacgatcttggctcactgcagcctccgtctcctgtgttctggcagttttctgcctctgcctcctgagtagctgggattataggtgcccgccaccatgccccgctaatttttgtatttttagtaaagatgggatttcaccatgttggccaggctggtggtcttgaactcctgaccttgtgatccacccacctcggcctcccaaagtgctgggattacaggcatgagccactgcgcctggctgactttttttagttttaaataagttatcttgagtgatgatttacttcaggaatggctatatggttaaagatcagaatggtgtatgagttacctttcaaagattacttttctgtatgtagtcataatgtgtgggcaaacattaatgtgatgttaccccttttactctgcttaagtagctgcttgtttaagatcttgatgactgattggttatatatggtgcagttttgtgttttaaaatgagtattactttatgatgaatggagaaaatgtttaacctttttttaaaatgggaaatatttaaaactacagaaatagaaaagttgcaccagttgtggtccgtggaccagcggtgttggcatcatttgggagcttattataactgtagaaccttgtgcctcgccccagacgtactgaatcagaatcttcattttaacaagattctaagtgattcttatgtattaagttcatatacatttatatgaagctattcatctggagtcatagcatcttgccactttgttattgatgttgttatacatggttttcattctctgcgaacctccaattaattgtgtcttgagcaggactagcaagaggctaggtaagtttcgtttctccggaagcagtaacaatggcaactgatgattgttgagctcttgctgtgccttaacctagcatgatgcacatagggcattgtgcattacttgaattgtcacagttcatcctcacaaaacttctgtgatgtatacattgttatgattcccactttccagatggggaaacaagatttatagccattttatttatttttttattcttttttaaaaaactattacctaaactctatacttggatttcattgatttttccattaactccctcttttctgttgtaggattaaatccagagtgccacattgcatttagttgtcacgtctccccagtctcctttcatctgtgagagtttctaagtctttccttagttttcatggtctaaaccatcttgagaaatactggccaggtatcctgtagaatgtttttgaaatctagatttgtctttttttttttttttttgagacggcgtcttgctctgttgcccaggctggagtgcaatggcacgatctcacctcactgcaacctccgcctcctgggttcaaacgattctcctgccacagcctcccgagtgactgggactacaggtgtgcaccaccatgcctggctaatttttgtatttttagtagagacagggtttctctgtgttggtcaggctgatcttgaactcttgacctcaggtaatccacccaccttggcctcccagagtgttgggattacaggtgtgtgagccaccacacctggccttgtctattgttcttaggataaactagggttattggtttttagaaagaataccacaaagataaagtgtgctagtcacatcatatgggaaacatgttatcctcatgacattactggtggtgttaacctctcacttggtcaaggtagtatttgcaagtttctctactgtaaagttactgtttttccctttccataatatattctttggaagcaagtcattttgtctagcctactttcaagagggttgggataggaattaaattccatctcctggtggggggagtatttacatatattaaatggaatttctgtaaggaaatttctaaatcgtttatatatgtatggatttatgtatgtgctttgagttgtaatccagcttagtggattacaactctataaaatatatatttgtatatatttatgtataataggtattttatgtatctattgtataatagttgacttttttgttacttaaattgatctagccttggctcttggaagcttttttaggttggctcgtatgtttcttttacacactgccttacttttaccctagaatcagccactctccaaggagccttggttccatttttttggagaatggcattagaaaccaagatttgggtactgggtgtgcttgttgatattcaagtgtcactgcttttatttcctctcagtgaacaaagtagacagagctaggtaatatatgtagatatattatgtatacctacgtatctatagtcatttctgtatccttacgtctgtatacatattatctcatacataaacgtgagttcataccgatggctccaactctaatcctgtgctatagggttcattctaacctttctttcttattgctttgtaacttccttactcaacattgagaaacctggctctgaccatccaccatttatctgcttatatattcactcataatatacatgtaaagcagttttagaatttttaggatatactttatcaagagaaactaatttcgcaactaaaatacggtgtttacatacagtacactttaatatttagcctttaagtttctagtcaaaacactgttttctgatgttggtcaagttcatttttctctcacccctttgagtgtaattatgtgataaatttataataaaattagattcatttgtcacaatctgcattccatcctgtgatcatcatcatactggttgatttttaaaatttgcatatattaatgcttattcaatgatgcacagttctttgggttttgacaagtgcatagaatcattttttctgtactccagtaatgtacagaacaattccttcatcttaaaaggtcccagatctactgagccagaatttccattttaataagattcccaggagaattgtattcatgttaaattcatatgcatgtatatgaagctattcacctgtagtcattcagcatcttgccatgttgtaaagttatacattaacttcaagaaagattattataatctaggggtgataatggaatagccagtttaaatatgcaattgagtatattcaaatttgtggggccaaatgggcatgcaagtgaggtaaaaagaaaatggagggtagattactagagtcatttaatgagctatttggaaagttttcatagcatgctttaacttttgtaattttcataatgatgagaaatgtagtttgaaaagaaagaacaaatgatatatattcagaagggtgttggagaggaagtttttttttttgtttttttttttttttgaagagtcttgctatgttgccaggctggagtgctgtggtgtgatcttggctcactgcatcctccaacaagtgattctcctgcctcagcctctcaagtagctgtgattacaggcacgcgtcaccatgcccagctaatttttgtatttttcgtacagacggggtttcaccatgttggccaggatagtctcgatctcctgacctcgtgatccgcccgccttggcctccctaagtgctgggattacaggtgtgagctcccgcgcccggctcaggaagatgtttatggaagtcatagtcccccattaaagaagtatgcaagtcccctaataaggagaatgtatttgacatctagctttgcagttctttacctgaggtttattcattgttaaaagtttttggccaggcgcggtggctcacatctgtaatcccagcacttttgggaggccgagtcgggtggatcacaaggtcaggagatcgagaccatcctggctaatatggtgaaaaccccgtctctactaaaaatacaaaaaaattagctgggcgtgttggcgggcacctgtggtcccagctactcgggaggctgaggcgggagaatggcatgaacccaggaggcagagcttgcagtgagccgagatcgtgccacggcactccagcctgggcgacagagcgagactccatctcaaaaaaaaaaaaaaagtttttctgtgacttagttccaggtgaaggaaggaaaaaaaaggaagcatagcagaaaaaacactgccaatggggactgtattccccacgtgaatgggttggaaccactagttttagggagagattccaggaatcttgtaccagaatcaacttgtatatatgactgagaaaattagtgtttatgattgaaaatatattatgtatcactatggtatgaggtgactgttgagtcagaagtcaactttaaatgttaaattgcactcagaagtttctttggtgtagatagattgagatctaagttattgagattaaaatatgtagagacaaagctggagatgtgcaaagttctattcaaacagtactgacttctggaattcagtgtctacagtatctctcagaactgaggcataaggcacaagaatagcggggtactcttttcttaatgagaatgactccaaatagctatttctcagttccactgttgttgctttcagaaatacaagtgtttgttttcagatagttatttagatgattgagcaactactacgtggtagatatcatgggattctaaaatttgagttcctttaaagcttataatcaagaaagagataaaagtcttcaaaaatacatgtatatgtcaggtggatactgtaaatgcagagagatactaaaatctgtggccaatcaaatgtaggagtgaagtttgatcataaggacaagtatcaagcccaatattaattaagaggttgtttttttttttttttttttttttttgtttctttgtttttggagggatgggcttaaaaccatgataatcttaaatttcacgtatgttaaaaatgtcctggtgatgtgactttggtggtaaggcatttagacaggcttaagcaaaaagcagagtgatttaatttttatactaaggaaaagtatgttagtaaaagctaatgagtcctaggatcaaaagtttttatgtcaaggcatggggccattggagaagagtgaagtaacattctaaattcctacaagcctaaaacaaggagtctttttgtttttatgcttgagattgattactattacttctgtaatactgttttcacagttctaaatgattcagtcctcagttacattagtaaaaggcagaggtcggatatgaaaggaaaatttataataaaagaatcagaattagttgtataaggggtaccaaaatttctaatcatcttttatctattccagttttagaatgtattttatagtgaaggattaacccattgtccaccctagcatctggtacatactacattgtttatttcacattttttaaccaaatgactcacaataaaggcagttttttcttaggtgcagtacacacccataggtatatgcagacagatgaaatgccacataacaaataattttgtttaaaattacatattgctggtaacttcatttttttgtggcagtattcattaaagtaatttaaaagcatataaatatttttaaacctttttttttttttttttttttttttgagacggagtttcactcttgttgcccagactggagtgcaatgttgcaatctcggctcaccacaacctctgcctcccgggttcaagcgattctcttgcctcagcctcccgagttgctgggactacaggcatgcactaccacacctggctaattttgtatttttagtagaaacaggatttctccatggtggtcaggctggtctcgaactcctgaactcaggtggtccacctgccttggcctcccaaagtgctgggattacaggtgtgggccaccacacctgccaaaaccttttttaaaaagcaaactaaatatcaataatctctttaaaattgaacttttatttatttattttttaagatggagttttgctcttgttgcctaggctggagtgcagtggtacagtcttggctcactggaacttccacctcctgggttcaagcgattctcgtgcctcagcctcccaagtagctgggattacaggcatgtgccaccatgcctggctaattttttgtatttagttaggacggggtttcaccatgttgattggactgctcttgaactcctgacctcaggtgatcgacccacctcagcctcctaaagtgctgggattttgggtgtgagccaccgcgcccagccaaaattgaacttttaaatgtaggcattatttgcgttaacttaaatattattatgaataatttgaagtttatattaaagtactgacagtagtaaaatgagccccatgtacacaccatatagcttcaacatattttatttcatagcccaatctaatttaatctcttaactcctgttaccctctcccacctcacttgattttttggaaacataatttctctatgtgttagacttctgcctgaaaaaagtcattaaggtttgccttgttgttgtaactataaattagagaattagagattttcattcatgtcattgatactataataaattttagatgtatgttaggaaactatttttcagtgacttttcagtgtatatatccatagcccttatttctcatctgctcattctctgcttactagaaaatatttacttttgagtttatcctgggttcaacacaactaagtaatcatctttgaaattagtcatgttaaaagttactcttcctagtatctctccacttttaacagttttaaatttcttcagttagaaactttaaggagatagaatcatattgtactttaagcagagtttataatacagttttgtcttggattgatagtttagaatgctgaaaggaactgttgttttgctggtcagtgcttaacaaagcagtggaactacctggttttcagagttgtacaaatgagaagatgttttccaggttttctgaaaccttttatagtttttatttgtactatttcatcaaactttgtatttatgtgtgtgtatacttcatcatgatgtaaaatgtattatataggtcatggtccaaaaagtttgaaagccgttgcttgactttggccactaattgtttttttgttgttgttgttaatgtttagcattcagtcattacctactactttccagattctttctacagtcatgctaaagtggacagtggtctataaaataactaaaataaaggtcctgacttaatgatcttcaagacctagttaggagagatatatgtataaaaataattgtaatactgtgaaggaattattagtaacatgagcaaagtattgtgggaacatgagctagggcaatgatctgtgcctggggaaaccagggaatggctacctaaaggacatagttttgaatagtcttattttttaatagtcttgaagagtgaaaagttttattgattgctttggagagaaagcattctccagacagagggaaaagtatggagaaagataccgttgctgaattctgaaatcactccctataaaaccatacatgtaattgcatttcccccatttccagttcctcagtcaggaatcggaccagttgtattttatctttttactttcacataaggtattttttttttctatggcattttgttcccaatagaaactctagctcagtactcattagttgaagagatgagcaagtgagttaaaattgtgtatgtataaaacctgttctttccaaaatgtttatttcacaaatgttagtacagtgtgttagctagagaaacagggtactatattagagaactaaaaacacaggggcttaaatataactacttctctttcactcctaggtaagggagttcaaacctttggacagccttactcttcttaatgtatggcttccaatactagtggttgcccttttcagctagcagggagaagatgcaaagggggaggatttaaggcaagccacttcatttttaaggctgtgatgtagaaatcacacatcaccatcacttctagttgtatctcattggccagaacctactcacatgactacactgagctgtagaagatgctgagaaaggtaatctttagctgggtgggcatgtgtcaacctaaactggggggatggttgttttactagaggacaaacaaaatagatactgggtggatagggaggggcacattttctgccacaaacattaaggaattttttaaaaaaaaaactactactctcatcataagaaatgagtggcttttttctgaacttcctttcagttctccatatatattcgtaacttgtacacttgttattacagtgttggcatttgtttacacagccttctctgagcttgaatgtatttgtattatgaaaataaaaggattaaataagaacctaatatctggcacatagcaccaactaataacatcttttcctttttttattaaataattaaataattagttctatgtggcagaaacctgaggctcatctaaccagtgtacagatataaatacaactagaaggagaagaaagggctagagagctaggggaaaataatttatggttgaacttcagaacatcaagttagtcccaaatttaccctatgggggaagtgtgcgtccaaaaattctttcaagaattccctaaaagaaggctgcctcccctttttttaagagttagggtctggctcttgtccaggctatagtgcagtggcacagttgatagctcattgcagcctcgaacccctgggtttaagggatcctcctccctcagcctcccgagtagctaggactgaaggcatatgccacctcccccagctaagtttatatattttttttgtagagatgggatctcattatgttgtccaggctgatctcaaactcctggcctcaagtgatcttcccgcctcagctttccaaagtgttgggattacaggtgtgagccaccatgcctagcaagaagctctttcgaatgacattgacacttaagcagtagctataggtggaagggaacaagaggcataggatgagaatttagtacactatcctgtattctttagtaaataaaattctttgatttgtttatttatagctctctttgtcaagcacacaatcctccattataattctgtggaaaattagtttaccttctatcagggtttccccagcacccccaactggaatctaattcagctaatcactgttaacaggttaaaaataaaggaaagaaaaagtagggaaattatatgtacaagaaagaaaatctttatgtgctaaggacagaagtaaataaatgtatatgttatataattgaaaataaataacagatctaaggctttggtataagctgtctaatttacgtataatgtttaaatacacgtaaacagtctcttctctagtgctactagcacttgccgaggtgacttttgtatacatttgactttgctttctttattttattttattttatttttttgagacagagtcttgccttgtcgctcgggatggagtaccatggctcaatcttggctcactgcaacctctgcctcctgggttctagtgattcccgtgcctcagcctcctgagtagctgggaacacgagcatgtgccaccacacctggctaatttttgtatttttagtagagatggggtctcaccatgttgggcaggctcgtcttgaactcctggcctcaaatgatccacctgcttcatcctcccacaaagtgctgggttataggtgtgagccaccgtgcccagtttgacatttgccttctttaatgttcatttttatcttttcggatttttttaaaaagttttgttaagttattttatttctgttggcctagtttggccaatttattgacacattatacattagataattgtattttcatttttcataaattgaatgtttacttgcctgttatgttcacttctgtggcttttaaatttttccatcattgtacattttcactacctgcaaagaagatttcacaatcttggatgttaataaagaaaacttgtgatatagtaggttgcagaaatcacacctcttacacttcagtatatattttttaatttttttttcttttagaccattctctgtaacagtcagtatgtattttagaataaaaaaagtattcttttactcaaggcctatattgtttattaagttcaggaaaatttacactgatttaagagtacttaaattctcagtctgcattccagtttggtcaatcatctttccgtacagagattacatattgcatttgactgtcgtatctctttaatctccttcattctggacagttcctctttctttgtctttcatgacattggcattttgaaagactataagctagttattttatagaatatatttctcaatttgggtttttctggtattcacttatcattagatccaagttatgcattccttactctgcgtaccaggctggagaaccgtgttggtaatgatatatcttctaaagtgtttcacagctggagctcacattgtttgtctgtccctattagtgatgctacattcaatcaccaggacatggtgtccggtttctccactgtgatttctaattcatctgttacagctaagaagcaatttgtgagaagacactttgagtctatgtaaattatcctactcagcaaacttcccctagatgtagtatccattgatgattttttgcccaaaccagcattttctgtgatgattgcataattatggttttctaagactaatacccttaccagttgacattcagagctctatcagagccctcctctgtgtgtctgtttctgtcatcagcacagactcaagggttcctgttttatttactgagcagtgatccttaactgtctttatttttatgctcaaatcagatttggtcaatggaagccccttcaagtgggctctcatgtccttttgtttttcctctgtcctttttgacatgcctctatatatatatatatatatatatatatatatttttttttttttttttcattttagcacaggaaggttgttagactcatcttgtatcttccctattgcagccttagagcctgccatttctcaaaggagctgtagtttatttaagtgtgcagtagtatttagaagtcaggatctaggtgctaggtgattgtaaatttaaaacttcagagaggatgagtttacattggttgataaatagcacatcaaaatacacactgtcataaataaaaaagatatctgcagagggccatttttttttgtatcactatttgtagaatcagagaactgaaaacaacatgtacatccttgaggcacatgaaacgatggtgcatctacaaaatggagtatatgcagtttcacaaagaataatatgtccactactgcagaatgatctccaggatataatgtgtatataatctgctaccatttatttaagagtgtaaaatatgttaatgattatttgtgaaaggggaatataaacattcttattcgtaatttgctcatgttaaaaaaggggaaaataaaaaatttttgaatggttactataggggaagagaggacatagtgtagaggagtcaagaatggaagctgaacttctgaccatagcttgttctgtagctccgaagttggatccaagtaaataaagcaacataaaatcaaaattagtaagaaagcagtctctatttaaaaaagcagatggtcctaactgtgccaaattggtggtcacacagagataaattattttacctgactttatagcagttatttgactgtagaagtgagtattcctgaaaacaaaaagaattgcatagtcatcttaactttaataatcatattgtttatgataatggtattattttgaaactattaaaattgaaataaagcaaataaatagtgccatttgcaaccaactcaacccgagtgatgacatgaacatacaatggaagtaaaaagcttgcagttttgaatttgaattacatgaattcttaatgtagtttctctaaaaatacacacatcctagctcattccattgaaacatcctaaataaggcaaccagtccagtagtaataggttcacctagtacttagattgcaacttagtttctaatttattataaatagaagggctttttgataaaatggctgggttatagcctcaggcaagaaatacgcaagatgagcctggtacatcctgtcatactagaaagataggcaggttatcaaagactacttcaggtcttgtcagaaggacttaagagctaataaagggtttcctgttggaaaaagatgggagagtttggaaatcaacaaggatgctgacagtagattaaaatttataaaataagttcaaatccatgagttcataatgggacttaaaaaattattggtctactttgaaggatgctggcgatttaactcattttgaaaactggtaaataaggaaaagaaataaaaccccttttcttcatgaactatacctcagagttaacaaatatgatgagggaaagtttctctttacagaagtgtaatgaagaaaagatgttttgggtaactgatgaatgatgtcaccattttactgcctcttattaatggaggaagacatatcatcatcagtggctgctaaaaatgctaggtatgaagtgatggggagctttataatggatggataaggctggcagtacctgaatccacagatttatactaaatctcacacaaaagaaaacaacaaaacattaaatgccatctggtagaagtccacaacaccacgtataaactattcttgtcaagaagaactgaatttgaatctgatcaagcctctagatataatagccagtttataagaaatacaagggatagaaaaatatgttaaatgataacacaagggtgcgcttagcaaaatctggaaagcagaagagtggaagaaacaattatgagactaaagggatagcctgattggatatttaatattcagtgtacttaatttaatgtttaataatattaaatatctttaatattaacgaagtgatcttttaagagatattggtattgcaaatgtttacaaatagtttcttagttgaatcaagattggtatgagttgctaattgtggagctgggtgatagattcatgataattcatcatattgctcagtttatatttgaaattgtatattaaacttgaaaagacactttaatttgaattactattttatcttttaaatgtggtatttctccttaatttaccctaagaaaacactataattttatcacagtacctattaatggtggtttttctttcgtgaattgaggaaaagaattcaatgggtttatttatttatttatttattccgtgggtgtattatctgaattaagaattcagtgtttttagcaatctacctaccactttaatactgttgtgctggtgagatttaatacactttaaggataattcaagtgttgtacagatatttcagttttataaaagattagtaatactggttattacctaaaataaaatattaattggagatcagagatttaatagccaaatttgtgagttttacataaaatatgtaaaactgtgtcccctatatctctttgatttacttatttattcatctatccatgaaacattgtactcttcatttaatgcttgacataagagcagcaaaaagcaatcccagcgctcaaggaacataaggtcttaggtagggtacctgaaaactacagtgattattacatcgtttgctcataaccaagatagaggtatatattccagaagttttgggagtgctgtggaagtaaacctgatttaacgttgggttgggatagagttggcagagatttgctggaggagtagctgtgaggtgggactcaaaaaattacataataaaaagaaaagagaaggaatggtacaaaggcaggaagtggaaagagtaagtggcttttagagaattacatgtagcttgccatagcttgaacttagggatttaagtgagcaactagttgaaaatagattggagaattagagagagatcctgaaaggtctcatagatgtttgttgaactttgttatagaacagaagacaaaaaagaaaggccaccatcagctttttattttagaaagagcatttgcagcagtaggtggaaataaaattactttattagggagaggcttttcacctattttagctcaaagttttaagtctaattttttttctggccccatgtatatttttctttcatttttaaaaatctctttttaaaaaaatcatgtaaaacatttacgtaattctaaaactgaagactcatttcaattgctgttccttctactcttccctccctctctttaggccatcattttcaaattagttgggttattctgccattgttgcttttcaaaaaatacaagcaaatatatataaatatttttctttcttatgcaaaagaaacattctataaacatttggtatctttttttcacttaaactgtatcttagatcattctatagcagtaaataagatattccttactctttttgctttttttttttttttttttgagatggagttttgctcttgttgcccaggctggagtgcaatggcgtgaacttggctcactgcaacctccgcctccagggttcaagtgattctcctgcctcagcctcccaagtagctgggatcacaggcatgcgccaccatgcccagccagttttgtattttcagtagagtcgaggtttctccatgttggtcagactggtctcgaactcccgacctcaggtgatccgcccccctctgccttccaaagtgctgggattacaggcatgagccaccgctcccagctctttttgcatattctttatcgtactaaagaacaactcaataaaataaatactttattcagtatttctaatacccaaggtaaagacattctaacaataaacctgtgcaactagagtagcatagcctcgggctgttgcttttatctccagccagtactactgcctaaagaatatgaaaggaaagatttctgtattcatttaagaattttgatttgttaacaagcagtttttactagctatgcatctggaatgactaatgactaatgagaattacaggcccacaatagcccccacaatttaatcattcatctgtctactgttcacatatttattgagcacccatctgtgtgaggcactctgctaggtattctggaaaaaaattgagtttcataaatatccattgtgtcatagatacaaatttaagacatcatgaggtctacttgttaaccttactgtgtatgatctctactttcaagatcttcagaggagatactttattgctactagcagaataatttaatagaactcacattcctcaaaagaaagagatactcttttatttctttgctgaagaattcatttaacagcactttcttctaagtgttttctgactactgtaccaaacttggttatatctttagtgctccccatacatgggaatcagttgtcttaaacatagcaaagaaggatatttattcatttatatgactgtctcgaggttaaatagttcttttgatgataaagacttcatctcatctcagtctgtccccagtgcctaacacatgatagttctcaataaagtttattgagtaaatgaaatattttgcttacctattatgttaagggaaaaataaagttgtatgtcaggaaaaaaaatcttttaatatccttgctaaaatttctcgcaaggtatgcaagtaaaatatggccttaaaaattaaaatttaatatgctgtttttggacctctaaactatgtgaccagagaggagacatgatggcaaaaatgatcttcatagcatatgcctttaagaagcaaattttaatttactgtttctatgaatacaacatttattccattagattgaaaaacacaacaatgcttattcatactttaagcatttatatatctcacctgtagaatcaaaattcttcctgcaaacttttatttctctgttctcatgcagaaattactaaattcttgctctggaaaaagagaattactgtgttgtcttagagtaatacctccatctggtggcattttagaaaattacagaagaggacaggaaacttgtattttcttgtatatctgtaaactgtattacctgtggtttctcataaagccaaatgaaattacatcaaaagcggagtcaaccatatgtaccagaaatttaatgccctagttttcaacatataaacaaatgaccttggggataattatataatcaactgtttagtccagactatttctgctctatcttggactaaaaattagaaatggaaaaaaggatagtttatgaaatgtcaattgcttttttatgtgtgtgtatacacgttaggaaatatgagaatttgctatttcagatttattgctacagatccacaaagaacttattaataagtgattttctcagacaagcagtgttactgattttttaaaataaattatattttatcatagctcggttataataaattatgttctcctggagtgatagagatggaaacttgaaaacaagcagaaactacaaataaatttctgcctgttactgtaagaattttttttaacacatttaatcttttcttcacacatttcttactttattattgctagagctttataaaggtaggtaccatgccttcaacttcttgacttctcaaagtttctaacccaggattttgtacttagtagattttgcatattgtcttagaagaagattacaatcttattgcttatgttttagccataaaaatctataaaatatgtcataaatctatcaagtatgtaataatctatcacgtataaataaattatcaactatggcagttgttactatagattaaatcaattcctttttcttttttttggccaaagatagttgaaatattaagtatgaagtaaaatttaatgatttggggctttctgctgacgtctaagaaaaattaaattcctaatgaattttgtttgaaattgtttattttcaaattatagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgaggtaatcaataaaatacccaatgaaaggtagattgcttgtattactttgggaaaatttagaggattggtttataccattcttaatctagcttttagagaagacaacattttaaattaaaatttacttttagtgattctcacattcatggtggtacacctgtggactaattggcttggaatagatgcattttcgaactagaaaacacaaagtgtaaattacacacaggcaaataaaacgttttctgcctcttaggcagaaattgagtttcataaatatccattgtgtcatagatacaaatttaagacattgtgaggtctacttgttaaccttaccgtgttatgatctctactttcaagagcttcaaaggagatactttattgctactagcagaataatttaatggaactcagattcctcaaagataatgatggaatagggtaaggggctattctgtttggaaaaaactacaagagatacaaaaacttgtctatacttcgtggtagtatacagtgttactcagagtaccagtctgtgatgagataagatgcttgagggccagaatataaatcgacacacagattccttcatagagaaaaatgttgctaccggccccccgctcaaatctgagctaaaacaatgtgcctagtgacatcgttgacgtatattctgactcagcctcttcacctcacactgataaaataggtaaccacactatgagtagcactaatacaaataatactcttagcatcaagaggatattgattaatattgtctgtggaactcaacacaccatttttttttatacataactagagctcagcattttatttaactatattgcaatgataattgtgttacatataggtaaggaatatagtctttattactttgaggcagtaaagatggtggtatagtttttcaataaattaacctttttttgcagttttcttaatacttcttcattcactggtttatatttctattatagttttggaaatctagtcctagtattctggccgttcagagatctgcaatcctcaagaagcagcaacagcagcagcagcaacaacaacatcaagcctcatctaatagcggatcagaagaggtgcattttcatcatgagctattattttaaaagtggacatgctgctgaatcagttaactagtatttgtgaaattattaaaaataataagtgctttgaaagaataagtaggaaatactttaagtgtatatatcaagaatcttgaaatacagattttgcattatccagtaattccaattttagggattaatccaaaataagcagtgggacatttgtgtgcatttgctcattacagcaaaattagaaataaactaaatgtgaactctgtgggaaataattaaatgtgatatgcacctacacgcatatacatgtatgaatgaaggaatattatatcattaaatcatatttgtacgaaataataacagaaatctcaacataatatttttgaaagagtagatggccactatacacaatgtagtttgtgtgtgtgtgcaagcatgcatacatgtatgtttgcacaaaaacattcaggaaaaattataacaaaaagtaatggtgaagaaaaaattcaaaatttggcatgttggcacctaggatttcttgttttggctatactaggcaacaataatggtctccagtgagggtagattttaaggtttcatacaaagtgctgacattttgctatttacttaatttcactggctatattaatttgcaataaaaatgttattactttcagctagttaacataaataaaactacattgaaaaaaggcttcacaagtgctgttatttgtaaagtgaatgttaaatagtatagcaaataaaaatttaatatggttaaattctaatcattagtggatgatactgactttatttcttttctacaggattcctctagcagtgaagattccgatgactcatcaagtgaggtcaaaaggaaaaagcataaagagtatgtcattttgttcaactgactacttcattttagaaaaatcctgattatttcatatttctttctttatgaaaattgttgccaaaaggagactcttctaaattcttagttcatggcattttatgaagttaatttacaccattacacaatttaaagataaatctttaacatttatctttctgtgaccacctgagggtattatgccatttctttatctcctgtaactccccctatatatttttaaactttaatgatctccctagttgtaatatcagaaaatcttaataacttgggaatataggagtatagggatgacaggatgactgattttggatggttcttataattatattaatagctatccttactattcagttgcatgtgaaatttacttcataccgtagaactcattttagaaactcactgtaatttcctaaagatctggacccagaaagtattaagaatacttcagattctcaatccatgtttattttaatgatttggaaacattattccattttcttgtcttttattttcctatttgcctttgatattctgcatattagatttgttacttatttttcccaaaaaaagattcatgcatttttaatgcgaagatttgtatcttttattagtctgttctatcttttattctgaaaattcaatcatttatctttggattttttttcctttctctttctacaaatctctctggtcctcctattaatagatgtatattggatcatccagttttttttccattataaaaatacacaacggaaactttttttcggtgtgcaagccctgaaaagatctcaaagtaaaaaatttgcttctactatgtttttatcataagcagattttatcatatatgcttgtttatgtagccttcatcatagttacaattggtgcaaaagatacagagcaatgaagcagaagcatagctgaaataggatatagtgtatttgtaagaattcaatgtgtgcctttcatttgaacttcttatgatagcaaaatattaacatccattatttttctctacatgttgattggaatgaaatagacttaatagactaaaaataataatacaggtaaggtactcagattgaatatttgagatggtactactgttgctcttttttttttttttaatttttctatgtttcttaatgaacgtgcactatttaaaaaatcagtttaaacaggtgtttttcaaaatcacaacctctcgaggattaaaatggcatggattagtatctcttttttgagagggcaagtagaataattttatgagattttcatctataatgaaaattaaaatatcatttatttgctgttcactgacgtataactaagtgattagcaaaactagagttgtgagagaagtctatgaagaatattttccagagtgtttttgttttataaatatttcatttttagcatgagtaaaagcaacagtatttttgatagcgaatatagtttggttgatttgatcatctttgtattagggataaaacttgccatataagtacaaataaaaatactttataaattttgtctgcagtgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaataggtatggtctcagtttggtgctgaaaattgattgtggaaagtatttgttctttttgtatatagtttctcaaatcttgtttttttttctctttgcactttcctagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggaggtagtttttaaaaaaccatttattgtttggttatttaaataatatttacaggagtagagggctgggcacagtgggtcgcccctgtaatcccagtactttggggggccgaggccgatggatcaggagttctagacctgaggtcaggagttctagaccagcctggccaacgtggcaaaaccccatctctactaaaaatagaaaagattagctaggtgaggtggtgcgcacctgtagtcccagctacttgggaagccgaggcaagggaattgcttgaacccacgaggctgaggttgcagtgagctgagattgcacgactgcactccagcctgggtgacagagcgaaactccatctcaaaaaaaaaaaaaaaaggtaaagtatttaagatttttctacagtgttgaaagctaagagggtggattttttgttgttgttgttttacttatgttttataaaagctactttgcttagcctgagtaccttcttaataaccacctgaccacatttcttttttcttttttttttttttttgtgacagaatctcgttctgttgtccaggctggagtgcagtggcacggtctcagctcactgcaagctccgcctcccaggttcacgccattctcctgcctcagcctcccgagtagctgggactacaggtgcctgccaggacacctggctgattttttgtatttttagcagagatggggtttcaccgtgttagccaggatggtcttgatctcctgacctcgtgatccgcccgcctcggcctcccaaattgctgggattacaggcgtgagccaccgtgctgggcctccagctgaccacgtttcatatattgtggataattatagaataatgctgtgggatctcaggtggatctctgtctttttattttttctaattcgaaaaaggaggggattatattagataattctgaaattctcagttttatttatgagcaatagaatttcccataagtttctatacccccaatactttatttaaaagagtatatatttttgtactcatattattgaaattttgagttgaaatataatcctacaacagaattaattacatggaaggatcttgtgcttttgttttcagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggtaagtatgctgtatatcatatacttcttttaatagttcaaagattactaaacctttatgttaataaagaatacatagtaacattaaatgatagcctaaaatagctatagactttataatacagttggctgtctttgtccacagcttctctatccttggtttcaaccaaccatggattgaaagtattcggagggaaaaaaaacaacaataacacaaattaaaaacaataccatgtaacaactatttgcactgcatttacgttgtaaatgtaaaattgggtattataagaacatctagagatgatttaaagtatgggggaggatgtgtgtgggttatattttaggtaccatgtcatttcatataagggacttgagcatcctcagattctggtatctgtagaggatcctcaaccaatcccctgcaggtagtgagggatgattttattccatctcaaggtaaaactcctagaggtatacctatctaaacctatccttggtaacagtcacatagagtgtgtctcatacattataaattacaaatttttagttaaaaattaatgatgctttattcctgtttgagtttctttattactcaaacttggcccacacagtggcaaaatgggagattttgtgctacaaatagtgttggggatgggggagtgaaaggttatttatgggagatttttaagtctattcctggattaataatttttcaggttgaaaaatgcctctccagaagatgtggaatattataattgccagcaagaacttacagatgatctacataaacagtatcaaatagtggaacgtataattggttagtgataaatgattctagttaaactttctttttatgcttgaaataatctgaaaaaagtcataagtttgccacttacatatcaaacacagtagcttgctcttactaaaacagtattgtaaactagatagctaaattttacttgtgtagcctttactaagaattatgtatctgatgattaaatgtaaaaaaaaataaataaataagtaaatgcctgattctctcacagctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtgagtattgtctaacattttaaattattaaaaatatatttatacattataaatatttacaagcctaaatacaagagttggatcctgatttcagatagactaagggagaatatttcttggttaataggtcttacaggaagtgaacttctgcaattgctgtgtgttttttagttttagttttataattttttatttcaaactttctcttaaaaaaattgtaaatgatgttttcgtcaatgtatcttcttaagtgttgtcttttatcttgttgagcatcactatgtcagaaagatgagttggttatggtgattgtcaggaagggttgggagaataaacagaaaaaaacccttggaaactagagatatgctcaattttaaagatagtggatattttcttagaaggtagagaaaaaggagagtgatataggaaagtatccagaactaccttgcacaatactttctgcatccttgtaacttacccagagttactagtgatgtgttgagatctatggactactagactttctttccttattacaagaattacattcttcatagggataacttggaattcagaaattgaacggtaagctaagccagttttatggtttgtagcttaaggctggagtgatggttttgaacaatttaacgtaggttttgcttgtgaaatacatgagactcatattttggcaggaagttaattttctctatacatttttgtttaaaaaagaaggcaaaatatttcactgttcatttttgtagagtagtagaaaacagtattgactgaatcctcaggtacattttgagtaatggaatctctgagcttgatgattagagatgaaatttaagaatttatggtaaagctgaggctttcatcttttagtataatttcttatatttaataactctacataataatgtttatttctactaaaggtattaaaacaaaggccaaggtttgtagccctgaagaagcagccatcctatattggaggacatgagggcttagaattaagagattatcaactgaatggtttaaattggcttgctcattcttggtgcaagtaagtatattttgaatcatctatttaatttgacagagtaagaatttaccaatacaggattcagaaaagatttccatttacataaagaataagactctttggcagtttatatgctagtctttgtatttcctagtttgtataaacaatacttactacatactaggaagaaaatccagtggagttggagtttaacttgattgttgcctttttaaaatatgtttttattcagtttaaaaatcaaaatgcatatctgttctcatcccatgctattcctggaatatttctctttttcctagttattttaatatccatttactcttctacattttttttctatcttctatggcccccactctacttttgtgaatctcggttgcaatttagctatagttttttttttttaatctgtgttcttcctatatactttttacttatttaatatatctggactctactactagtagatgaattgcattattggcttcataattgattaaacataatactattaatctttaagcctcttctggcccaaaacggtcatctccttttacttttcttacagcattagtgattaagtctttagccagatacctttacatttattatttgtagttaataaaagtggtatattctatataatacctatcaattttatttaacttcataaaaacatatacacatgatgtaaaaaggtttctttgtatatttgaatatttccttgcatgctaatttttttttaactttgtagaggaaatagttgcatactcgctgatgaaatgggccttggaaaaacaatacagacgatctcatttctgaattatttgtttcatgaacatcaattatatggaccttttttattggtagtaccgctctccactcttacttcctggcaaagggaaattcagacttgggcttctcaaatgaatgctgtggtttatttaggtgacattaacagcagaaacatggtaagttgtttccctgtaaatgtagaaatcaaaatgtacttgtctttgagatcaagtgtttttgttgttttgagatggggtttcactctgtctcccaggctggagtgcagtggtatgatcttggctcactgcaactgggaccacaggagcacgccaccactcctggctaattttttatattttttagtggagacagggttttactgtgttgccaggctggtcttgaactgagctcaagtgatctgcctcccttggcctcccaaagtgctgagattacaggcatgaaccaccgttcttggcctaacaaggatgagaggttttgttttgttttggtctgtataacagtctttgtttctggtatagaacttgccacaaataagttctcagtacatgtttaattgactgtaacaaagtcagttttggtttagtgttacttagtatatatatttgactgtttttttggtgggtttttttttttttgttttcactctgtcatccagactggagtacagtggtgtgatctcggctcattgcaacctccacctcccaggttcaagtgattcttctgcctcacccttccaagtagctggcattacaagcgcctgccaccaggcccggctaattttcatatttttagtagagatggggtttcactatgttgcccaggctggtctcaaactcctgacctcaagtgatccacctgccttggcctcccaaagtgctgggatttacaggcgtgagccaccataccagcctattttacatttttaatggaaaatttcaaatatgcatgagaacagacagaagaatgtaataaacactcatgttcttaagtttcacaaatttactgctagttttgttttgtctatacctctacacacgactttcctagttactgtgaagcaaaccccagacatcatatttcatccataaacattacattattaaatgaattaatcacttatgttttcttaaataagaccttttcgtttgtgaaagatgtgctttaaaattgtgtttacttcgttttttaagaaatgctgtggtatttatgttttatttataagatttacatagcattttggactatataaagaataactctggccgggcatgccggctcatgcctgtaatcccagcgctttgggaggccaaggtaggtggatcatctgaggctgggagttcgagaccagtctgaccaacatggagataccctgtctctactaaaaatacaaaattagctgggcgtggtggtgcattcctgtaatcctagctactcgggaggctgaggcaggaggatcacttgaacccgggaggtggaggttgtggtgagccgagatcacgccattgcactccaccctggacaacaagagcaaaactctgtctcaaaaaaaaaaaaccacaaaaactcttttattacataaacatatattaatagttacttacatatttgaatggattttaatttttagatatgtaagtaaaagtataatttgcttgatgtttgtcttaaaaattgtccttcaaatttcttaatagataagaactcatgaatggacgcatcatcagaccaaacggttaaaatttaatatattgttaacaacttatgaaattttattaaaagataaggtatgtatttatttctcacgtgttttggtctcttgtatatcagttttttctttatcatatgctgtggacaagatgagagaatagcctaaatcgtgagtcagcaagctatagcctgtggtcttatttttttaatggtgcttgaactaagaatggtttttacctttttgaaaggttacatttaaagggtcttagaaagaatatgtaacagagaccatatatttatctgcaaagtctgaaatatttactatctggctcttcttagaaaaagcttgccaactcaatcgaatgaaaccagtttgttatagtgtgtattgatttgtaagctctttaaagaagaggaagatacctaacaggattaagctaccactgtgtgaagcagtgaaggctttatagatactgtcttatttaattcctccatctactttatattcactttctctactttatggaaaagaaaatcagtctcaaaaatgtctcaaagaatttaatgaacttggctgtggtaacacagctcttaagtagcggaatcaggcctgctctaactcagagacctaagtttaagagagttctacagttcataaaagttgtacaaagaattgtacctacacttggaataagacactgttctgaatttgtgtcatagtttttttttcatattgacattaatagaggcttctattggggttaggctaaaaatcttttgtaaaaattttaaatgacactgctgatttttctccgttaattatcagtttataagctaataaaaactttggcttgatattacattctagtggttaaatttgtcatagaaggaatatgtgctgagttacttatgtattgtaatcttgagattacgattttttatttgaaaattagacaaagtttgtttttaatttttatttcattttaataattgagttcagattaaatgggaaggctaaatttgaattccgtttttctctcaaaatactgtttttctattattttaaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagtaagacaactttacaattttaatcatattgtgtggatattatgtttagtgggaataaacccaggtaataaggtcagtaagagtttttattgccctaaaagattagatcacagattactaagaattttttaaaaaggaaaatgaggtcaggtagtttgtaatactatttgaatttttcaattttgttaataaacttaagccatgtgtaataaatcacgacagttgattttgcacattttcaaaatataccttgtttgaaaaactaacacagtaccattctttgtatttaacagtaggagtaacaacaatgaggtgctggtaatccctttttctaaatgaggaaaactagactagacaaggctaaataagttcccaaaggtcactacttgttctctttcagtaggtccagaactttaaaagtatatttttttgagaaatattttagtgataattactcccatacttcaaaatacttcatattcacttgattcaagaatcataacttataaaacaactaattatatttcatcatgcatcttcttgggagggagatttttagaggtaactaagtttagctaatttttttttctaaaaatctgtagtattttgtttataaatgactcccctaaaaaaaaaagttcatacacaacatacacaatttgattttttctagtaattgttccaatttcttaaattttaaaggttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaagtaagctgtacacagaacacagttctgaacttctaattctgaaaaccttccatgtctgtgtcctgcttttggtgcccccaccttctctacaatagtgtcttagagcagttgcaattctcgagtttcagaataagtttattctgtgtcgttaggaggcaaaaggagatttaatgacatatccaaaattatgagtgacaacactgagtaattcatcttctgacacataattaattgctttcctatatatcatactgttatcttataaagagtttaagtgttaggatttccacaataataaaggtattatatgattatgacaattaacagaggccaaaaaaagaaacttagaaaaaaattttaggctctgctgctttttgaagagtattaacaaatcatagctggtataaattttgtatgtcaagatctatacagtaggacttttcaaagaatcagaaaggaaaatctgttctaatatctgtttaaacatttaattgcataaaaggaaatatattgctacatgcatttggagtttcagaaacatttatattctatggtaaatctataggtgccatacatttgaaagaatatacttaattgcataattatttttattatggaagatgtcagacatatacaaaaataggataatttaatgaactcttatacccatgactcagcttcactttctttcttttttttgtttgtttgttttttgagacggagtctccctttgtactccaggctggagtacagtggcacaatcttggctcactgcaacctccaccttctggtttcaaatgattctggtgcctcagcctcccaagtagctgggtttacaggtgtgccccacaatgccctgctgatttttttatttttagtagagacagggttttgccatgctggccaggctgatcctgaactcctggccccaagcgatccacacgcctcagccttccaaagtgctgggattacaggtatgagccactgtgcccagccccagcttccctttcaactcatgccagtctttttatgtatctctggtcatccccatttccctcagtacctgtccttttgaagcagattggaaatttttccataaatatttttctgtgtatttctaataattgatttttaaaaatactagtatcacctgggcccagtggctcatgcctgtaatcccagtactttgggaggctgaggcagacagatcacttgagcctcaagagtttgagaccagcctaggcaacatggcaaaaccctgtctctactcaagatacaaaaaacttagccaggagtggtggtgggtgcatgtggtcccagctgcttggtaggctgaggtgggaggatcgcttgagcccatgaggcagaggttgcagtgaaccgaggtcatgccactgcactccagcctgggtgacagagtgagaccccatcttaagtaaataaataacccactttaaaattttcacaatttaggaaattattgctctctcagcagaatcaatttcttgataccaatattcagtatcagtgttcaagttttctctgttgtctcaaaaaatttttttacgtttactcgaattgggattgagataggttcatatatggcaattgatttgtctctgagtttattatctataggtacttcttttttgttaaaatgtatacgatggggaaaacagttattctgtagaatttttccacaatctagattttgcatagtacttccctctaaaatagtttaacagtatcctctgtatttcctacagattggtaggtagatgtaggtgcttgataatattcaaattaataattatgagaagagtatattttgtagtacacaatggcgattatctaattttgttatggggttctttaaaaaaagtaatgcattttgtagaatatttagaaagaaaagtcaaagtaggaagaagacacattcacctgtaattctcttagtgctagtcatatatcatggatgttgaacttaaactcttcaaggtactttttggcaactaaggtaataagatactgccataaatttctggaaaaattcttagaatttttacctctagagaaattaataataaattttttctggataaggaaaaatattctttattcttgattacctcttagggcattgagcattgtccatgggtttcgttttgcttttcattccagttttggggaactgcctgtataactagtggtaaagaatggtaataaaagagtatgtacactagatatttgagactttcaagtcccttcaaaaactgaccttgtaaaaaggaagaaaataaaaggtggaaaaggtcatggtgagaggaaatttttcttttcttttttaaattcagcttttattttagatactggaggtatatgtgcaggtttgttacatgggtaatattgcatccaggtagtgagcatggtacgcagtgggtagttttcaacccatgttcccctccttcccccctctagtagtcgacagtgttgttacatgtttatgtccatgtgtgctcagtgtttaacttgcacttgtaagtgagaacatgcggtgtttggttttctgtttctgtgttaattcacttagattatggtctacagctccatccatggatattattttatttgaagggcattatttcatccttttttttctgtggctgtgtagtattcatgggatatatatacaaaaatatggagtgttcatggatttgcatgtcatccttgtatggggaccattctaatctctgtattggtccagttttagtataaatgctgccgaagtgagcacaggaattgttacatgtagtttggagtagtaaaatatcaccaagatgttttctataagttacatatgtattgtgtaattgcaatctagagaaggcagtcgtggctaaaaccaggtatcctcaggtttcttttaggtccatgcaaaataattcagtttcattagctgtctaatgcagtaaaagttgtaagaagattcagataaataatgcagctgaccatctttttagcaaatttgaggggaaaggattaatacactgtaataattatgttacattagcctgttctgtgtatagctaatggttcagaaaacaagttgtgttctcatgagtattatgaaagaggtttggtccgttgtatatacagctgtgaattttataacggtacagttttactttggtactatcgttggctttttttgtttgttttaatgcttttagaatttatcctggtaattgttctgctaaacatcgttttcataatttttttttttaagatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaagtaagaatttttaaatgttgtttctttgtgataaagttctagaaatgttgatttcacttacaatcgaaaatggctcaatgctttaacttattggataaaagttctctttagttaatggtgcctttctataatggtctcagttattaatctttgtagaaaagactttaaaattctaatttatgtaattattttgatgaattttctaaaaataggtctctcaaaccatggcctataataacttatccagcaagaaaatcccacagtatgttcataattatgaaaaaatcgttaatagtaattgtgctgcatttgtgatttggtaaatggtaatctaaaggacatcttgacctcacatcttaacccttcctggtacttctggaagataagtcagaagtgcgaaggcacagctgcaatccagccactgtagtgcattgaagggctaggatcagcatctagaattaatacattagaatgcatttgcttactctttttaaacctttggttgcttagttgctgctgcttctgatgtcattgttcttcagctaagatttttggagaaacactgtggtatagtaactagcaaacagagtgaacagtacttttttcctccccgatagtataacaaaacctaggtgtgatatggcaaagggtattttagcttcagtcatagagtgaaatggtaaaggtcttagaaaattttgaaaagtgaaataagttgttttctaacatgaaaatttaaaatctcaatttaaaataattcaggcaactaaagtgttacgtggacaacttaccatttatgtcttttaacatataacaacttgaattgtttctgtagcacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaagtaagcatttaattgtatttgttgttttaaattttatctaattcctgtgcatattttacagaattaactgaaattattttataagtgtttaggtttttatataaactgtactttttctttaaaaagatgtatctgctttaaaaaatatttgtcattcccggtttttcttgactttacatattgcaacaaaacaatttttcttcctttcctgtgatttttattttcttttaattctgtctttttcttctatgcttgctttagattttaaaaactgaactaaggcagaattttcttgattggatagatctaaaagcaggggagcctttagtcttcaatctgaatgaggaaaacagccagtagtctctgaatgtgaatgctgccaagattctgatgattggtgtgctcatagttatctgacacagggtttgttgagtaaaactagacaactttacagaagaaactaaagaccaaaattcccttccatctattcaaaatttatattgaagttcattcaatataactaaagctaatattgatgagtatttaaagtcaggtgctgttttcagtacttcagatctaattacttaattctcaaagcaattttatgaacagtactaggaacatagcagacattatgtagatacagctagtaaatgctgtatatttagtgcagatagtaaaatagcagtaaaattataataatgggactgaacacacaatccctgctttgtcagagcttatcatctcttacaggagacagacatcaagcaggtgattacaaataaatgtaacattacaattctggtaagtgttgtgaagaaggacaggtatttggtgataggaatatcattgagaaataattgcagtcatttaggggaaaacgtagaagagtaccattagttgaggtttttgaaaacacctttattgatacgtaattcccatatcatacagtttactcatttaaagtatacaattcagtggtttttactatgttcacagatgtgtataattgttcgacaggtggttttagaacattttcatcagaaagaacctgtagcctttagctattcctcttgtccttccatttgccttcctcttctgccctgtgttgatttgtttttaaacaaattattgtgtacatagtcaaacaaaaaattagtttgactaattttgagtgttaataagcgccacttctctgttgctaattccttctcattcctaggtcacttcctggagagaataatttttaattttatttggtttaggtcatgccacagtaatgagatgccactattcttaaaatttgtactaatatgtattttagtggaaaagaaaaattattttaattttttaaaactttaatagacatgttttcctactttgagtaggtgataattaagagcacttcatttaaaccacttagaatacatcatttaaaatgtttatattttttcttcgcagagttaaaattcatatagtaacaaagcaaaggtaggcatatggcttcccaaaatactagtttaattcgtcggttaaatgcatggatcatagtagacaagttatttctagtctataaccagttaataattataaaatcattgccatttctaaagtgaaatagcagctaatgtttaataagcgttcagtatgttgtaggcactgtgctacatgttttcctgtgttctctcactgagttctctatagtctatgaaggagggactactattatgtctgttttgtttaaagcggaactgacatggtgaaaaagtttgtggagaaaagtcaaatcacttgctcaagataccaagtgaataaaatactcatttgctggctgttgactagaacccatgatgcttcacatcaataattttcaaactttagtgtgcatcagaattaactggatggcctttgctaaacaccttcagtaggtctggggtaggactcaataatttgcttatctatgttctcaggtgacactaatgctgttctagtaaccacgctggacttaatcagtgtttttaaaactgaattgtaacctgttaatggatctgtgaatcagtttaatgggttgcaccaacattttgaaagtaaaatgataaaacatgagagtataacatagtatatcatgtcatgatatgaaactgtttcaggtgtttgcaaacagctatgtactcaatcacatacttttagaatggggactcaggcagaatagtatgacagcctatgctgtatttactcttgagggtgcagtcttagtgatttggagcacagactaaagacagaatgcctgagcattattttactgtctagtaagtactttctattatagttttagcaaaggacatgcttcacatttctacttaattttataattgattttaattgctttgtaatactttgattctgtttatgcagtattttaatgtgtttttttctagagattagatggatcaataaaaggagaactgaggaaacaagctctagatcattttaatgctgagggatcagaggtatgtattagtgcttttaaaattataaataattttgatttagtatcagtatattacattattatattcagacatttttaatcttcatatctagtttgataaaaaaagagtggtgttagccacctttgattagcaaatgaggttttaaagtcactattctagtttaaacctaaggattttatctttgagacagagtctcactctgtggcccaggctggagtgcagtggcacaatctcaactcactgcaacctctgcctcccaggttcaagctattctcctgcctcagcctcacaagtagctgggattacaggcgcgtgccactgtgcccagctagtttttgtagttttagtagagatggggcttcaccatgttggctaggccggtcttgaactcctgacctcaggtgatccacctgcctcagcctcccaaagtgctaggattacaggcatgaagccaccgcgcccagccaagaattttactctttattatcaataatgtttcagcatggaacagttattttaatttgcttcaaaataaattagccagattgggcacagtagctcacccctgtaatcccagcactttgggaggccaatgcaggagaatcgcttcagaccaggagtttgagaccaccctgggaaacagtgagactgctgtctgtacaaaaaaaaataaaaataaaaagtaaaaaaaataaactgggcatagtggcactcggttgtagtcccagttacttgggaggctgagttgagtggatcacttagctcaggagtttgaggctgcggtgagccatgatcatgtcactagactctagcccaggcaatagagtgagactctgtctcaaaaaaaaaaaaagggaaagaaaaaacccaaaaacaacaaagtagcccactttcctttaaaaaaaattttttttatttccgtggatttttgggaaacaggtgatatttggttaaatgagtaagctctgtagtggtggtttgtgagattttggtgcacccttcacctgagcagtatacactgaaccaaatttgtagtcttttatcgctcaccccctcctaccctttccctctgagtccccagagtcctttgtatcattcttattactttgcatcctcatagcttagttccctcttacaagtgagaacatacaatgtttggttttccattcctgagttacttcactcagaatagtagtctccaggctgggcgtggtggctcacgcttgtaatcccagcactttgggaggctgagacgggcggatcatgaggtcaggagatcgagaccattctggctaacacagtgaaaccccatctctactaaaaatacaaaaaaattagctgggcgtagtggcgggcgcctgtagtcccagctactcgggaggctgaagcaggagaatggtgtgaacccgggaggcggagcttgcagtgaaccgagatcgcgccactgcactccagcctgggtgacagagcgagactccgtctcaaaaaaaaaaaaacaaaaaacaaagagttagagaccagcctggccaacatggtgaaaccgcatctctactaaaaatacaaaaattagctgggtgtggtagtgcctgcctgtaatcccagctactcgggaggctgaggcaggagaattgcttgaacctaggaggtgaggtggaggttgcagtgagccaagataaaaagagtgagactccgtcaaaaaaaaaaaaaaaaaatatatatatatatatatatatatatttagtctccaatcccatctaggttgctgcaaatgccattatttcattcttctttatggctgagtagttttccactgtgtatgtataccacagtttatcttcttgttgattgatgggcgtttgggctggttccacattgttgcagttgcaaattgtgctgctgtaatcgtgtgtacaagtatctttttcatgtaatgacttttttgctctgggcagatactcagtagtgggattcctgggatcaagtggtagttctacttttagttcctttaaggaatttccacgctgttttccatagagttctttttttggtatatgccttttattttttaaggaaataaaatttacagttagagttgaagtgtcattcctttcctatcccgttttctttctttttcaccagaagtaaacactgtattgaatttggtgttaataacatatatatttgattttggagtctttttgttgattggtcttgctagatgtttattagttttaaaaactgcctttctgtttaattagtaccatactgcttacgttcagaaaatcaattgaaaaatttttcattttgattattcaatttcttacaggatttttgctttttgctgtccacaagagctggaggtctagggattaatttagcctctgctgacactgttgttatatttgattccgattggaatccacagaatgatcttcaggcacaggctagagcccatcgaattgggcaaaagaaacaggtatttttaattttaatttatattatattgctgttttagaattctttttttttttttggaagtgatttcagtttatcctctagaggataagatcactgtaacagtcatactactgtttaaccgataggatactgaggagcttggtttaccaaaatcacctggagagtctgacagaattgagataactatgcatatataggatcatgtattctgttttgatcccgtattctagtcgtaactataaaatgcagtgtttttcattttataataaaaactttaaaacgtctttacttgcttattttaacttgaaagggagtttgagtagcatatgctacctttctgttagtctatattttgtccatgtgcttacaagattctccacatgtaaacgtgaccccattttataattgtaacaacatacccttaaatggtggtactgaacctttacctagagaaatagggaaaatttactgcagaatctttgacctagagaaatagggaaaatttactacaccaattcttttcaattttggagagtttgttttatggtgggtttcttattaacttggggagtagttcatagaattttgcattatatagagtgatgaaacattagaatcaaggcaacgagtataagaaggctatcagaagtttacatgccccccccccattttccccagctaaatcataacataaaaattactgtcattcctttaaaaaaaaataagcaaatgcaatctccttatcaaaatattaagaaggaaggaaggatatagtttcaaaatagtcccttaagttgaggaactctagctttaaacatgttttttaaattttcattttgcttttaaccagtgaaaacttcatatagaatgagcttcaatttgtgtgccagtgtttaggcacttgaggttagcaaaacaaatcctttatactgcaatttgtttcctcatgtgtatttttacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaaggtggttacttgattattaaaaaaatgtcattttagagtcagtaaactcatatttttgatatgttacatcactgtagatcattgaggaaatgtattcagagttgtactttttatattttggaagactttggactaatttctagttagaagacatacttcaaatacctggtttcatcgctacagatttgtaattttaggggtaatctctttcacttctatgcttcaagttccttattttaaaataaatatactgcactaggcaacatagtgaaaccccacctctgcaaaaaataaaaaacttagctgggcatggtgacacacaactgtagtcccagctactcaggaggctgaggtgggaggatcagttgagcccgggaggcggaggttgcagtgagctaagattgtgccagtgcacttcagcctgggtgacagaaggagacactgtctccaaaaaaaaaaaaaaggattctaatacttgatttgtctaacttcttcatgtaactgttgtaaaggtgaaaatgtcagtaattaataaaagtgctgtgtaactgttatatttttaactgttaatgttaagcatttttgtttttcctgttttagttctactcctttcaataaagaagagttatcagccattttaaagtttggtgctgaagaactttttaaggaacctgaaggagaagaacaagagccccaggtaaaaaaaaaaaaaaaaaaaaaaaaggcctgcctcagaatatgtgtcatatatttgacaggatgaaaggattcaagtatatttaaatattgtctttttaattataggaaatggatatagatgaaatcttgaagagagctgaaactcatgaaaatgaaccaggtcctttaactgtaggagatgaattgctttcccagttcaaggtagatttaaacaaaattttccttgtaattacataaattgagaggaattgagttatgtcatttagtggtttgttaatctttctttaagcataatcaggaagattgctgtgttatgtaaaaactactctctcttgttcagacaaaccagtagcaaactgatttgaaagagaccaaacccatttatgaagttacatttagttgggtggaaagagctgttgtttcctaattagcaactagaatagtgtttggcaaatagcatgtccttaaatacttaggtaaataaatgaatcagtgtgatctcttacttagatttccatgactgaaagctttcagctgatatttttttgaagcagtttttgacattaacttatcacaaataagaaaactcaagtaaatcagtcaaagtaagcaataagctactatatattgatacttaatatccctggtttgttgagggtcaatgagttgaaaggagtcctaaaacaacgtaagtcaactgacctcatggagtaagttaagtgccatttgtttgaagaaacaggtttctctacatcttagctgttttctctgaactgtggtttttaaagatcaattcatttcatgtgttcatttgacaaatatttatggaacacctacagtgtaccccacacagtgaataaaaaacttttataattttaatgaatcattctgactactttgtggttgattgactgtagtgaggaaagagctatagcagggggagataagacagaatgttgagtaatcctggttaagaggtgaaggtttctggaatcacaggcgtgagccacttcgcccggctgtgatagttagccttaatgggtgctttctgtataccagaccttgcatagtaccttaaatgtgctatcttatgtaatcctcacagaaattagtgtgctctcaaagagctctatgtctctgccagtagctctttagatagtgtttttgtgaccataaaaatgatattagattgttctacaatacttgataggtggactggtctgagaatttctgcagattatttagcatgttaatagtataaattacttttttgttgttctgttaactgctcttagttctgtgatgctactaattttgttgagcagtagggcaaaataaaatcattcctagaggattattagatgtcatttggtttgatctgctttgccctaatgaagaaatgaatctaggttgtttagaagttatatttggtttagtccacagccatgttcattatcctaaggagcatgccagttcttccccttaaaaaaaacttttagggatcaatttttctgtaacagttactcttaaaattctgaaatttatcaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacaggtgattttgcaattttaaagatatttctataaagtaagagtattcaacctgggctgattttgtttgtttctacgaggtatcagtccatagttttcttttcttgtaatggccttgatttgataatgtttgcctcatgaaatgagttgagaagtgtttcttcctcttttattcatcttttcaaagaacctgctcctggtttcattgatttttgtgtgtgtgtgtgtttttaatttcatgagtttccacaatttattatttcttcctttctgcttttgatttaatttgctgttttctttcttttcttttcttttttctttggtgacagcatcttgctctattgccaaggctggagtgcagtggcacaattctggctcactgcaaccttaacctcccggcctcagatgatcctcccacttcagcctcccaaatagctgggactacaggtgtgtcccaccacacccagctgatttttgtattctttttgtagagatggagttttaccatgttgtccaggctggtctggaacttctgggcttaagtgatccatctgccttggcctaccaaaatgttgggactatagcacgagccactgcacctggcctcttttattcagtttcttaaggtgcaagcttagatatagaaatgtaatctctcttttctaatatcggcatttaatgctacaaatttttctttaagcgttactttttctgaatcttccaaatctatttttatattttccttaatttaaaaacattttaaaatttcccatatgacttatctttgacccacaggtttttttagaagtatgttttaaaatgttcagatatttaggaaatttttcaactatgtttgttaatcattggtagtttaattctgtcatgttcagaaagcatattttatgtaattttaatttttaaaaatttgttggtgtttattcagtggcctaagtaaacaaataccaaaattttgaataactgtaatagtgccatgccaagctatattgccaaaaaggaaaaaaattctaagactaatttctttttctagtatcctttggtttttaggatataagattttttgtcttgattgctgagttttttcgtgcttccttaaattttaagcctggggcaaatgaggggcttgccccactctagtccctgccctgctaccattccccgaagggtagagctttttgttttttcttttcttgcaaccgtattagatcttattctgttccctcagttgagcagatgagaaaggtctggcaaggcttccttcctgtttccacaaaggtgactgctcactttctccaaggctgtaccatggaggaaagttttctccagtcttccttctcatgagcacctggtggaagttcgtggcaaagtgcttgagagtgggtgcaggtcctccgagttttggctgttaggtcctgtgatctcacaatagcgtacactcagccattagcagattttagctgatctcctcttacctgcttgtatggtacttgatttctgtcacctgtgttcttcacaaatgagccactgttcaagtcctctttttctctttttgtaatctcctgtatatccttacatttagatgtgtaggttgccgtgtgatttcatctctctgatgttaaacagaaaaattatgattttgtacatcagatttgttgttagagtaggagcagtgcccctaccaagtttctacataacagccagaagtagagccaaaaataatgcttttggcctgaaagtaaccatgcatgttatttcttgtttctgtttatttctccaaacccctaagtagttttgttttagagtgtgtgagaatgcagcattgcattagatcttgtgaaaggatcaagggaggttagaaaaaaaaggtctaaataccattttttacttcatttaactttcagcatattagaggttcggaatatgtgccaaggctttggaaaaactcccaagacttacagaatatatgttttgatgtatcttattaaaattaatggatgttacaaatagccttttatgtgggttcaactggcatttttttctttcaaatatctgatttgtctagttagaatagcaatatgtggatattaagcagaacggaaaaaaagacagctaatcaatctgttcatccagagataggactgataacattatcacagtgtacatcattctaatttttaaaaattcattatcatttgccaaattaagttggagttgtattaatttggaactttttcttctttttgacagtatgtcatgaatgttaattattctacaaccccatttttaatggtgtctcagcattctatcgtatagatttgtctggtctctctttgatgaatatttagattatttgctttttgtttttgagacaggatctcactgtgttgctcaggctgaaatgccatggtatggtcatggctcactgcagcctcagcttcctggggtcaaatgatcctcccacctcagcctctcatgtagctggaactacgggtgcatgctacaaaaatacctggctaatattttaaatttttggtagagacaaggtctcactatgttgcctaagctggtcttgaactcctgggctcaagttatcttcctgccttggcctcccagtcatgctgggattacaggcatgagctgctgcactcagccacatttttcttttatgatgtaaattactttattgatcaatgtttcttcacagttctgatctcctcaggaaaaatgcctagaggttatgttgctgcgtcagtagaataacttttggaggcttttgatataatgtctgattaccttttaaatcaaaatatccaccagaggtatatatttttctctgtttgctctttaattttgtttatggaatgtttttgatacatttaataacatttttaagattccgaccatcttttataatggtttttgctcttaagatacaagctgtttttacactaaggttgggtaaatattttccaattccagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtaaggtgttataagacaatcgcttcaacttggttttagtagagtgtgaaactaaaatgtaaaaacgccgtaattttcaaaaattgtgatgaagttttagaagaggcaaatctgttatttgagtaggaattgggtggttctgcttttgggtatttgttataactgaacaaaacaagtttggtgtctaatctttgcatgttatttatttatcgctaaactgcttagactacacaattttttttattaatttgactcaatagtgatcctttcgaataataaaagtagttttgatgcatttgatttttaaaaattctcacggtgtttatgactcccaaagttactaattttttgtggaaattctgtatttttctagtttcttaacaacagggtaatttcctttttgaaagtaaccctgttaaaagcatttctgatatgttcaagtaggaattgagatgaggtaagattggccaggcaggatatatttattgtagtgtccattcagaatatgtttatatatacacatttatttaagaggaatgggataacagcttacttttgtttatgtaatagttttggatatgacatttattaaaatcttattcagttttgtattttgaaagtttctttgaagccattgtaacttttttcttttaaaatcttagacctgacaaaattcttccttattctttctaccagaaaatttaatacattgttagtctttttaaaaggcactttcatgaccacctgaattgctgtacttttcgtctttagttgaggaagcatttcgacttctactttacctggatatttttcctcatttattaaccacttacgtagctttcttaagtaaaattttaattttgcattgttggtgtaatacacatctgaattaaagctattcagtgaatttttatcagcacttggaatgtgaggaagtgtaatataattgataattattgtggagacacttcctgtggtagcttcagaccttcttttggtcttatgaaaataatgaagtaatttttaaaacaaaatttagcttctattgttttatttatactgatatctaaacatcatcttggatgttaatttaccttgtcttacctggtgtatcttaatgttttaacatttttgtttttagcatagtttattcattcttcttagataacagtgccttgaatttttatactaacaagtattttcttatatctgtaaatatcagaaatacgtataattttagtgaatactgaagctcacatttaccaaacaattattttctcttaggtttatcaagagctataagaaatttggtggtcctctggaaaggtaaatacgtttattattctcatagaataatggaatgtgttacatgctgtcacctttatttatttgtattaacattcagtttagctactttgttaaatttgcttttaatcggcatttacaaaattaatgtacaagggaaatttcagattgtttttaaaaatgtttttatactgtgtttaatttccagtctcaaatttctttcctgtaaattatctatacatgtttaaattgcacttttatgacggtaaggcactttttacaatctttatctcatttttcatcaataacttaaaagtagcacgagcagatttatccatagaggggctgagttgctaacccagccttttttttttttctttttaaatggagtctctcactgtctcccaggctggagtgcagtggcgcgatcttggctcactgtaacctccacctcatgggttcatgtgatcctcctgcttcagcctctcgagcagctgggactacaggcgcatgccaccacacccagctaattttttttttttttttttttttttagtagagacggggtttcaccatattggccaggttggtctagaactcctgaattcaggtgatccgcctgcctcagcctcccaaaggctaacccagccttttaaccagctctgctttccctaagtagagatattttcttaagtttctcaaattcattctcttattatacaaactgtattaaaattcaaattaagatagtttttttgaagttatcagataatctcagtaattattgtgatttggatattctttgccctttgttgtggccaacccactgtctgaatatagatcagcaaagactcaaattagtttatttttttactcttaaaaaatcccttcaaaaatagatatattttgttttattttgagatggcatacttaaaatataatgaaatacttgcataattattttagatgaaaaaatgtcttgagtattaatcattcatattatctatttggtgcacagtaataaaaagttacagaactttactcagcttttgtgtttacaattataaagctttaccacttcattctgaacatcttaaaatttgatcagttattaaaaggttttacagaattggtatataatcttccatttgctctataatgaattaaactcattattattgaatatataaatgaattgtttgtctaccacattgtcctggtttttatgtgtttcctgccatttatgtgaacaagaatatatagagcatgcagtagagtgatattcagatcttgaaatagagtgaaacttaatcttaaatggcaccacttcatttaacatatttacctgaaaattggattattttgttacagattagatgcaattgctcgagatgctgagttagttgataagtcagaaacagaccttagacgactgggagaattggtacataatggttgcattaaagcattaaaggatagttcttcaggaacagaacgaacaggtaacattaaactgagagtgatttaaaagagaagtaaatgaaagcttcaaaatatgctttattgagctagatattatatcttaaattatttattcatcagtctcaaaaggttatttataaaacaaagtaaagctattctgggtaataggaaatggagaacagaattgcaattcgaaggcagtagaatctgtttttaattcccctgacattttctgtctgggaggtaaggtcagaaattactgttttatacacacacatatgtacattcatagatatatgtgtatatatacacacacacagtacaatatgtatagtatctataggttttttagtatagatgactgggaaaatataatgcaaatatacacatatgatattggtttgggacataattattttattattatgcttattttgctgttcatttacctgaataaaaattatttagataaaatttaataagcagaccaggcatagtggctcacacctgtaatcctagcacttttggaggctgagatgggagtttagcttgaacccaggagtttgagaccagcctgggcaacattgtgagaccctgtctctaagaaaaatgaaaacataaaaattagcagggtgtgattgtgcgtgcttgtagtctcagttacttgtgaattgaggtgggagggttgcttgagcccaggaggtcaagactgcagtgagcaatgattgcaccactgcacttccagcctgggcgacagagtgaaccctgagtcatcatcctataattctttatttagaggctgacggtattagtagattgatccatcttatgtaattggtaaaacacttagagaaatacttttcgtgaatttgcatctgcaagattataatcacttgttcatatgtaatgaagttcaaggttttccagtaatctcttaataatataaataaggaatacttattgttaaataacataagtaatagcatcagttgcttggtgttttgtagaattatgttttatacttttaaaaatactggtttttttaaaaaaaatcaaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtgagtgatttattttctccattgtaagatttttgttattcaataattgcaaaatgaatgtgctgaatttttatggtgttattggctagttttgaaaaaaaaaaggaagaaataaagcatattattttgaagttctaatgactcacgtttttcaaaattaatttttcagttaaggcaattacaaacttatcattagttattaactttgatgccaggtatactatcccatgccacacaaaggcagctcattttgatatagactggggcaaagaagatgattccaatttgttaattggcatctatgaatatggatatggaagctgggaaatgattaaaatggatcctgacctcagtctaacacacaaggtatttatctatttctgattctgttaaccattcatgttgaatttaatttattctaattcttgcttttaaattatgttggaaataatggaaatctggaaaccaaggcactagctggttgtgtgaccttggtgcgtttagaagatgctttgcatgaaaggatcaaatttaaatgatttctgagattttgcgttactgtgaaattatatgttattaaggcattaggtgtattatttttcaaattacgaggttaaaagtcttattccatcattagctttaaaaaaatttttgatgcataatagatgtacatatttttggatgcatgtgataatttgatacaatcatataatatataaagatgcaatcagggtaactggaacatttatcaccttaaatatttatctttaggaacatttaagtgattcttttctagctattttataatgtatagattattgctaactgtagtcaccctactcacctatcaaacactaggtcttatttcttccatctaactatatatttgtacccattcatcattaattttattattccagtaagacaaaatccttaaaatcttttatatttatttttaaaaaacatcggcattgtagtatttttggtcatttggttgcactgtgctagctgaaatcctttttttttttttttttttttttttttttgcctaaaatgggaaacactgggagaacttccttattgtttatcctgtgtgttgggaacctttagatattggtgctttgtcatttgttactgtgaagaaaaaattaagtagtctagattcccctgtaaaactttcctcccagtgtatgctttaggtcttcttctagaaggatgacatcttgtagtctaggaatttctgtgtacattatatataagtacacttttactgagaagggaaggtgtttaaggattatataacatttaatagtggatgttaagtacacttttgtatatttgaaggaaatttacaaccttatgctttctattttcattttgaaagataatctgagggtttttgaagtttagaattcattctcagaaaaattaaatttttggctctggcatacgtataaaaaatacattttgcattgagtttattcctacaaatattaataattgaaacttgttggtgaactatatatatatttaaatggttaagcattttttagccagtacatttctcatgttatttattaagacaatctgaaaaaatttattgctttttcagattcttccagatgatcccgataaaaaaccacaagcaaaacagttgcagacccgtgcagactacctcatcaaattacttagtagagatcttgcaaaaaaagaagctctttctggtgcggtaagttaaagcccacatgcctaagaccagtttactttttagtaaggtaaattttgtttacttcaccatgctaaacatctgaagtcaatatgagcttatataaatggatttttctgtaattaagtagttttatttgatgttgccatatttaaattttaccttaaattatctcagcatacatgttaaaactgatgaatcatagctttcagaagtaggattctgttttttttttctagttttagagagggatagagaaaactcgtttagcgtgcggagtactttttgagaagtcaagccttacatagcctacatgactgttttacttggagtcattagaatgcttaagggacagcgtcataggttgccaagcttactgaaaaagaaggaaaaagacaccaaaaaggaggtgattggaaacttagagcaactgttagaagtttacctgtgaccataatgtcaataactacctgtgtagcgttaaaaatcattcctaatgcagtctcttgtgctatagaattaagctgaaggccataataatctcagagggtaaaaaatttgtttctacttctctctgatcctttttttaaaggaataataatggctagtatttattatttacattaatattatatttgactcattaagttatatcacctttattgagtttctgatgttggtacagcttattaccaatagactaaggatcaggtaggaatatgtgttctagcccttggatttaatgtttatgaagtttttaaaaatgaaatctgtagaattggttaaaattaaaataatgatttttagggaagttcaaagaggagaaaagcaagagctaagaagaataaagcaatgaagtctataaaagtgaaagaggaaataaagagtgattcttctcctctgccttcagagaagtctgatgaagatgatgataaagtaagaatgtgttttagaacaacaaccttttctatggaaagggaatatggcatgtttttgtgtactttacatttaaaatttatattttaggtaccgaagtctgtgtgtgtgtgtgtgtgtgtgtgtgtgtgcgcgcgcacgtgcgcacgcacttatagttcataacagtctcaattatagaacagaattctaactgtccagtagatattatatagcactagaggcatagagcaaaggtccttccttttcaaacatttgccaatttgatgagcttctgtctcttttaattgtattatgaacttgaatgggactggcttactttagtttataggaaggtaaacattgcatgtatcattattagggggattctgggctctttcagaatccacatacatgcaatctgtagtcatatgaagaaaaattagtcgttgttaaaatttggttagtaatacattggccatacttgcactttccaggatgagatcagttctgtgaaacatccaaataaaaaaattaaaacagaaagagacagtgaagaaaaacctgagccagatgtttatataaagaaggaaccagaagaaaagagggaagcaaaagaaaaggagaataaaaaagaacttaaaagggagataaaagaaaaagaggataagaaagatataaaggaaaaagattttaaagaaaaaagagaaaacaaagtaaaagaagctatacagaaagaaaaagacataaaggaagaaaaggtatgcaaatcataataaaaaatgtagaaagtaaaaacaatcagcatatttacattttaggagactaaattgcatatcagcccttattagtctcaataactgagttcttcagaagcatgtttgggtatgcagtagaggagaatagtaggtctgaacactctttaatgctttaccttcagagtaacattacagagtagctttgattgtttccccaaataaaattggggaaaaaaacaaattaaaatagatgaggatattcaatgagaatgagcacttgtagaataaaatgagacagtaattattttctggaagtgttagtcattttgcctttgttgctattggggttttgtttttgttttcttttcactttttctttagttgagtgaatccaagtctgatggtagggaaagatccaagaaatcttcagtgtcagatgctccagttcatatcacggcaagtggtgaaccagttcccatttctgaagaatctgaagagctggatcagaagacattcagcattgtaagccttagactttctgattattagtattaactcataaaacatttaagttgaagtttgtcatttatagcatttaatttagaactgcatttgaatttattgtagattgataaaagcaatgtatttgaaatttgaagggtgtcttttttttttttttttttttcttttttgagttagcatctcactgtcgcccaggctggagttcagtggtgcagtcacggcccattgcggcttcaacctcctgggctcaagtgcccctcctgcctcagcctctcgagtagctgggactagaggcatgtgccatatacccagctaatttttagttttttgtaaagatggggattttttatgtcacccaggctggtctcgaactccttggcgtaaaagggagataagcctgggcatggtggctcacacctgtaaacccagcactttggaaggccgaggcagtggatcacctgaggttaggagtttgagatcaacctggccaacatggtgacactctactaagaaaaaaaacaaaaattaactgggtgtgttggcgagcacctgtaatctcagctactcgggaggctgaggcaggagaattgctggaacctggaaggctgaggttgctgtgagctgagattgcaccattgcactccagcccgggccgacaacagtgagactctatctcaaaaaaaaaaaaaaaaaaaaaaacaaggaagataaaaggaggccaaggtgggcccaggtgctgggattacaggcatgagctatcgcacccagctggtgtcttaaatttagaagcaactcggaaagactttttaataaagacttttaagaagaggggtttaacaagtactttgagtgaatttgttttcctccagctcgtatttcaaatttttaaattcccaatgccattaaaaaataaatatgtacacacacacacacacatgtgtaatagtgcttcttatttatggtgaaggactagtttttttcccagttttttgcagaccaatatattttttaaaaaatacaagaagaatgaaatgtttcactagaaaagtgaaataagaaaaaattatgtacaaaatatgagcctaatgttttgttagtagatgcagtagctataaagttgcattgtcaaattatgagtttctaaacaggctcagtttttgtaccgatgttgttttggactggcaatatctcttgtcaaatatactgattctccatgttgtcatgcctttgcgttcctcaaagtgagggagaaactatctgtgcctttattctaaagaccttatttactgaagataattataatttatgtatttatttataatttactcaatgtatgtattcataatttatttactgaatataattatatacttatgtaattacataatataacagtatgtatgtgcttaatagtactgactcttgaggcagaatgctatttggtaagtaagtatgaagattaaatgaattggtacatgtaaagtttacagatcagtgctgtcttcagaaaagctcagaaatcgataagtgattgttgtagatgttgttcctaaattcagacatgtgaagcagataagagtgagactaaaaagtccaattgcagagcaaaaccaggaagaaataataatgttagagaaaaaagggctgagtgatacgagaccgataatgtagtttggctttaactaggactaggaaatgtttccttacaagccacaactgaaggaaacacttatagtctgatatatagatgtgtcatgtttatatatagttacaatatacacaaatttatatataaatatatattcctatatttcctttttagagatttctagcatctgaatcttttatactagttggagcagttaacatacttcagtcacttgttagacttgggtgtcagctttatcactagtattaatcaaatgctatacttcaaagagggaaaatttcaccttctaaaattatatttgttttcaacccattatgtccttctagatccccagcttatcctcttgtcctactttctcttcttttgcaccgtgactagacagtgttgatttaatgaacccactaatgtatttcctactgattccacaacatgccctaatatagttcaactattgttcatgctctttaaatatattggttttttaccatcctcttgttctccctactttgagctgttgacattcttccagtcactgggagtattggagacattcaaagctgctgcagctcctatcttccattttatttatttgagccatattttttatctctggacttttatttttatctcctctgcaggttcacaggctggaatttcttctctctttttcaagggtaaccgtttttgtttttgttttttgtttttgtttttgttttttacctactctgtattgggtgggagtcaggggaggtggtattctttagcttttttgaagtgaaaacattaaacttttcactggagctacttccccttctctatgtggtctactaatgaattaggtgaaattgtatctcttgccacttttttttcccccacatttcttttttaatcttcggactttttcatgtaactgctggaatggaaaaattcctgctgtgcacaatgcatgaatttcctctccattaatcttaaatgatattgtgtgtatcatggaaatgaagactggaatagttcttaaacgtggactctgtagccagactttctggcctgtataggattttacctctaagtaaggaattccattgtatttgggaatagctctaagtaattatgaaattcaatggccttttctaggtcgtcactctctaaacatatttgcttcatttggcaccttgattttccttttactggttgtcttcctaaatgacagtataatttagcagtcaagaaagagcagagtctgaggtcagttagagctgggtttgacagatgtcattgtattctaagtttcagtttcttctataaaatagattaaatactattgcaaaggactattgtcagggtctgttcttattgcttccatcctactcatacctcagtttgtactccacatagcaaccagagtaatcatgacttagagggagaataaagtcacaccgttatatttctgtgcctacaacactccagtggctttccatctcatttaggagaaaagattcttagcctgaaaccagcctcgtagcatctagtcacctcccatcgttgccggccacttctctgacttacttggttccagcgacactggcattcatacttttttaaaaaacatgtcaaacaagttttaggactttcatgtttgttttttcctctacttggaatggcttgctccttcattttctttaggtgtcctctcaaacattgcccttctttgaaatcttgcttatgataagataggaagctccctgctctttcttcctttatttttctttatcacagttgttgtcatctgacatactatttcttgttcatttactggctctcttatactagagtccaggttccataaaggcaggatctgttttacttacagctctatttcctgcatctggaacaatgcctagaacatagtatgtactaaacttacatatgttggataaattattttctaacagaatataaactgccaaagttgaacaaaaaataggaaacataaaagcaatgaataaactaaaagttagaaaggaaattaaagattttccctttcttaaagcatcagatctgactgaattctaattttatttataataagagaggtccttcaaagcagtggtgtgaggatttattattttatttttttgaaatagggtctcacttttgcctaggctgcagtgccagtggcatgatcacagctcattacagtctcctgggttcaaacagtcctcccaccttgacctcctgagtagctgggactacaggtgtgcgccaccatgcttggctaattttttttttttttttttggtatagaatcaggatctcactgttgcccaggctgatctcaaactcctggactcaagtgatcctcccgcctcagcctcccaaagtgctggggttacaggcctgagccaccatgcctggcccaatttcttaataaatgatgttggattatctaaatgcattgtctgatgttgacccatcatccttatattcctagaactaaaccagcttgctttctgtgaatatgatgttaaatttttatttgtttttgcatttacaaattttatctgacggttgccttgttagtaatatttttattctgattttggcataaggttatagtgcctattgctacaataaaacatgcaattcttaatatgtcatccttttattagcatgtcaggaatgtacaggccaaggaaaaagttaccctttgaccctctactccccaaccacccaaaatatgaagagcaagccattattgccaccttctgttatcacaaaggtttggaagaatacagtttatatatctagctatattgattttaatagttttgctaaaatcattttaccctgtatttagtggatagtagggtattaagttatactctgaaatattttactatcttttaatagtctatatttaagactccttagaatagtgtgctacaatataaaaaataaccatttttgtagaagctaagtaaaatccaaaacttttacttactcaaagactgattttaaatgataacagaaaggcttgctctcctgaagaaaatctaaaggggaaagaaccctgatgtataagatttgtgaagtgagatttaattgcttattttgctatcaaacagtgttataatattatactcatgtaaatatcattgaaggaggtagaccttgttgaatttaggtttttaatacatgtgtttatattcttgttttctcattttaaagtgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaagtaagtgatacacttttcaggaagtgttaaatttatattatataactgtctttttttttttttgttttctttcctgattctgaagtttaggtaacaagataatttttaaagaggtaacctacagatgattgttttaatttttctccctttaatgttaaatttttttatttatgagtggttacttatgtatcatggtatgtaacaagtggcatctctgcctttaaagaaatagtgaaagctgtttcattaaaattcagattgcattttatttgaaaaagtctttgcaatttaccaaattattatcagtaatatcttttgaagttggtgttcccacaaagtttattgttgcttgaatttagcaatttacctcctggatacatgtataaagatgtaaaaattaacatcctcacgcaatgtaaaatgcaaaaaattaggaaaataaaggtaatgtagtgcaaattgttcttaaagctaaatttagctaatctaaaggattatattaaaattcttctctacttttattagtgtaaaaatgcttggcttctatcttttacatttaactggaactataaaatttgaaagcctggcaacttctcttttaaataatgccttttgccaagaatgggttatcattttggaggaccactgaatgaaaatacttagttgtatcttcaccaattttttgaatccttataattagggcttagatttttgaggttcaaagagttagaatgtctaccttttctgctttctagatgagaaataaggaacatcttattgaaattacacagtgaatttggttgaaagtaaatttaaaaatgagcaaagaattaaagaatttgaaataaaattttaagtaaaataaaaaaagttacacagtgactaatacaaataggtaccatttcaaattcggtttgttataaggaaagggtggggaaacctttggaagaagagagactaatagccaggagacttaactttttcattgtgttctgtcactttacatcctaaggctgtgctctcacctcacttttctttactcagttgggcagattacctttttggttttcccctgtttggttctcagttactttgatttcatattccttattgttcattcctgctgccactctctctggttaaaccaaattcccttaagggggagatggggaaggaaagagggaaatatcccataaagcaaaatagcttttgctgtcttggagaaattttattttgatttatttatttttttgagatggaatcttactctgttgcccaggttggagtgcagtggcgaatctcagctcgctgcatcctccgcctcctgggctcaagctatccttccacctcagtctctttggtagctgggactacaggcccacgctaccaggcctggctaattcttgtattttttgtagagatggggtttcaccatgtcagccaggctggtgttgaactcctgacctcaaggaatctgcctgccttggcctcccaaagtgctggggggaattttttttttatttttaatgcagaaacaagaaaaaaaagtaccttatattaagacctatcattggctgacccgatcccctcaagaacagtcattgtgggctgggcacaatggctcatgcctataatcccagcacgttgggaggccaaggtgggcgcatcacaaggtcaggagattgagaccatcctggctaagacggtggtctactaaaaatacaaaaaaaaaaaaaaaagtagtcgggcatggtggcatgtgcctgtagaaccagctactcaggaggctgaggcaagagaatcgcttgaacccaggaggtagaggtcgcagctattttgctttaagggatatttccctttctttcctgaatgaaagaagatagagatctaaaccacaattacagaacagttggcattaagcaagtgttacagtagttaccataatgatctttttgttttttgcttacaatttttttcaatatattttttgaccaaatttcttaaaaacaactgaaatgcaagactagtttttatttaaagatgactgtaataaagtgatggccaaaatagaatgtatatttgtattttgtcttattaaatatgcctcattctagctgatccttttaatagtattgtagaaaatgtgaacagatatttactattccattttacagaagaaaaaaatggattcagatgaaaagcattttagggctgggactggagaatgacaaaggaaacacctaggacctgaactgtttaaaagaggcactaattcttaggtttgtgtaagtgctgacgcttgcctcagctctggtgctttgttcaagatcagacagtcattcggatgatataattaagaccagaatctgattcctgactagattttttggggggaaaatatatttttataaggaatttacttaggaacaaaaaggtactttattaacttcctaccttttacccttataagttaatcgtagaatgtagatatgttcgagatagtctgtgaatttatataaaggctagatgaattttccttcttctgtggatttcatttcagtaaggtatcattcaatatattctcaaagttcattttaaaaatatatttcaaggtaaatattatacctctagtgtatatttgaatcttctagggatactaccctaacttagaacctaacattccttttctttttggaggtatatttgacaattacagttccttatatatttaaggtatacaatttgatgatttgatatacacatgcattgtgaaataattacagtctctgattaattactgatgcctcccttgggatgggaagagatagcaaactgtacctcatttatggtgtttggttgtgttactcttgggaccattacattaccattattaagtgacagttaactttttaatgcattatttaagacaattctttacaagcataattcatattatctgatggtatttccactccagttattaacatacctgtcccttatatgcataatcaggatcacaatatgaatctgagtcacttcctgatttaatttatgtctttggtgcatttcaaattaggattgtactgcttttcaccctaaagactataaaatgaagcgatttggaagagaagtaaaatttaatgtttagtttcactggagtcttagtcatatatgaagttttgaaaaaatgcataggaaaattaatatccttaagagtttgttccatagagggctgtgtatgtgtatatgtgtttgtgcctggagggaaggagttccatgaaaaaaactaaatattttccaccagactaacttaatttgcctttttttaaattcttctagaaacctgtggatttttgtatctaagtttactgaatttgatgcaagaaaattacataaattatataagcatgctattaaaaaacggcaggagtctcaggtaaacttgacatcatattttttccctgaatttatataattaaaaccttgagacattctttttacagagcagtttgattaataaatacagaatgaataagataaatttaaaaaatcaccattgaacaccacagtaatgattgttgcaggcgagattcacagaagagaggtaaaattaatgggcaagaaaacaggatattggcagatctcctctgaaatgtttattagttataaagggaaaataataactttatagagaaacttgcctgacccaccttaaacaagtgatcaaagttaatgtcaccaatagttaagacatatcagcatcatgaaccctctgatactgagaaaggtacatcacttatgtggaattcttgccaaaaatatatgtgttattatgtgaaaatatcagacaagccctacttgacggatattctataaaataactgtctgctactcttctaaagtgttaagagcatgcagtagactaaggagctgtcccagaggaagacgtgacaactaagtgtaatatgggcttccaaatcgaatccccgagcagataaagaacattagtggaaaaatgtgaaatctgaatgaagtctgttcttcaattaatagtgttataccaatgttaattatttggttttgatcattatactatgtttgtataagatattaacattaggagaagctagatgaagggaactcagtatttttgcaacctttctgttaagtcaatttatttcaaaatgaaaaaatatctttaagtcatgggacaagtagttcatgctttaaaaatggagatctataaatgtcatacatgtatatatacacacataaacattctaatatcttgtgtgaagacttcattatcagtattttctaagaattatctgtgcttttttgtaagtttgtgaagtcacctaaagattcttaacacgtgtgcatttattttagcaaaacagtgatcaaaacagcaacttgaatcctcacgtgattagaaatccaggtatgtaagccttactgattgggaaaataaattaaaaaaaattttttttaaatttttgttttaaataaaccaaatgataaaaaaggttcttaccttgtttttatttataagtacctttatattaaggagatacagtaattctgatacatacctacattattatgtaaaatgtattctcttaaactgtagttcattttagtttattatccttttaatcatccttttctcagtttctagaaattgtagaatgactgttaaaatgaacaaatattcttttttatgtaatttggaatagtaatgcattctttctgtatcagagtcacaaaagtatagtctgagaaaggaataggtcccatattttttagtttttgtgacatttcagaatcaagcaaccttttttaattaatccttagtactgcttttatacaccatttctaaatgctttaactgcttgtatttgggaaccgattttgttttggcaagggttgaaacgaattcttgttatctatcaactaagttttttttgccacattatttttaaggtcattaataaaagttgtacttatctaacagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcaggtaaacttggcagtcactttagaaattttgcttatgcatgtttttctccttatcatgatgttcctgtatttgacctgtcagccaattcaatcttcatgcagtcaaaacaaatcttgtgaaataaaggtgttgtatataattaagaaaaatgtatatattttaagaactgaatttctctataaaatggattttgaattataaaattgagatcaaaatatgtagtaaggtgatgtagggagttgtatgattataaattgcgtggggttcattgttcgttttgaagaatattggctcaaatactctttaaaatataataagtgggataaaagcttgatataatagtgattcaggtttggtttaggaaattttgcattccatatttttaaaaagtcgggaaaaattaatatatgtgaacacatctcattgaggtaaaacttaacctcagcaatctggaatattattggaaccaggaaggttttttgtttattgttttttgaagcctttgaacagtaagcaacctcagtgtaataacatcagaatactttttattcctttattgataaagaagtattttcggtagttaatgatcactactaaaagtaaacttgaaaactgagatttatagtatttatgcttttatagtaagtagaagaaacaaattagaagacatctttgtattttagtgttcattacaataatttctttgagaacctctgtcagcactatgaacacatcagttgtagaatggctgttatttgaaggggtcaaataattaaaaggaaaaggcagatttatagtatatatttcacaggcttatgcaatatagttacagttgtgtgtgtgtcagtttggaaaaggcactcattttagagaataattctcattaaactgccacatttattttttatcaagctgtcacatgtttgtatggagtaaatttcgtaatgattcatgtgtcgagtcttactatataactagtcaaacttgaggaagcttttaataggcatcagcaaccagtgaaaaatttttcagcatagactgcattctagcatttttaaactttttcctgcttagaggttggtaaaaggctctggtctcaggagtatttcagatagttgtaataatcttaatttcagcttccagacaattaagatgcagtcatataaatgatgtgtaaaataaaaagcagctaattatctaaaatagccatgtgaaattagatgctattttaggggttttgtatggttcgctttagttttatgaatcaaatagtttttccaaagagatatatccagtgatttttgagttaattaagtaagttttataatgcaacactgagtttctatacaattaaaaacatgttttaaggtatttttatgttttttagttatcttttatttggaaacattttaatttgcatgatttgtctaaaattctcaatttttctttattagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgttttatgtgggcaataatgtcaaatgtgctatgcagccaggttaacattttagataaacttgattgacttttaatataaactgttacaatgcacactgattgtatataaaaacgttatatatgacaaattaaatttaagaaaaaggatatgtgggctcctgtaattttctgctgcattcttactccctcaagcacttaccaccaccaccaccgccccctacccccgtttttaagtaacattttgctgccagaaaaagtattttggtaagcagttgaatatttgtaatgtgtagcattacaactaaatctgttttggagactatgaatattcctatgaagtaaaacttaggtcatagacatttttgttggccccttttggcttcctacagatattattatgggatgctttatatttattcacagatttttattttgttttatattcagcgggaagtttttaagtcatgtggcacacattcttgcatgtatgctttgatgtaacaaatttgaatctttgacgaatataagtatgtggacataatttctatagtattgctatgtgtgtcactgttaattagctgtgggagcaacctacagatatttgtccataggtgtattttttaatattttcctttgtccaattaggtttatgtgtataaaagcttgtgggtttttttgctttttgttttgttttttgcagtaatttctctttctgatacagttaccctgaagaataataatgctttgtttcttttctggtatatgagagaacatgtgagggagtagctcagttttttaaacatctaatttataattaaatataaaagtaatgaaggtagtcctggcacacatttttgaaacttttatcacttttctctacatttagtatgactattttattccacaagatagcatttgactaattcataatgcttaagtcataagatggtggctggcattttttaatttattactaaaagctaagatatttgcattatattgtgcaaatttcacagaacaatgttgcattttctgagataaggctctaattttttaaatagtgctacatttagttgaaagtttcagtcagctagttagctgagttgaatgaaaaatatagaactgtatgtacatttatcaaatgataaaatatgttcatttttgtaagaaatcagaaaaattaagacgcaatggtgaagaacattagtacataaatatagcagaacattctccataaaatattctgttttcattctgctttgttatttttatccagttatgtttaatttttcaagggtgagagattatgtatagtactgtaccaattaaccttccacttttatacaataaataattcttactaaaagcaatagcctgtttgcttataaagatattctttgtttagagtatgttagaaattaattttcagactatggaaaatgagtttgaataattttattttcagagtgagtagcttaatgagaacctttttaattttatgtaatataaattataatttctttttgtagttaatatgaaaaggttgagtaggttattcattttcatgaagtttatcaagaatatgctctaggagtaaatggcctga

SEQ ID NO: 15322 - DNA, 7070 bp, Human; identical to SEQ ID NO: 12469

SEQ ID NO: 15323 - DNA, 13795 bp, Human
  misc_feature (1)...(13795): n = A,T,C or G
ggaaaggaaggtggcctttattaggacctggagctgataggcagagcatgagcttggctgtttatggtcccaagtacccatggcggcggcagaggaggagcctggaaagaacgccttggaggtctgccaaaaatgcaatctgtgccctgccccttctagactgagagcccctgtggacagagccatgtgctaagtacttggagaaaggcaaagggagtatcccaaggagtctccagtctgagggggagacacagcccttagcctcagaaagcctcagtgtgctgggggaacatcgcctccagctctcctcctcctctcagagagctcccaggcagatcagggacagaaagcccctgccttggagtggctcctgtataatagagaggcacagcgtaactccagggtcttcactctgatagaagagacaggatgacatacttctcttgtacaggacagtaggacatatgaggagaggggctcctaaatctctatagataaagttgtaactaccccaccctcctgtgagcccctgaggtacaaacatgtctctttctcctgctttatcctgcccctgagcaggaagacagcttgaatgtatgttctcagtttatccagctgtccctaggaaaccccgatccttcatattccctcaacattgagcccttgggacacctctctagataatgtgatgggggcattgccacatcaccaaagccataggccactgtccagagctgggattcagatgactgtggacctactctctcccacccagaagtagcctgttgccttgtgggagtgtccccctgccagttagtgccaccctaccccaagtctgtcctcactacaagtacccttttttatttttatttttattttttgagacagagtcttgttttgtcacccaggctggagtgcagtggcacgatcttggctcactacaacctctgcctccaggtctgggttcaagcgattctcctgcctcagcctcccaagtagctgggactacaggcacgtgccaccatgcctggctaatttttgtttgtttttttttttgtttgtttgtttgtttgttttgagatggagtctcgctccgtcgcccaggctggcaggcagtggcgccatctcggctcactgcaacctccgcctgccgggttcacgccattctcctgcctcagcctcccgagtagctgggactacaggcacctgccaacatgcccggctaattttttgtgtttttagtacagacggggtttcactgtgttagccaggatggtctcgatctcgtgacctcgtgatccacccgcctcggcctcccaaagtgctgggattacaggcgtgagtcactgcgcccggccccctttcttttttcttttctttttttcttttttgagagagtctctctttgttgcccatgctggagtgcagtgaactcgatcttggctcactgtaacttctgcctcccaggttcaagtgattctcttgcctcaacctcccaagtagctgggattacagccgtgcacgaccatgcccagctaatttttgtatttttagtagagactgggtttcaccatgttggccaggctggtctcgaacccctgacctcaggtgatccgcccgtgtcgtcctcccaagcgctgggattacagacgtgattcatcgcgcctggcctacaagtatcccttctaactgagggcaactgtaaaggaagtagggcatagaagaatagtagtgggccctgtgcccagaagggaggaggaggaagaaaaaagggggtacttagggtaccctacccacaggcaggccccagacagcagctggagatagccaaatgttaatcaccaattagcacagttcaggtggaaagggcaactctattatgtgtaaaatggacttaatgtggcaggagctgtgggcttaatttcttgagataagatgcttttaggctaatcagcaggtctatgcctaatataaaggagctggggcatgatttcttcagcaggctcagaaggtccagaaatcaggggaaggagacccctatctgtccttcttctggaagagctggaaaggaagtctggtaagagaagtggagacagggatggatgagatgacccgagagcagatggatcttggcaaccctgagatgctcagcagccctggcatcttagttttctcttcctctatatgagatgtgagaagatagtcaggtgcggtgcctcatgcctgtaatcccaatactttgggagccgaggtaggaggatcatttgagcacaggagttcaagaccagcctgggcaatggagggaaactcgatctctacacataatttaaaaaattagctgggcatggtggtacatgcctgcggttctaggtactcgggagggtgaagtgaaaggtttgcctgagcccaggaggtcgaggctgcagtgagccacgattgtgtcactgcactccaacccgggtgacagagcgaaaccctgtctcaaaaaaagagaaagagaaatgagaaggtagcgctgatgtttcctttatttatttatttagagatggagtctcgctctgtcacccaggctggagtgcactggcgcaatctcagctcactgcaaccctgcttcctcccaggttcaagcgattcttgtgcctcagcctcctgaatagctgggatcacaggcgcgcaccaccacacctggctaatctttgtcttttatgtagagacaggatttcaccatattggccaggctggtctcaaactcctgacctcaagtgatccgcccacctgggcctcccaaagtgctgggattgcaggcatgagccactgcacccagcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtctctactaaaaatacaaaaattagccgggagtggtggcacatgcctgtagtccaggctactcgagaggctgaggcagaagaatggcttgaacccaggaggtggaggttgcagtgagccaagattgtgccactgcactcccacctggacgacagagcgagactccatctcaaaaaaaaaaaaaaaaaagaaaaaggaaaagaaagggtccaaacctcagggctttgcccctctccagctttcagaacccctactggttgctctctcaacatgtcctggcttttttctgtcttagctcaggaaataaccttggaagatggtggccacgaagacctttgctctgctgctgctgtccctgttcctggcagtgggactaggagagaagaaagagggtcacttcaggtaggagtggtgagaggaaagggatggggcagaggaggggttaggggatgacaggttctggatttgtttctagggggagatgagaaagggaaggaatccaggctaagaggtaggaagctccagggaaatacctgccggcagcgtgagtgcaaagtgagcactgagccagagaggatttattgtgtgctgctgttacagtgggagagactatggttagatctctggcgggacttcctggtggttaattgtccgaagatgacagaatctcccttcccaataaatgttttattcatttatgcatgtttgcttctttcttttctttttttcttttttctttttttgagacaggatcttgccctgtcgcccaggctggagtgcagtggcgtgatcgcagctcactgcagcctctgcctgccaggctcaagcatcttcccatctcagcctcccgagcagctaggaccacaggcatgtaccaccacgctcggctagtttttgaattttttgtagagatgaggtttcgccatgttacccaggcttatgaatgcattcttttttttttctattcttttctttttctttttttttggggggggatggagtctcgctctgtcacctaggctggagtgtggtggcacaatctcggctcactacaacctctgcctcctgggttcaagcaattttccctgcctcagcttaccgagtagctgggattacaggtgcccaccaccacacccggctaatttttgtacttttagtagagatggggtttcactatgttggtcaggctggtctcgaactcctgaccttagatgatccatccaccttggcctcccaaagcgctgggattgaaggcatgtaatccctgtgcctggccctttttttttttttttttaattggagtctcactttctcgcccaggctggagtgcactggcgcgatcttggctcactgcaacctccgcctcccgggttcaagcaattctctgctttagcctcccaagcagctgggattacaggcacctgccaccacgcccggctaacttttgtatttttagtagagatggggtttcaccatcttggccatgctggtcttgaactcctgacctcgtgatccacctgcttggacctcccaaagtgctaggattacaggcgtgagccactgcgcctggcctgtatcatgtagatgttaagaacatagatctgagcccagatggcctggggtaaatcctggatctgttacctatacggagtggcagataataagacaataataaggtaatctctgcaccttggtttctccattcacaaaatggggatataaatagaacctacctcataggatgttgtgaggatgaaattattttatggattcaagggcttacacagtgcttctcagagctttcgtatgagttgactattgttatggaatgtgaaccaaggaattgaatcaggaagggccagggcaggaggaataaaggagggaattgtgtgactcagtcttttcagatgaggggaccccgatcccttttttttttttttttttttttgagatggagtctccctttgtcacctaggctggagtgcagtggcgcgatctccgattactgcaagcagcgcctcctgggttcacgccattctcctgcctcagcctcccaagtagctgggactacaggcgcctgccaccacgcctggctaatttttttgtatttttagtagagacggggtttcaccatgttagccaggatggtctcaatctcctgaccttgtgatccacccaccttggcctcccagagtgctgggattacaggcgtgagccaccgcacccagccttttttttttttttttattgagacgaagtttcgctcttgttccccaggctggagtgcaatggcacgatttcagctcactgcaacctccacctcccaggttcaagtgattctcctgcctcagcctcctgagtagctgggattacaggcatgtgccaccacgcctggctaatttttttttttttgagacggagtctcgctctgtctcccaggctggagtgcactggcgcaatctcagctcactgcaagctccgcctcccgggttcacgccattctcctgcctcagcctcccgagtagccgggactacaggcgcccaccaccatgcctggctaattttttgtatttttagtagagacggggtttcactgtgttagccaggatggtctcgatctcctgaccttgtaatccgcccgcctcagcctcccaaagtgctgggattacaggcgtaagccaccacgccctgccaacgcctggctaatttttgtattattagtagagacgggatttctccatgttggtcaggctggtctcgatcccgacctcaggtgatccgcctgccttggcctcccaaagtgttgggattacaggcatgagccaccgcccctggccccgtgatctctttttgcccagaatccagagccacacacactgaggctgcaggaagtgggccctggagctgaggataaagcctggggtggggtgggggagtggatccacagggagtctccataaaaacggactggtttgttttcaagtgtctgcctcctgttagtgacagtcatttaccctagcattgtgattctccccccatctctgccccttctccgcacccttgtttccagcgctctcccctccctgcctgttggatctcatgctaaggtgagcagccctcaacctcgaggccccaggtacgcggaagggactttcatcagtgactacagtattgccatggacaagattcaccaacaagactttgtgaactggctgctggcccaaaaggggaagaagaatgagtgagtcgctgcttacactcctcctgttccctgtgccgggctctgccttcctaccttcagaggaggccaccggctgtggccacacaggccacatgatgcacaaccccaggtggcacctttctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttgtattttcagtagatacggggtttccccgtgttagctaggatggtctcgatctgacctcgtgatccacctgcctcggcctcccaagtgctgggattacaggcgtgagccaccataccccgcctctctctctcttttttttttttttttttttttttgagacagagttttgctcttgttgcccaggctggagtgcaatggcgcaatctttgctcactacaacctccaccctccacctcctggattcaagcgattctcctgcctcagcctcccgagtagctaggattacaggcatgtgccaccacgcctggctaattttgtatttttttgttgttcttttgagacgaagtctagctctgttgcccaggctggagtgcagtggctcgatcttggctcactgcaacttccacctcctgggttcaagcgattcttctgcctcagcctcctgagtagctgggactacaggtacgcgccaccatacctggctaattttttttttttttttcagtagagacagggtttcaccatgttgaccagtctggttctcaaactcctgacctcgtgatccgcccacctcagcctcccaaagtgctgggattacaggcataagccactgcgcctggcctaattttgtatttttagtagagacggggttccatgttggtcaggctggtctcgaactcctgacctcaggtgatccacctgccttggcctcccaaagtgctgggattacaggtgtgagccaccatacccagcctgggtggcacctttcaccaggcaaggatggggagtcagacatggtagctctggccaggaccctgacttgggcaccagtctaggctaggggtagggaccagggctattccctaatcctttacttctttttttttgagacggagtcttgctctgtcacccaggctggagtgcagtggcacaatcttggctcactgcaagctccgcctcccgggttcacgtcattctcctgcctcagcctcctgagtagctgggactacaggtgcccgccatcatgcacggataatttttttgcatttttttagtagagacggggcttcaccgtgttggcctggatggtctcgatctcctgacctcgtgatctgccctcctcggcctcccaaagtgctgggattacaagtgtgagccactgtgttggccctaatcctttacttcaaaggggaggagtcagaagatgtatgggagctcagagaggatccccaggggtctgaggatgaagcaagggagagacgagctccttctaatgactgcttgcttggcggtggccactttagactttgaaaacaggattggctagggccaggcccagtagctcacacctgtaatcccagcactttgggaggctgaggcgggcaaatcacgaggtcaggagcttgaggccctcctggccaacatggtgaaatcccgtctctactaaaaatacaaagattagctgggtgtggtggcacgtgcctgtaattccagctactcgggaggctgaggcatgagaattgcttgaaccctggaggcggacgttgcagtgagctgagattgcaccactgcaccccagcctggcaacagagcgagactccgtctcaaagaaaaaggaaagaaaataggattggctgttcatggtggctcacacctgtaatcccagcactttgggaggcccaggtaggtggattgtttgagctcacgagttcattcgagaacagcctgggcaacatggcaaacaaaaagtacaaaaatcagctgggtgtggtgatgcctgcctgtagtttcagctactcgggaggctgagatgggaagatggcttcagcctgggaggcagaggttgcagtgagctgagatggtgcccctgcactccagcctgggcaatacagccagaccctgtctctcacacacacaccaaaaaaaatgaagagaagattaactgtcctcgtccttctccctgctctatgccaagtctctttccccgccctctctggtcagcacggtagattctgaaaagctgttcactggtggaggcagctgaagaccactgataggtggggttgagtggaaaaaggtaccctctgcttttggggttcaggtattaaaagattcaagtgtccctagactggagtctccgcagcttgcccactctctaatctttatcttcccagctggaaacacaacatcacccagagggaggctcgggcgctggagctggccagtcaagctaataggaaggaggaggaggcagtggagccacagaggtgagtcagggcgcagagggaagggagggagccaagcctcctgccccgcccccacctctttgttccctctccctgaccccagagcagagcaaggacctgagataagcatcctcttcctctcagagttcaaagaggggtcttcattgagcaaactcctggaggtcagcccaagcttaaggaagaagccttggagaaacgggaggggtgctaggaggggtttcagggacagggtttctaatattgatgactgcatgcacagcacagtcactgagtcaggagaagggcaggaaagaagagacctcaggtcctggcctcaccacctctccctgccaaacctcgggaagactgtttgtgaaagagcgggggatcttcccaggcccactcccctgaaatcagttatcccctctctgaatggcacaggtcatttcaaagagtgaatgtgcccaaagtactctctgcattctggaacactggcagaggtggatgggcagaatatctcataccagaattctgtttgactctccctgtatgaagagtccatattccccaggcaggcagcgctgggtggggctggcagaaaggaggctccagatctcagagctgagccaacggagagacagctgtgtcggctccctccccccatccgcggctgcccctcagtggtgtccccaaccctgtgtttaccctctctgggcgaggctcaggctaaaatagttagccagagactgttcccttgcagctccccagccaagaaccccagcgatgaagatttgctgcgggacttgctgattcaagagctgttggcctgcttgctggatcagacaaacctctgcaggctcaggtaggggagtgtggtgttgcacagcggttctaacttgagcttgggcatcagacatggattcagatctttgcccctccacatgctggctgattacatagcctttctgaacctcagtgttttcactaaaatcagaggtatagaatcatttcacaggattgttgtcagctttaagtaagagaatgcaagtggaaaaatacaaagaaaaaaaacaaaagaaaaaaaagacaattcaagtggagacctgagggccatctttgaggagtaataagagctcagcaaggttagtagctctgattactatttgttcttcttcctcactcttccaggcgaggtgatgctctcccctgcctatccctacctgcctgtctctacccacccagagcccatcctatgccccgcctgtccctacccaccgagctgagcccatcctgtgtcccgcctgtccctacccaccgagctgagcccatcctgtgtcccgcctgtccctacacacagagctgagcccatcctgtgtcccgcctgtccctacacacagagctgagcccatcctgtggcctgcctgtccctacccacagagctgagcccatcctgtgtcccgcctgtccctacccacagagctgagcccatcctgtgtcctgcctgtccctacacacagagctgagcccatcctgttctcagctttccctctgtacccttgggccatggcaccttcctggtgatgggaaactacatagttagaggcaagtttccttcctctgtggccactgctggcttcaatggtctcttgaatccccctcatcagctagaaaattcttcagtccattccttatgtcccagaatcgaggcactaaatattatgaagagacctgtccacctaaagggtgagacaggaccctcatgatgcagacacagaggcacggaaaccaaaacacttcagacattgatgctgagcagctagggagggattgagggagcaaatctgggacaggaacctcaggaggggaagaagggacaggagtgtgagcagatccatggagaagagggtgtaagaaaatctccgtaagaaggtggatattgtgaattattttgattacttatcattaaaatggtgatttgatgaggcaaaggtgggagcattgcttgaggccaggagttcaagactgcagtgatctatgatcacatctgtaaacagtcactgcactccagcttgggcaccacagtgagactgtctcttaaaaaataagtaaaatgaggccgggtatggtggctcatgcctgtaatcccaggactttgggaggccgaggagggtggatcatgaggtcaggagatcgagaccatcctggctaacacagtgaaaccctgtctctattaaaaatacaaaaaattagctgggcgtggaggcgggcgcctgtagtcccagctactcgggaggctgaggcaggagaatggcgtgaacccaggaggtggagcttgcggtgagccgagatcgcgccactgcactccagcctgggcgacagagcgagactccgtctcaaaaaaaaaaaaaaaagtaaattgataaaaattaaaatatttaaaaaggtgatttgaaggtaggaggggttcaacaatggttgggtcccaggataaatgtgcttggccgactccaagtccataacaaccttcttctcctttccccactctccccaggtctcggtgactctgaccacacccagctcaggactggattctgcccttcacttagcacctgcctcagccccactccagaatagccaagagaacccaaaccaataaagtttatgctaagtcgagcccattgtgaaaatttattaaaatgactactgagcactaacagggcatgtttgtctttgtgtatctctgtgtgtgggcaccacccaatgaaaaggaaatatggtctgggcatggtggcatatgcctgtaatcccagtactctgggaggctgagtctggaggattcgcttaaccccagaagttcgagactaacctgggtaacagagtgagaccccatctttttttttttttttgagatggagtcgcactctgtcgtccaggctggagtgcaatggtgcaatctcggctcactgcaacctctgcctcctgggttcaagtgattctcctgcctcagcctcccgagtagctgggattacaggcgcccaccaccacgcctggctaaattttttttttttttttgagatggagtcttgcttttgttacccaggctggatggagtgcaatggtgagatctcagctcactgcagcttctgcctcccaggttcaattgattcttttgcctcagcctcccgagtagctgggattacaagcatgcgccaccacgcctggctaattttgtatttttagtagagatggggtttctccatgttggtcaggctggtctcgaactcccgacctcaagtgatccgcctgcctctgtctcccaaagtgctgggattaaaggcatgagccactgcgctaggcctaattttttatttttagtagagacgaggtttcgccatgttggccaggctggtcttggaactcttggcctcaggtgatgcgcctgcctcggcctcccaaagtgctggcattataggcatgagccatcgtacctgcctgagaccctgtctttaaaataagaaataaaaagagggccgggtatggtggcgcaagcctgtcatcccaacaatttgggagcttgaggtgggcagatcacctgaggtcaggagtttgagaccagcctggccaacatggcaaaacctcgtctctactaaatatataaaaattagctgggcatgatgacaggcacctgtagtcccagctactcaggaggctgaggcaggagaatcgctttgacccaggaggcagaggttgcagtgagctgagattgcgccactgcactccaacctgggtaacacagcaagactgtgtcacatacaaaaaaagaaaagaaaagaaaaggatcatttgaggtcaggaatttgagaccagcctggccaacatggtgaaaccctgtctttactaaaaatacaaaaaaaaaaaaaaaaaaaaaaaagaaccaggcgtggtggtgcacgcttgtaatcccagctaatcgagaggttgaaacatgagaatcacttgaacccaggaagcagaggttgcagtgagctgagatcacaccactgcactacatccggcctgggtgacaaagtgagaccctgtctccaaaaaaaaaaaaaaaaaaagaaaagaaaaggaaatatggtttttacttgcatctgttaattcatctatttattctacaaacacttattggaaagttaatattggcagggctgtgctaaacactgtgtatacagcaatgaagaaaatggacacaatccttgcccccgaagagcttaaagtctggtgacaaagacctctagtttttttgtggttttgtttgttttactgggagagtcttgctgtgttacccatgctggggtacagtgctgtaatcatagctcactgcaaccccgagctcctgggcttaagcgatcttgccacttcagcctcccgagtagctgggagaagttgggactacaggcatgtgccgccaagcccaattaaccagaaaagaaaaaaaaatctgtgtagagaaaaggtctgatcctctgatccttttgtagtgcatgagtgtgatgattgggtgttaacgggcatgtgtgagatgtgccacccttgaaccttgttacaatgttggctcattacccttctgacatgaagaaaagaaaaaaaagatagaaaaaaggagtctcggctggacatggtggctcacgcctgtaatcccagcactttgggaggcggaggtgggca

SEQ ID NO: 15324 - DNA, 7036 bp, Human
cctcgtgttccacacccagctggcccatggcagtcccactggccgcatcgagggcttcaccaacgtcaaggagctgtatggcaagatcgccgaggccttccgcctgccaactgccgaggtatccactggggagccgggcaccagggtccctgatggtggaccagaggtctgggcctgcatcctgttcatgagctggggctcagatgctgaagctgcagatgctgagcctgggccccactcagtggtgggggccaatggcctgggctggatgctgagttcccatgaggcactgggaggcttgtgcccctgtgaattgtggggaactggaggccagggctggatgctgagttcccatcaggcactgggagacctgtgccccagtggattgtgggagctgatggccagggctgcatgctgacatcccatcaggcattaggaggggtgtacccccagtagattgtgcaagaccaggggtggatgctgagttcccaacaggcactgagagacctgagctccaatggactgtgggaggccagggctggatggattgattggatggatggattgagaggcctgcatcccagtcgattgtgcaaaactgacgaccagggctggacgctgagttcccatcaggcgttgggaggcctgcaccccagtagattgtggggagctgatggccacagttaaatgctgagttcccatcagacactgagaggcctgcacctctacagactgtgggagctgatggccagggctggatgctgagttcctgtcaggcattgggaggccagtgccccatgagatggtggaggctagaggccagatacgagatgcacttctccgtgatgccttggagaaactcaacgctgtgggaggcaggcttgcctggtgccaagcactgtggggatagatgggagggggtcaaggagggcaatagtgggtttgagcaagaagtagacgcaggggtctccctaagtgggatgagtttctgtgtcctccacaagcatttcctgagcactcactgtgtgccaggctccgttccctgaaagcagcaatgaattttttttttttttttttgagatggagtcttgctctgtcaccaggctggagtgcagtggcacgatcttggctcactgcaacctccacctcctgggttcaaaccattttcctgcctcagcctcccgagtagctgggattacaggcgcccgccaccagacccagctaatttttgtatttttagtagagacaggatttcaccatgttggccaggttggtctcgatctcctgacctcgtgttctgcccacctcggcctcccaaagtgctgggattacaggcgtgagccaccgcacctggcacagcaatgaatttttgctaggaccgaaatcctagctgggtacagtggtgcacacctatagtcccagctacttgggaggttgagatggggggatcactggagctcaggagttccaggccagcctgggcaacataatgaggctcccatctctaaaaaaaattattttaactatgtgggtgtggtggcacgtgtctgtggtcccagctactcgggagactgagacaggaggatcacttgagcccaggagttggagaccagcttgtgcaacatagtgagaccccatatctccacaaaaaatacaaaaattagccaggcatggtggcgagcacctgtagttccagctacttgggaggctgaggtgggaggattgccggaatctgggaggttgtggctgcagtgactatgatggcaccactgcactccagcctgggtgacagagcaagaccctgtctcaaaaagagaaaggaaaactaaatcctagtcctagcagagctgacacgctaatgtgggccctgccgtggccctggctcaggctcagtgggtgatgagttactgggatggaatccccctagtcctctcccagctctctcccttcgccctccagtggtgattagaaaagggggagggagggggaagaggtttcagcgtctcccacccctgcaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaaggtgcctggggagacggggcaccccggaggcctgggagtgagggtgggccatgggaccccggaaaccagggcagagccccaagggctgatgactccccgcccccgcagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcggtgaggagccgccccctggacctccccagtggcgctgctcgcatgggcgcaggcggtggtgccgggagcggccagcaggtggcgcccaagcctggcctgccgaaagggaaggggttgcagaaagggaaggggttgcagctcctcccgaccccagacggggtgctggcccttggcccagcctgggagaagggcgggggcgaggaggaagttgccctcacacctagcttccaggggccattagcccagccaagcgccctcagccctggccagccccctatccccaacaggccaggcttgactgctcagtgccagcccccccacttttccatctggcttcactaactctcaggaatgggccccaggcccctgaggtgggggtgggggactaaatcacttccctgggcaggtagggctggtctgtggcccagcagccatacccccttggccaagaggagacggactcaggcagctggagactcaggctggggtacacctgcttcctgtcccccagcccctgggagcagaagtggcccctccagtctcccctccagcatttcctattcctggcccccagctgttccccctgctctgccccacatccatgccaggcctgagtcaggattcctgccctcctgggatcaccccggccccagcccccagaaacttgcagaagcctggagaagtttggggtggtggtgaaagccaggaaggacaagttcctgcccagaacgtgctaaaaccaagcttcccccacactcactcctctcctgcctcccacagacatgatcagccagcgttcagcgggtggccgccctggctctggcccacaactgggcactggccgagggaccctgcggctccgatcccggggccccgccacggtggaggatctggtgagtgctccagccggaccctatctccggcatcccttccctttcttttttttttttttgagacagagtctcactcttgtcacccaggctggagtgcagtggtgcaatctcggctcactgcaacctctgcctcccaggttcaagcgatactcctgcctcagcctcccaagtagctgggattacaggtgcccaccaccatgcccagctgatttttgtatttttagtagagatggggtttcaccatgttggccaggccaggagttggtctcgaactcctgacatcaggtgatccagcctccttggcctcccaaagtgctgggattataggcatgagccaccgcgcccagccctcccttccttttcataaccggcagcattacctgttagctgaggggactctgggcagacagcctggattctagtccacttctgccacttcccagctcccagggaccttccttgggcacatgggccgcagtttgcccatcagtaaaatggggatgagctgaacaccgataccaccttctcagggttgtcctgaggtctaaatacgaatatatgtaaagtggtgacaatggcagtccgtccaattactatgtatattcacattgttatgatgtcgctgtcacccctccctggcccccagccctctgcctttgaagagaaggccattgagaaggtggatgacctgctggagagttacatgggtatcagggacacggagctgggtgagtgagggctgcctgggggagggggcatctaggtctgctgggggccgaatccaccctgagccccttggtccctggtgtcatttgtgcctccgttctgacccctcccccaatagcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgttggacctgtgtggcttcggggtgggagagggggaagattggggctgagaaagaattcagcagctgaaatccatcttccgcaggctccaaattgaattaggagctggcaccaagccacctgccccctcccactgttccttctggctgcaggccaccaggcttccaggcagggccagagcttcctggactactgagggttcaaatcctgccccctctcccacaaggcctcctaccccctggagcttcacaaggctgctgtctgcagctggtgacaacccccggaccgtggggagcaccagggcattgaaacctggcttggaaatagaaagatggaacctcaggcctgccagagccccacccctacaccgggaggttgggggcaggcgtgaggcagcccccaccccacccggcccaatgctggacacgcaggcgtccatggggcaccctgctttgtcctagacataaacccagcatacttgttttgacaacccactcatcttcgaggattgagggtgatcagggaaaggcggggtgggaccctggccagacctggagggaagggaagggattgaagcaaggggcgctgggccagagggccccacaggaatgcttgggggtgagccgagaggctgtggggaagtccgaggccagcttgcaatcctcgttccaaaaggcgggcgggcactgggccaccaggaagaggggaagggggaaaaggggaagaccctgggggctgggtgttggtggacagacccgggtggagtcggggagccgcagtcctggtgactcagggcatccccgggcacctgtgggctcctcgggtgtctgtgctgggagccgcttgcggtggtgaaggggtgtggctatgtgtgtctcgggtgttgggtagcactgtgagtctatcaagagtgttgatggctcgtgacgcaatgagggagggctgtgtcgtgggtaagggatgtgataaccggctctgtgttccagggcaattgcaggtgtaactggcagtgtctggtggtggggagtgcaacggagtgactgtgtcttggggtgtcccggggtgtgggggtgtgtgtcttagggtgctgtttctggggcaaggaggggtgcttggctaggccttggggtgttcaggggtgtcagggtatgtctcggggtgttgctgtttcctgggtgggggtgctggctaggtctaggggtgtctaggggtgcaggtgtgtgtgtctcagggcgttgctgtttctgggtgagggtgggggtggccagctaggtctctggtgtccagcggcggggggtgtcacttcttgtgccttgggtgtacggagtttgctggtggggcctgtctgggattgttggggggtcattgaaagtcaaacagagtgtggtcaggggcagttttggcaataaggagtgtgtgtgcgtgtgtgtatctctcggggtgccaagtgagaccctatttcccagcactaaggagggtggttcgggtgatcatctcagagggctgcattttggggtgttgggaggggctggaattgaggcagtaactctgggtgcgtcccggcgctgggggtaagaccctgagttcagggatgtggcggcagcaacctggctgtgctgagatggggacaggatgaaactgagtggtaagtgacaggattgtatgtcttagggtgtgaggctgtgccagtgtgaccctacttctcagggcaggaggcgagtctttgtgtcttaggacgtgtgtcacaggtgtcactcagcccatcttaaaggagccagtcactggggagagtccccaggtcgccaggcctcctggttcccctgccccctttcagcctcctcccaggatatgactcgctgtggccctagccggggcttaagcccctgtataaataggcggatcccctggccaggctgggcctgacccaagctggtctacccgaggccctgcccaccagcacccaccccgacatccacgaaggctttggcagggcagggggggcatt

SEQ ID NO: 15325 - DNA, 4441 bp, Human
actgcaagctccgcctcccaggttccagcaattctcctgcctcagcctcccaggtagctgggactacaggtgcacgccaccatgcccggctaattttttttgtgtttttagtagagacggagtttcactacgttggccaggctggtctcgaactcctgacctcgtgattcgctcgcctcagcctcccaaagtgctgggattacaggcatgagtcactgcacccggccgaagagatgtctttctaattcactcacagatgctatataggctagctggggctctgcacatgacctccagaagtggacagtccggaagaggaaatgcacagggagcagggaaatgtgtaaatgtctaatataaattttttcctttattttcctttttttttttgacagagtcttgctgtgttgccaaggctgaggtgcagtggtgcaatcagagctcactgcacccttgccctcctgggctcaagtgatcctcccgccccagcctcttgagtagctgggaccacaggtgcttgccaccatgccctgctaatttttttatttttattttttagagacagggtcttgctatgttgtcccggctggtctcaaactcctgggctcaagtaatcctcctgccatggactcctaacgagctgggattataggcatgagccactgtgcccagcctcatataatttttaatagtgatatggagacaaagcaagacaagttctatagacaagatcagtgagggcgtctctgagcacgtgaagctgaacttgagacctgaaccacaggaggaagcattcatgcaatgatttggggcaagaacgtcccaagtagagagaacagccagtagaaaggccctgagctggggctgggcatggtggctcaagcctgtaatcccagcactttgggaggttgaggttgacggatcacatgaggtcagcagtttgagaccagcctggcctacatggcaaaaccccatctctactaaaaatacaatacacaggtgggcgtggtggtgcacacctgtgatcccagctactcgggaagctgaggtgggagaatcacttgaatgcaggaggcggaggttgcagtgagccgagatcacaccactgcactccagcctgggtgacaaaccgagactccatctcaaaaaaacaaagaaaagccctagccaggcgcggtggctcatgcctgtaatcccagcactttggaaggccaaggcaggcggatcatgaggtcaggagtttgaggccagcctgaccaacatggtgaaaccccgtctctactaaaaatacaaaaattagccaggtatggtggtgcatgcaaacctcatctctactaaaaacacaaaaattagctgggcgtagtggtgcatgcttgtaatcccagctactcctgaggctgaggttgcagtgagctgagatcacgccattgcactccagcctgggcgacagagcgagactcggtctaaacaaaaaaaaaaaaaagaaagaaaagccaagccctgaactgggcatgcaattggcatgtttgaggaacagtgaggaggcctggggggttggaacagtgagtgaaggggggatagtgagaacatgagggcagggaggtaacaggttgctatgttttcctgattttttttttttaatggggtctcactctgtcgtccaggctgcagtggagtgatgtgatcacagctcactacagcctcaaattcctgggctcaagcaatcctcctgtctcaacctcctgaatagctgagactacaggtgttcacagccatgcccagctaatttttattttttgtagagacgggtctcactacgttgcccagattggtcctgaactcctgggctcaagcaatcctcccgccttggccttccaaagtgctgggattataggcatgagctaccacacccagcctgctatggtttggataaggtttgccccattgaaactcatgctcgaacaatcgattggctaacgaggtcgatgacgccaggcacaagatgctgggcctaccgcggtagcgtgagggaagccgtgcgttctgttccaaggcatctgtgagcccatggagtatacaccatgagcaaagctcaccctcctgagttgaaaaaatttacggacaagaagttttcattgaaattaaatggtggcagacatgtccaaggaatattgcggggatttgatccctttatgaaccttgtgatagatgaatgtgtggagatggcgactagtggacaacagaaaaatattggaatggtggaaatacgaggaaatagtatcatcatgttagaagccttggaatgagtataaataatggctgttcagcagagaaacccatgtcctctctccatagggcctgttttactatgatgtaaaaattaggtcatgtacattttcatattagactttttgttaaataaacttttgtaatagtcaaaaatgctttttcagatgttctgaatatacaatattagctctcattccaattttttctaacatgaattttcctggttgacattgatttcaaagggttttatgtattaaagtgacagaatcttattaaatgtgaaacatggcaaggagaaaaaaaaaaaaaaagaaactcatgctaaaatttgatccccaaagtggtggtgcggtgttgggaggtggggcctagtgggaggtgtctgtgttatggggccagatctctcctgaatggcttgaagtagctctggaagcaatgagtgcttgctctcaagagcccggattagttctccagaacttacagtagttggccaggtgcagtggctcacacctgtaatccctgcactttgggaggccgaggcgggcggatcacgaggtcagcagttcgagaccagcctggccaacatggtgaaaccccgtctctactaaaattacaaaaaattaggccaggcacggtggtgggcacctgtaatcccagctactggggaggctgaggcaggagaattgcttgaacctgggaggtggaggttgcggtgagtcaagaccgtgccattgcactccagcctgggcaacagagagagactcagtctcaaaaagaaaaaaaagaaaatacattagttaggccaggaacggtggttcacgcctgtaatcccagcactttgggaggcagaggcaggcggatcatctgaggtcgagagttcgagactggcctgaccaacatggagaaaccccatctctactaaaaatacaaaattagctgggtgtagtggcacatgcctgtaatcccagctactagggaggctgaggcaggagaatcgcttgaacctgggaggcagaggttgaggtgagctgagacagtgccattgcattccagcctgggcaataagagcgaaattctgtctcaaaaagaaaaaaaaggccaggtgtggtggctcacgcctgtaatcccagcactttgggagtccaaggcgggtggatcacgaggtcaggagatcgagaccatcctggctaacacagtgaaaccccgtctctactaaaaatacaaaaaaaattagccgggcgtggtggcacacacctgtagtcccagctactcgggaggctgaggcaggagaatggcgtgaactcgggaggcggagcttgcagtgagccgagatcatgccactgcactctagcctgggtgacagagcgagactccatctcaaaaaaaaaaaaaaaaaagaaagaaagaaagaaagaaaatacattagttaggccgggtgcaggggcggtggctcccgcctgtaatcccaacactttgggaggccgaggcgggtggatcacctgaggtcaggagtttgagaccagcctggccaacatggtgtgagccaaagaaggctggtgtgagccactgcgctcagcctatattttcttatgtaaaagggacttcctggtgcctcctatccaatggtctcttccagggggccatgctggattcagcttggccgcatccaatcttttttttttttgagatgaactctcactctttcacccaggctggagtgcaatggcgcgatctcggctcactgcaacctccacctcccaggttcaagcgattctcctgcctcagcctcctgagtagctgggattacaggtgcgtgccaccacacctggctaatttttgtatttttagtagagatggggtttctccatgttgaccaggctggtctggaactcctgacctcaggtgattcgcccgccttggcctcccagagtgctgggattagaggtgtgagccactgcacccagcctgcacctagtctcatgtatccatttgttcatgcatccattcgtctgtcccctaacacaccctctcatctcacctggtccatctccatgatcacttacctaaactagtgtggttgcctcctgtgggtttcccagcttccaccctcaccccctacgacttcttgtccagacagcagccagaatggtcc

SEQ ID NO: 15326 - DNA, 29930 bp, Human
  misc_feature (1)...(29930): n = A,T,C or G
ccctggtccccttgctgccatgtggatgctgttgtgattgctgtttgtatattatcaaaatgtttttatattaaaaatgtttggtctgaaaattaaaagcacttcatttagaatgattgtttgtgcttttgtctctggtggactgaagcaactttgtccactctcccccagaagtggcctcttgccctgtccagtgggttggctgtcccacgtcttctttccagcttcctactccagtcttaattggttctacagttgtattccagactgaggttccaggaggggtttttctttgtcaaaacttaaaccagctgtcctgcagatagattataatgagtgatttttcagactttgcccttgacccacaggaaaattaacatcgtgatcccaacacacaaacagcaatgcttttattaaattttactaaaccttaccatgtatctatccatccagaggcggagtggtcagccatttccccatagttcacagaaaggctctgactctccctccctggaactgtggttgatctgggaacatgggggcagacagcagctggagaaggtggaggctattcaagtcgaagcagcagatcggcttgtagttaagcccagctagcccttccgagtcggggtgacctggcttctcccctcccctgaccctctcttaagtgcttctcaatcaggagcagttcggccccgcaagagcacattcaccaatgtcaggagacagcggttgccacagccagcaggaagatagaggaggggctactggcatccagtgggtagaggcgggggatgttgctcaacacccagtggtgcacaagacaccccccagcagaaaatgatccagcctcaccgtcagtagtgtcgcagttgggaaaccccgactgtcctctgctaagtgtgtactgaaagaggatcctgaaggaaggggcaggttcccttcgcattgcccagacaggaaatacagacggggaacaggagcagggaatctgcctggctgtaccccagattcctcatctgtgcaatgggagtgatgatggtagcacctacgcgatgggagtgtggtgcgaaggagcgttaagtgggtgccagctcttactactggcaggagcccagggctagggcccagcaaaggggtggacactgagcgccccttcccagccaccccttgcgccgggcccggcatcctcctgagtgcggctgggaaaacccaggaggccccgcggcctggcccccaagcaggcctggcctcggccgcccagcgccaggccttatgaatgacgccggcggcggccgggcgacctctgacccgcgcgccggccgcgcccctcccccgctggcaggtggacagcggctgcgccgggcaggccgcggcgccaactccggctggccgacagccgctgccgcactgagcgggggcgggggactgcggcgcgcgcggggccggccgggcgcccgccggggccgcctcctgagcctcggagcgctgcgcggccgccagccagcctccgccgccccgccccgccggcccgggcccgcagactgcgtctccgccccgccctctcacccccggattgacactgagcgttctgctggggggcttggcggacccggcacctccgccaatcggcggcctcgcagggcggaccccgggcccagtccagcgtctcggccaatcggacgcgtctgcccgcccagctgcggcctcgcgagcgagtgaatggccgagagtccgcggtgcgtgtcccgaggctgagagcctatagtggcgcgggaaggtcgcgggagggccaatgggaggcggcgctgagccgtcagtcagggcggcctaggccaatgagcggcgggctgcgggggcgtcacagacagcggcagagatcttgggctgaggttcccgggcgggcgggcgcggagagacgcgggaagcaggggctgggcgggggtcgcggcgccgcagctagcgcagccagcccgagggccgccgccgccgccgcccagcgcgctccggggccgccggccgcagccagcacccgccgcgccgcagctccgggaccggccccggccgccgccgccgcgatgggcaacgccgccgccgccaagaagggcagcgagcaggagagcggtgagtgcccgggctgtgaccccgatcttggccctgcgctgccagccctggccttgtccatcatcgcctggcccctccccctacggggcccctcatcctctctgcctaccccccagcgccccttgccccggcctgtccaaggctggggcccgcgggcccgcagagtaccccctgtaggggtccccttcccctagggccgccccatgctgcaaagaccgtgctcccccccagctgtcactgccaaccatggcacgtatgaccgctggggccccacatgggcccctgtcaccagcctaccccctcctttcctggcccctcttcccagattctaatccccccacttcctcactcacctctctcacctatgggatcctctgcctgaccccgacccaggtttctaccagtttgggaatgcgatgaggtctgtctgcctccaccgcgcagggaccttggccacttgctgaccacacccctcccccctccagcccccgccatctttctcctgccctttccctcttcaccttagcacagcccccccttccaaacccatcctgccccctgaacatttcccagagccacctccagcattgtttttttcttctgtgtcacttggcatgggggacaggatctttctgggtccctctgcctctctcatcctgtcactctgtcattctgctgctctgcttgtgctccgtcctccaagcaagcgtctgtccctggctggggtagcagactgtttatgaacgtagagaattgcttcagtgcttccaaagccaagtttgagctggtcttgttgggattcattgcatcctctttcctgcgttggggtaagggggtggtggcagagccccctctcatttcctgtcttgcagtgagctctaggctccatggagggcccctcaataaatggtcgtttcacaactgaggctccgtcattcacccagtccctggggcttcttccaccactcctggcttgggatgaaaagtgtctgggtttagcgaggttcattcggttctaactgagatggtcagaaagagcactggggaggaggaggcagtcaaagagagtaatgggtgacgtctagtgatttgctttgacgtctagtgattctgatcattcccagggctcagccagagagagacctgtttcacccacttgcccacacattaggttggtcttttccagccagccagagaaagagattctctatctggaaataccatcagaaatggtcttgaaccccattcccaatttttacagctcttaaattgttgtcactccagtctgaaagctggaaggcagctgggatcccctgtccacttacccagaaatagtcggaactattggtcgaaaaggaaggccagtttttggtctcaaaccccagcatctgagtttcctgaatgccccctcccagaaaggtatgaaagccagggaactttattcccatacggattcaaatagcagaactcagagtcacagagcgatcatgaagaggcctgacatgtcaccaatgggtgggggctggggagggaaatgcctgtagctgagtgcctgatgacagaggagcaggtgggtagtgtccaaaaaaggtctgggcatgagcttggaggggacttggccggggggggaggagtcaggcccccagcaggtgaggccagctgggaggtggaaggtagaggcaggcagctatatattgcggtagctcagttgaaagttggggagatgacagtcctggaaaaccttcaaggctatcagacacatgtggtggggggtggaaagccacacaagaaaaaggatcccaagaaaaagatcagaggctctggaaggaaccactgattctctcagagcacaggtcagacacccaggaatgaatgatcatggtaaaatagagctactatttattgggcatctaggctgtgccacaggctaaatggccaggcggatagagatacctactctggtgactttcataacgggctgttatccaaattttccaaaggagccctctggtagaaatgacatccatgacatagatgatgtcacagaggcaggattcacatccagatccatctaccagcaaacttcttggaccccagaattccccgactttgacatttttcagcagcctcccagatttttactctatcatattttcttaatttaaaataataaaagttttactcacttgtgttcagatgtaaacttggagctcattctaaacaataatataaatgaaatcatgggattgccatgccagttatattttctctgatacgcattaaatacagtgtaactagataaatgaaacatcccgaaaatcatgtcatgttctgccaatgggactatgtcacacgttgagaaacgcccgaagctgtacttcctcccagaggctcccagagaaggaaataagatgaggaaggaagtccctctttgctttgaggcgctctgattctgagaggatggagttagacaaaatttgccctcttagaagggtggggcaggggcaggggcagtagccaggccagcctgcagggggcacctggatttcatctgccagacgccggcccgactggggtcaggaaaatgcccaggccttgggaggcaccagttaagcatcctgcagtcccctgtggtaccatctctgtgccagggcaggacagagtccgcctcctcccaagaggccagggatccagaatgaaccctggagtggagttgggggaatctacacccaaagatggcaaagccattgggagagctgagagggccaagaaaaaagactaaggcccaggctctggccaagttggaagaatggagagggagcagcggccccagggggcaggcgcccaggtcagacagccaagtggggctcaggtcgtggctggcactggctgaagatacccctgggagctggcccacaggggaaggggcagagctagtaaaagggagcccccgatccccaggacacaagcagatcctggcaaagagagaaaagcaccccccaagaagaccctagatgggaagaactagtgccgtgtaacatcctatggatgcctaagacggccaaacaccttctgtgccttggcagttgtatgggtgcccaagaggtcttatcaaggcagctctccccttagcgcaaccgcgtctacagaaactcggagggccctatctgtccctcctccacacccagtggcctctgggttgggtttctcttcctgctcccaccccacggctccctagctccccctgcaggcagggttctggggacagacagccgaacagacacggcaggtctcatgagccttcccagccaccgtagtgccggtgccctgagaacaggactgagtgatggcttccaactccagcgatggtgaggctgagtcctgttactatagcaacttcctaggcacactctgccccttaagtcagggaggggctgcagcggggtctggggcacaggcgaagagaagaaggatgtgaacccctggctggccctggaaacgcctcctgtacagccccgggctgtgcggcctggggaagagagaggggatcggtggcccagttcagacaagggaggatggtccacccggcagggggccagctcagagaggggtggtggagtggtccatcccagtgttggggttcagctcagactgtaggatgagccatcccagtgttggggtccagctcagaatgggggtcgttccagccagtgttggggtccagctcagagttgtgtcatttaggtaagcccagagcagggaatccaggctccactggaggaatcagccagcctcgagtagggggcccagcccaggctgggcattcctgccccagaattcccaggacagccagatttcaaaagggcagaaggtctgagattgttgtccggaggaagggggttctgtggctgggctccttccgagagagaccccaagccccttgcccaaattgatattctgctgttgcaattccccattcccagggcgagtttctagatttctgctttctgctgtggtcctggcttttcaaggggtgtcaaggagttttccctatgaacccaaatggaatctggaccagagtgagagctggcaccccccgtgtgggagatgtgggcagggcggcaggctgtacaggccagcagctggctgggttaccatcctctgccacttcctgttgctagcaggggtcctggatgccgggcacactcaaagaggctgccactgaccctctgcttcttttgggatctggaaagaaggaggaagatggtcaaggctgcctccccctcccccacccctgggtttagccgctcgtttccggtttggactttcatggccgagagtagagccaagcacagggcaaggtttgagagaggccaaggacatcccgggatgcctttcccctctccacccccgcataggagcaaaacaaaagagtcagatatacccattttctctctcaggatagcaggatttgggggttccacattgaaagggagttcaggggaggaggcagggtggctcttgtcgccccccgccccaagcctttctctccagctgttctttcagcgaattaagggagctctggggcctctttagcccctaaggagtctctggctgttgcctgatcctgaaccttaactctttcccctctgcccagtgggcactgctctgggcacatcaggcgctgtcctctgcacagtccagtgcccactgaggaaggcagggcctggcgtcctgggagcagtgaagtccgtggaaagggaagttagttttatcgccccgccctggggcacgcaggccagccagagggacaccctcgggagaatcttcccattgcctcctgccaagggagccctctgcaaaccttggctagcttggagcaggtacctttaaaagcttctgtggcaaccagctcctcctccctggtcccctgaggccatcccaaggaagctgacttagaggctctgcgttttcctggtttctcagcaaaaggaagattccagggagagcccaagggggctggggatggatctgggatcaggcagcagccagggtggggacttggagaccaccttccagctgtggctgcagctgctcctctgggcccacctggctgtacgtttcctgggctacctgcaccgcaccttccgggggcctaagccacagccagcaccctgagcctccctggccagggggcagaaggccgccagatcaccccatcccacccaccctttattctaccctttcctggaagagacaggaagcagaggtgagtgtggggcctcttgattgaggttacctgcccctcccccccatcatccctctctctgcctgctcctcctggcactggcctcccccatgccccatccccaaatctgacaagctaacagggctagtggcaccagaggggacagagcctgggcgctctggtcctttgagaggccagagaagggccatgctaacagcaaggcaccctgtggagcgactctgtggggcaccagcggacagccaggggctgggagctcagcgagtcggggaggtgcaggattcagcaattctttcctttttgctaagagcaaagggaaaacggaccagaccttttggattcccttcaagcctggcacctctctgccttcttgtgtgggtgaaggtagaatcccaagagggcaccctccaccctccccacccactgctgaattctgtgtggattatttggaggtttccaaggaagatgttttctgtcacaaaggttctatgactgaagccaggcacagtggctcatgcccgtaatcccagcactttgggagactaaggtgggggaatccattgaggccagaagttggagaccagcctgggcaacatagcaagaccccatctcaaaacaaaataaaacactcaaacaaaggttctgctagtgaaagtgttggatttggtgtgacccccaggctcaggcccctgggctagttggtggcccagccaggcacccatctaggactcctggccattcattgcctatcccctctccgcctggtcatttattgtggggccttcttggccacggtctctctccatctgccatctaccactttcttttttttttttttgagacagagtttcactcttgttgtccaggctggagtgcaatggcgcgatctgagcccactgcaacctctgcctcccgggttcaagcaattctcctgcctcagcctcctgagtagctgggattacaggcatgtgccaccacgcccagctaattttgtatttttagtagagacagggtttctccatgttggtcaggctggtctcaaactcccaacctcaggtgatctgcctgtctcagcctcccaaagtgctgggattacaggcgtgagccactgcacccagccaccatctaccactttctagctccatgagggctcttctctctgaatgctgagggaaagctctggagacaggtagtgggggtggctccccacaaggccatgtgggattactggcaggcagataaccagcaatgccaaagggcaagtgtacagggcccctcggtggcagcaaacccaggaacatcagggggttgaaggcagctctgtccacattggccaccctggtgcactggactcagcactgaaaccaatggctgagttggcagtgaagtagttaatctcatgggatgtgggggcaggcaagtgacctcagacctgatcagtcttctcctctgtacagtgggaataacagcagctcccaccccacagggtgagaacgaagcatagaaaatactcagcaaggggctggtcccttgtagccctaggtggtggttaaaaggacaagtccataatgcaagaatctgtcaggctgcgcatttaagatttgagcactcagtgtatctcctatatttgtttttggggtttttttattattacttttttttttgagacagggcctcactctgtcacccagcctgcagtgtaatggctcagtcacggctcactgcaggctctatgtcccgggcttgaacaatcctcccacctctgcctcctgagtagctgggactacaggtgcataccaccacacctggctaatgtttttattttttgtagagggttttgatgttgtccaggctggtctcgaattcctgtattcaagcaatccccccaactcggcctcccagagtattattatttttttgagaaagagtctcactcttgctcaggctggagtgtagtggtgtgatcatagctcactgcaacctcaatctcctgggctttaagcaatcttcctgcctcagcctcctgcttagctgaaactgcgggcatgggccactatgctcagctaattttttaattgttttattttttgtagagattgggtcttgctatgttgccaaggctggtctctaattccaggcctcaagcgatcctccaacctcggccttctaaagcactgggattacaggcatgagccaccgttcccggctctccctatgtgtgtgtgtgtgtgtgtgtatatatatatatatatatatatatatatatatatttttttttttttttttttttttttttttgagacagagtctcactctgtcgcctaggctggagtgcagtggcatgatctcagctcactgtaacctctgcctcccaagttcaagagattttcctgccccagcctcccaaatagctgggattacaggcatgcgccaccgtgcccagctaatttttgtatttttagtagagacggggtttcaccatgttggccaggctggtttcaaactcctgacctcaagtgatctgcctgcctcggcctcccaaagtgctgggattatagacgtgagccaccatgcccgatcgctccccatattttcttttcttttttcttttttttttcttagacgagtcttgctctgtcacccaggctggagtgcagtggtgcaatctcggctcactgcaacctcagtctcccggattcaagcaattctcctgcctcagcctcccaggtagctaggattacaggcacacatcaccaccacgcctggctaatttttttgttttgttttggagacagagtctcgccccgtcgcctaggctggagtgcaatggcatgatctcagctcactgcaacttctgcctcccgggtcgaagcgattctcctgccaccatgcccggctgatttttttgtacttttagtagaaacggggttttaccatgttgaccacgctggtcttgaactcctgacctcaagtgatctacccgccttggcctcccaaagtgctgggattataggtgtgacccaccgtgcctggcctcatttttttatttttagtagagatggggtttcgccatgttggccaggctggtctcgaactcctgaccttgtgatccacccaccttggcctcccagagtgctgggattacagacgtcagccacctcacccagcctctctccccatattttatacctcaatttagaaaataataggctgggcacggtggctcatgcctgtaatcccagcactttgggaggccaaggtgggcagatcacctgaggtcaggagttcgagaccagcctagccaacatggcaaaaccctgtctctactaaacataccaaaattagctgggcgtggtggcaggtgtctgtaatcccagctactcaggaggctgaggcaggagaatcatctgaacctgggaggcggaggttgcagtgagctgagattgtgccactgcactccagcctgggcaacaaagtgggactccatctcaaaaaaaaaaataataataattaaaaaaaataaattggccgggcatggtggctcacgcctgtaatcccagcactttgggaggccgaggcgggtggatcacgaggtcaggagatcgagaccatcctggctaacacggtgaaaccccgtctccactaaaaaaaatacaaaaaattctctgggcgtggtggcaggcgtctgtagtcccagctactcaggaggctgaggcaggagaatggcgtgagcacgggaggcggagcttgcagtgagcggagattgcgccactgcattccagcctgggcgacagagggagactccgtctcaatcaatcaatcaatcaatcagtcaatagatagataaataaaaaataataatagctgacatttatctggcactatcatcacacggggccactgttcaactccctttgtcaagatgaactcattcattcctcaaaaccaccccactttacagatgaggaaaactgaggcctagagaggtgagatcagttacccaaagtcacagagttcatcagagaccaggctgggctctgaactggatcttgaccccaagtcctggcccttagccactttgctgggctgtgtctcagcagagacgagaatgactgttttcaagcctgtttcctgggttgttaagtggagacaatggatacaaggcaggttgccgagtgagtcagatgagacagtgtagacagcagccggcacagggtctgccggggaagtttcaacattagccaggcggtgatgttcaccttgggataccatggggccgaggagtgggcatcgggcgagacttcccttgaaccagctctggagcaatgcccttgcgattgccacggagaggaacagggccagctgggggccaaggtgacagctgagccccccaagggcacctgctacccgagcccccgaggcctccatcccaggcccggcctccccagagaaggggccagaggaacagccaaatcccaaggctataaatacctcggctggcgtcggccctggccatggaatgtcggtcagaactggggcgagtgggggtgggctggtctgcctgggcacctccctccgttcccctgcgagtgacccctgagactctctgtaccccactttggatggagtggcagctggatcccacctctctgtagcaagggaggcccaggccacggcccagccaaggccccagaggcaccagaaaaaggtcaggctctgggttggaactgcaccccactttccaccaagtatctccccagaaatcacctgaacccaccccggtgagacgggcgtctctgtataactctcccctctctccctttcagtgaaagaattcttagccaaagccaaagaagattttcttaaaaaatgggaaagtcccgctcaggtaaggctgccgggtgcagagcccagggaggggtgagctgctaacccccagcccctggctgtgtcccagcaacacagctagaatttcagaaaccccatagaaggcttcagaccctccccatttgctccctaggtgcccatgggggctcctgtgtggagacacctgactgcccaatgccaggcacccccatcccaccacccctcccaacggcccgcccctgcccccagcacagctgccagcagcttccaggccccaggccagggccggatctggcccctgccacccgccttaaggaatgtgccctctgccatcttgattttccgccccctgtcctcaccccgctgaccccacgtgctccccggggccccctctgccggtggcagaggggatgccccagaccttagccaagcaggccgcggggagggcgtgccctgagcctaccgacccctctgcccacagaacacagcccacttggatcagtttgaacgaatcaagaccctcggcacgggctccttcgggcgggtgatgctggtgaaacacaaggagaccgggaaccactatgccatgaagatcctcgacaaacagaaggtgaggtggcctgtcctcgctcagggcctgcctgtcaggcctttgcctggactgtgcccactccttagagtgccctatccacccgttcactcacttgcttttttttgattcagagtctcgctctgtcgctcaggctggagtacagtggcgtgatctcggctcactgcaacctccacctccctagttcaagcgattctcctgcctcagcctcccgagtagctgggattacaggcgcctgccaccacacccagctaatttttgtatttttagtagagatgggttttcgccatgttggccaggatggtttcgaattcctgacctcaggtgatacacctgcctcagcctcccaaagtgctgggattacaggcgtgagccaccgcgcctggccgcttggtttttttgtgggggacaggatcctgctctgttgcccaagcaggaaagtgcagtgacgtgatcatagctcactgtagcctcaaactcctgagctcaagagatcctcctgagtagctgggactacaagcgcacactaccatgcctggctaatttttttttgttgtttgtttgttttttgttttagacagggggtcttgctgtgttgcccaggctggtcttgaactcctggcctcaagtgatctcctacttcagcctcccaaagcacagggattacaggcatgagccaccatgccaggctcacccactattccccgagcccccataatgtgccagccccaggggtcagaagggccctgtgccgccttcccaaagctccctctccaggccggccatggattcaaagccaggcactgtgacacagggtcagacaccagcccaacaggaggagaacaagagcactcttgggggaagtggtgtttatgtgcactttcttcccgtaaatatttttgtgatcggactttataccaggcactgctataaagcagcaatgtaactagcagaaatgtaacctgagccacagaagcaattttaaattttctgtttgctccatcataaacagtaaaaacagccaagcacggtggcgcacgcctgtagtcccagctactagacaggctgaggtgggaggatcacttgaacccaggagttcaactccagcctcgacaacacagccagaccccatctctaaaaaaacacccaaagtttgtaattaaaagagaaaatgaaagaaacaggtgtcattcatgaaattcattttaatgacatgtttggggcttttttttatgtttttttttttttgagacagagtctcactcttgtcgcccaggctggactgcagtggcgtgatctcagctcactgcaacctccacctcccaggttcaagtgattctcctgcctcagcttcccaagtagctgggattatgggtgccaccaccacgcccagctaacttttgtatttttagtagacttggggtttcaccatgttggtcaggttggtctcgaactcctgacctcaggtaatccgcccgcctcagccttccaaagtgctgggattacagatgtgagccaccacacctggcctaatgatatgttttaattaagccagtatatctacagtattaccctttccatatattatcaatgtgaaaatatcattaatgaaacattttacattccttttgtttttttcccagtcctccatgacttcggaaatatttcctttttttctgtactgaagtatctttaaaatccagtgtctattgtatgcttacaacagttctcaactctgatggtaaatttttcctggaaagataagaaaaagcagggaagttgaaaaagcagattcacatgcccaagttgttccaaccatgcctgaaagtcaccagtacctgcatcaagagtttaatttttgttttgttttgttttgttttgtttttgagatggagtttcgctcttgttgcccaggctggagtgcaatggcatgatctcagctcactacaacctctgcctccgggtttcaagcgattcttgtgctccagcctcctgagtagctggaattacaggcgccggctaccacgcccagctaattttttaattttttttttttttttttttgagatggagtctcgctctgtcgctcaggctggagtgcagtggcacgatcttggctcactgcaacctctgcctcccgggttcacgccattcttctgcctcagcctcctgagtagctgggactacaggcgcccaccaccacgcctggctaattttttgtatttttagtagagatggggtttcaccgtgttagccaggatggtctccatctcctgaccttgtaatccaccggcctcggcctcccaaagtgctgggattacaggcgtgagccaccacacctggccagtttttaaatatttttagtagagacagggtttcaccattttggcctggctggttgttgtttttttttttttttttttgagacggagtctcgctctgccacccaggctggactgcagtggtgtgatctcagctcactgccagctccacctcccgggttcatgccattctcctgcctcagcctcccgagtagcagggactacaggcgcccgccaccacacccggctaattttttgtgtttttagtagagacggggtttcaccatgttagccaggatggtctcgatctcctgacctcgtgatccacctgcctcggcctctcaaagtgctgggattacaggcgtgagccaccgtacccggcctggttgttttgtttttgagacagggtcttgctctgttgcccaggctgaagtgcagttgggctcaaatgatcctcccacctcagcctctggagctgctgggaccatagtcgtgccatgcccagctaattgcttttgttgtccttgttgttgtttgtagagatggggtctcgctacattgcccaggctagtctcaaactcctgggctcaagcgatttacctgcctgggcctcccaaagtgctgggattacgggcgtgagccaccatgcccagctggtgtcagttttttaatttatattttagatacttaaaatttttgaatttggctccccatccgaccagccatatttcaagggcccagcatccccctgtggctaatggggactgaactgggtagggcaggtatagactctgaggacacagctatgtgagcaaagcagttgacagctgactgagggaccaggctggccacatgttacacaccagcctgacatcagccagctgtgtgaccttggacaagtcacctcccctctgtgtctggtcttccaaactggcgtactcccagcatgggcctctagggcttctatcctgattcagtgagagactgggtgccaggtgcctgctcatggcatctgctattaggggacagctgatggctgaggagctgttagcctgaggttcaggttgctgtgtggagtgttctagacaagggtaaggcaggtcctaaaccccccacctcttgggcttctcctgcctgtcttttcaatttcagttcagctgccccttcctccagaaagcgctgtctgattcccccttccccagaccacgccaggtactttacatgggcttcttgggggctgcttctccacaaccccaagataccctccaccacggctctgacctctgtgggggtaacccatgtattctttgccctggacttagtgccgtgcaaggacaagcagcccctagcctccctgatgctgtgtcctcagcatcagctaagggcccgacaggccacaggcacacaaatgattctggctgaaggaaccggcctggctccggcatccctagttccaggcattaggggaaatgaggcccctctcacctccccctcctttctgccctcccctccttcccttcccaggtggtgaaactgaaacagatcgaacacaccctgaatgaaaagcgcatcctgcaagctgtcaactttccgttcctcgtcaaactcgagttctccttcaaggtggggtcccagtggccaagggcggggggtcactgcattgggtcccagccttctggcccccagggctggggtcggagctgaggacaatcagtggctgctctcttttgtggaagaacaagatccctggaggagggagatcaggggacaggagtcaggctgggactctggtagacccaagttcagttcctggtccagccagtttgtagttcgatacccttggtgagtcacccaacctcagtaacatccctcaaaagcagcacctggtttatggtaagagcctgacccaggagcacaaactctgccccaggcagccggggttcatttcccagttcagtacttcttgatgtgtggccccgggcaagagacttatctccccaagcctcagctttctcatggtaaaatggggatcataccagttccagcctggtggggttgtcatgacagttccaggcacgtcttgagcgccctttgggagccgttttgggtgccatccaaagctgtggtcatgagaaacaggaaaggccactcagggccagcttcatggacgtttgacccagagaagcacaagggcctgttctccgagggaccccacacctggtttaacgctttgctgctgctgctgtcttgagatccgtaataatttttttttgttgagacagagtctcactctgttgctcaggctggagagcagtggcgcaatcttggctcactacaacctctgcctcctgggttcaagcaattctcctgcctcagcctcctgagtagcggggattacaggtgcccaccaccatgcccagcttatgtttgtatttttagtagagacaggattttgccatgttgctcaggctggtcttgaactcctgacctcaagtgatctgcctgccttggcctcccaaagtgctgggattacaggcatgagccactgtgccaagcctaatttttattttttttattgagacagagtttggctgttgttgcccaggctggagtgcaatgatgcgatctcagctcaccacaacctctgactcctgggttcaagcaattcttctgcctcagcctcccgagtagctgggattacaggcatgtgccatcacatctggctaattttgtattttttagtagagacagggtttccccatgttggtcaggctggtcttgaactcctgacctcaggtgatctgcctgcctcgacctcccaaagtgctgggattgcaggtgtgagccgtgcccggccattttgttttgttttgtttaagataaggtcttaccctgttgcccaggctggagtgcagtggcgcaattacagctcacaacctttgcctcccaggctcaagcaatcctcccacctcagtctcctgagtatgagactacaggtgcacgccatgatgcccagctaatttttgtatttttgcagagacggggtctcactatgttgcccaggctggtctcaaactcctaggctcaagtgatccacccaccttggcctcccaaagtactgggattatacaggcatgagccaccacacccgaccctctgtaataattttttaaccaggggccatcttttttattctgggccccactaattctgcagcctatcatgatcccattttacagatgacaaaactgtggcctcagagccttactcaagctcccagagcaaggtactacagagttctctctccagccaaggcaggctaaccaggtcctgacatacctctgagccagccctcactttcacccattaacagcaggataagggtcgcccctgtagaacatgattcctacagggagccaggatcgctgttgtcatttaatgtttgaacaccagccggggaggcccccaaggccttcagatcgggtccaagtctcaggggtgggcccttgaccagccactgcttcccacaggacaactcaaacttatacatggtcatggagtacgtgcccggcggggagatgttctcacacctacggcggatcggaaggttcaggtaagcgggccaccccccatcacatcaggctgtcagggtgtccacaggtggcagtgcacgaccaagccccctgggaatgcagaggagtccagcatacttcaacatgcaggtggtctcccagaccctgtgggtttctgtttcccctctgctgaggaatatgtgatatttcaaccaccacaaaacaaaacagagcaaacagggcaacttaggtgtccaaactgaagttgctgccaggcacggtggttctcaccagtaatcccagcactttgggaggccaaggtgggcagatcacctgaggtcaggagtttgagaccagcctggccaacatggcaaaaccctgtctccactaaaaatacaaaactgagctgggcatggtggtgggcacctgtaatcccagctacttgggaggctgaggcaggagaatcacttgaacccaggagacagaggttgcagtgagccaagatcacaccactgtactccagcctgggtgagagagtgacatgccgtctcaaaaaaaaaaattgaagttgttgattttgtgcattttttgagccccaaaaggtggcatgcatctgtagtcccactagtcctgaggctgaggtgagaagatcatttgagctcaagaatttgagaccagcctgggctgcatagtgaggttttgtctcttttaaaaaaaaaaaattggctgggcgcagtggctcgtgcctgtaatcctagaactttgggaggccgaggcgggcggatcacgaggtcaggagatcaagaccatcctggttaacatggtgaaaccccgtctctactaaaaaaatacaaaaaaattagccgggtgtgatggcgggcgcctatagtcccagctactcgggaggctgaggcagaatggcgtgaacccgggaggcggagtttgcagtgagccgagatcgcgccactgcacttccagcctgggtgacagagcgagactccgtctcaaaaaaataaaataaaaattatactattattttattttatataggtggacagttttatatgtgtagattttaatatatatttttatacataaaataaatctatatacagaaatttgtaagtttaagatacaggctgggtactgtggctcatgccctataatcccacttggggaggccaaggtgggcagattgctagagcccaggaatttgagaccagccttacatagcaagaccccatctctacaaaaaaatacaaaaaaaaaaaaaaaaagtcaggtgtggtggcacattcctgtagtcccagctcctggggaggctgaggtgggaagatcacctgagtctgggaggtcaagactgcatgagcccaccttcatccctaggatgcaaggctggttcaacatatgcaaaaaaaaaaaaagactgcataagccgtgatcacgctgctgcagtccagactgggttgtaacccagtcagaccctgctgaaagaaaaaaaaaatttttaacttataaatttgtcttattaacttataagtttacatacgtagttttatttgattttattttttgagacagagtttcactcttgtcacccaggctggagtgcagtggcacgatctcggctccatgcaaactctgcctcccgggttcaagtgattctcttgtctcagcctcccaagtagctgggactacaggtgcatgcccccttgcctggctaatttttgtatttttagtagagatggggtttcaccatgttggccaggctggtctcgaactcctgacctcaggtgatccgccccccccgccttggcctctcaagatgctgggattacaggcatgggccaccgcgctggccttgtagttgtattttagatagataactatagattcactttacatacaacaaaatgcacagttcttcaatgttccatgctacaagttttgacagttgtatatagctacctaacctccacccaaaacagtatatggaacttttctatcacctaagaaaattcccttgaatcccttttttttttttttttttttccaataacatacagaggtggaggccgggtgccatggctcacgcctgtaatcccagcactttgggaggccgaggcgggcgaatcacaaggtcaggagttcgagaccagcctgaccaacatggtgaaaccccgtctctactaaaaatataaaaattagccgggcgtggtggtgcacacctgtaatcccagctactcaggaggctgaggcaagagaatcacttgtttccaggaggcaaaggttgcagtgagccgagattatgccattgcactccagcctgggcaagagagcgagactgtcttaaaaaaaataaattaatcaaaaaaaaatatatatatatatatacacacacacacacatatctacatacatacagaggtgaggtcttgcctatattgcccaggctggtctcgaactcctgggctcaagcgatcttcccacctcgaccccccaaaatgctgggattacaggggtgagccaccgcaccgggccgaatccctctcttgacacgtcacctccccaccaaaggcagttgtcctttctgacttcaaacaccgtgcctttgttttgtctgggcgtggacatgatataaatggaatcattcatgttcttttgtgtcttcttttgcttaacataatcagtttgaaatgcagccacattgttgagtggatgcatgggctgtcctgttggcggtggtggtggtgagtggaattccattgtatgactatagctcagtctgtgattccattttcctgtggatggacccacaggctgtttcccatgtcgggctatctaagaatcaggtgccttgcgtttctgacggctggactggaggtgtcttcctctgaggtaggctctgcagggccacctgctggaccattttggggcatgaccactgacgttcacctccccatttgtccccatcagtgagccccatgcccgtttctacgcggcccagatcgtcctgacctttgagtatctgcactcgctggatctcatctacagggacctgaagccggagaatctgctcattgaccagcagggctacattcaggtgcccaccaggccgggcgaggggcagccctggggaagccgtggcctggacccttcctccctgccaactgcctgttcttgtgcccacaggtgacagacttcggtttcgccaagcgcgtgaagggccgcacttggaccttgtgcggcacccctgagtacctggcccctgagattatcctgagcaaagtaggagcctccccagccctccccttcccctgaggccggctctgctctcctgctctcgcctcctcctcaccctgtgcccccccatcttgctccagggctacaacaaggccgtggactggtgggccctgggggttcttatctatgaaatggccgctggctacccgcccttcttcgcagaccagcccatccagatctatgagaagatcgtctctgggaaggtgaggtccggatgtggggacacagccctggaagaaacagaccgttccctgctcacccatcctattccctggggagccctgcttgttgtcagaataatctagaagttccttaagtcaggccaggtggtgaagctggacgcgccggccacactgaggccaacacctcaagcccccttgctgtccagccccaaccccgcggttccagaatcccatgggcttccaaaatcccgagcctcacgggaacatcttggccacagaacacaaaccgccctgccagacgaccctccttttcgctcctcatcccagttagtgtgagttttcgcaaattccaaggcagaaaaacgaatgtatttggttcctgttcccaggtgctgtccatagcctcacccaggattgccctcacttagcatttatagcccatgcttcctctcccaaacccagacttgcctaactctgagggttcagatgaggggtggtgaagccatctcagctcacatctatgacaggtgcaaagtgcccaccatccaccaggccccagaatccccatcagtcacaccctgagatagtggcaccctctgtaggagaggtgaggaaacaggctgggaaaagggatgtgtcttggccaagatcacactttggtgagtaggtaatcaccgtaggcaatcattgtaggcactgatggccggagagaggttggggaccccacctctgccctcagctcaaccaccttgctgggaagacccgaccatcccccgacttggtccagcatctcctacacaggagcttttggttggcccggagtcatgacactgtggtgggagcaccctcaggctcagcctgggccccagtcccagctctgccaccgactggctttgaaactttggggctgggtacaatggctcacacctgtaatgccagcaccttgggaagtggaggcttgaggccaggagttccagaccagcctgggcaacatagccagaccccatctctaaaaaaaaaaaaaaaaaaacaaactggccgggcgcggtggcttacacctgtaatcccagcactgtgggaagccaaggcgggcagatcacctgaggtcgggagttcgagaccagcctgactaacatggtgaaactccgtctctactaaaaacacacacaaaaaaaattagctgggtatagtggtgggcgcctgtaatcccagctacttgggaggctgaggcaggagaatcacttgaacccaggaggcggaggttgcagtgagccaagatcacaccattgtactccagcctgggcaacagggcaggactctgtctcaaaaaaaaaaaaaaaaaaaaaaaactaaaaattagctgggcgtgatggtgcacccctgtgttcccagctcatcgggagggtgaggcaggaggatcgcttgagcccagaagtgagctgtgagctgtgattgcatcactgcagtctagcctgggtcacagagccagaccctgtcttttaaaaaaattcaggcaagtggggtgccccagctggacacatagcatcactaaaagagaaagatgaaggccaggcgcggtggctcacacctataatcccagcattttgggaggccaaggcaggtggatcacgaggtcaggagttcaagaccagcctggctaacatggtgaaaccctgtctctactaaaaatacaaaaattagctgggcgtggtggcgggtgcctgtaatcccagctactcgggaggctgaggcagagaactgcttgaacccgggagacagaggttgtagtgagccgagattgcgccactgcacttcagcctgggtgacagagcaagactctgtctcaaaaaaagggaaagatgaggcatctgccaccggaccaaaagaaactgccaagaaaatggcccagagttggccgggtgtggtggctcacgcctgtaatcccagcactttgggaggccgaggcgggcggatcacgaggtcaggagtttaagaccagcctgaccaacatggtgaaaccccgtctctactaaaaatacaaaaattagccggatatggtggcacacacctgtaatcccagctactcaggagtctgaggcaggagaatcacttgaaaccgggaggcagaggttgcagtgagctgagattgtgccactgcactccagcctgggcaacagagcaagactccatctcaaaaaaaaaaaagaaaaaaagaaaaaaaaatgtcccagagtgggaaaaaaaagaaagaaaaaaacacagaagatcccacaggagaagatgcacatgactcccttctttgtagcattttctagttcccccgcaccgtcagtggtattatctccctcgtgcagccctggcatatctgccccacatctgagaggcatgcgcaggcccagagaggttaagggccatggccaaggtcacacagcgtgtaagaggcacagcaggaacaagaagtcgtttcttgcaactataactccagtgatgacttgcatacaaggcgtgggctcagagggtttggggaaaactttcaagaagagttgagctgggctttaaagaacggaagagccttagctatgcagaaagagaggagagaaaaagtttgtcataagcaagaatatttcagaagtctccagaccccagcagagatgccttaagcagcagcagcagcagctgagaatgcaagttctagagtccagtagacctgagatggaattgccccatcacacacctcaatgtgacctaggaagagctgtttaacccaagcctcagtttccccttctctgaaatggaaatcatcatagcacttgccttagagcaatggttcttaaaagggacccctttccagcagcaccattgctggggaatttgttagaaatgcagattcttgggccaggcacggtggctcacacctgtaatcccaacactttgggaggccaaggcaggtggatcacctaaggtcaagagttcaagaccagcctgaccaatatggtgaaaccccgtctctactaaaaatacaaaaattagccaggtgtcttggcgtgagcctgtaatcccagctactcaggaggctgagacaggagaattccttgaacccaggaggcggaggttgcagtgagcccagatcgcaccactgcactccagcctgggctacagagtgaggctatttttttttttttttttttttttttttcaaaaaaagaaatgcagattcttgctgggtgtggtggctcacgcctataatcctagcactttgggaggccaaagcaggaggatcgcttgagcctagaagttcaagaccagcctgggcaacgtagtgagaccctgtctctacaaaaacttcttaaaataactaactcttgaatttttaaagtttttaaagaaatgcagattctcaggccacagtatcagacttcctaaattggaaactgtagggtaggctcaaggagctgttttacaagatgctggcaggcactctgctttggaggcccacacccagtaggaccgttggatggagaaagaagcatcatgggcttcccaagttccagaccagcttcccaccctgtccttgtaccccttcctccaggtgcgcttcccttcccacttcagctctgacttgaaggacctgctgcggaacctcctgcaggtagatctcacgcaagcgctttgggaacctcaagaatggggtcaacgatatcaagaaccacaagtggtttgccacaactgactggattgccatctaccagaggaaggtgggcctcccctccttaagcctgctgagggtttgggagcaggccaagagtcagggaggacagccaatagagaaatagagaagagaacacaggttcaggagcaacctagagtagagagcttagagcagtggggtctagaaatgggattctggggtcatttggccattccatgaccttgtgcaacagatgcctctctctgggaagtaatttcccctttgatgagttgctacattaagagtttcgggctgttaagaggaatccataacctaatggtaagcacaggcctgagtcagagtaaatatctcttgaatgttaggccattcgcatttattgttgtaataatgattatgttgaatgctgaggtctgggtgattcttgatccctctccaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaagtgtcgctggtgttctcgacttcgatcacccacccacacacccccagggggttggaaagggaatttcggaccccagcgtgcaggccgatcaggtcctggcttgaagtccttgtaaccagggtttagctgaaattccggcactccttcggccccgcaggagaaacgagcgtcaaactgccctttgaccccagattcggggtccccaaatctgcggcgcgccccctcggcgtccagcccgggaccgagagggcgctctagggaggcgctggggctggcgcgccaggaggccgagcggcggcgggggcggccctggcagggggagtagaagggggagagggtgcgcgccccccttcccgcatcctcagcgccgggccaggcgcgcctgagggacgcgggggcggcggcagcaggagggtccccgcagcaccctgcgagcgcggcagccccggcccgcgggcggcgagttcccggtaagtgcggtcccgagagcggagcgcgctggagaggcgtggagaggggggctgggcgccggggacgtctgggtcccgcgcccaatggctggagggcggccgagcgccgcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15327 - DNA, 11290 bp, Human
gtgacagttctttgttgcagaaaaatatttcactttgatgaagtacagtttatttttctgttgtcacttgtgcttttgatgtcatatctaaaaaaccattgcctggccgcattggctcacacctgtatcccagcactttgggaggctgaggcaggcaaatcacttgaggtcaggagttcaagagcagcctggccaacatggtgaaaccctgcttttacaaaaattatccaggcatggtggagggtgcctgtaatcccagttactggggaggctgaggcaggagaatcgcttgaacctgggaggcggaggttgcagtgagccaagatcgcgccactgcactccagcctgggtaacagagcaagatctgtctaaaataaataaatacgtaaataaataaaaataaaaaaacatgactgggtgtggtggctaacgcctgtaatcccagcactttgggaggccaaggtgggtggatcacctgaggtcaggagtttgagaccagcctggctaacctggtgaaaccccagtctccactaaaaatacaaaaaattagccgggcatggtggcacgtgcctgtaatcccagctactcgggaggctgaggcaggagaatcgcttgaacccgggaggcagaggttgcagtaagctgagatcacgccattgcactccagcttggacaacgagagcgaaactccgtctcaaaaacagaaaccaaataaacatttcctaaccaatgtcacaaaactgtacccctatgttttcttctaagagttttcagaattgcccttggaatgcagttccccactctttgggcacacccctgagcaggccccaagctaaatccctggccataactccccacactactcccaccctaaccccaagcaagctgcttacatttcagtctttcagtttcaaggttccatgtagggtgggcagctgtggacaggtatcaaggcagcagttggggccggccagcaggtttaggatgcaggatagcaagagaagagtgcctgactgggaacaaggccacgcctctgagacaagggcttctgggctgaagtagtgcctgctggggccaacagcacaacctacctggacagctgtggcaggtccttaagggaggggctgggcccactgctggccaccgccaccctagtccaattctccattgctaggagctgttgcgtattacctagaaaaggagcttgtaaaattgactctctggtcaccaccaaacttgtcttttttttttttgagacagagttttgctcttgttgcccaggctggagtgcaatggtgtgatctcagctcaccgaaacctccgcctcccaggttcaagtgattctcctgcctcagcctcccgagtagctgggattacaggcatgagccaccatgcccagctaattttgtattttttagtagagatggggtttctccatgttggtcaggctggtctccaactcccgacctcaggtgatctgcacacctcggcctcccaaagtgctgggattacaggcgtgagccactgcgcccggcccaaacttgtctgtctttatctctacttacagtgagtgtcaggtcaccctcttggagaccggtgatcagaggctgatgacctctcacagctgctggccctggggacctaggggatccctttgggaatcccaggtcaaccgggtgccagctccattgctctggctgtgtgggtggtggtgggtggtgaggcacatagaaagtcaccagcgccagggaagggcagctcagaaatcctggtcatgccaagtgccactcagggctattctcactctagtgagtgctcattggttcttcccgaagtccagagggaaggacaccatcgggggcgctgtatcccacccggcaccattagcccctgccacccaccacccagcagctggattcccacgggagttgcgggtgggggcggaaccggctgaggtctgggggcggggcgtccgggcgcggggcggggctggcgggaatgtgcgcacccccgcgcggggccccgcccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggtgaggggctgcacggggagcccctagcccgccgccgcctgtcccggccgccgaggagggcgggcctcggggacgctgggggcgagttcttcccgcgggagatgtggggcgggcagctgcgcctggagcaccggtgcacggaagagtccccgggacaggctgttccccacgttggaagggaggaagcgaggaagtggccgggagagggtgcgcggccgcctcttggctcaagcccgccctctgggggctggggctcctcgccttcaacctgggagcatgttccccttaaactgtgaggccctgtgtgccacgcagaaggggacactccgcgcctccggccaccgtggggccccaaccgcagacctgggcgaacgtagccttctggcccagcccgttcaatttacagaggaggaaactgaggcctagagaggcccagtgaactgctggaggtcacacagcaggttcttggcggggctgcgacttgggagtgaggactcccagctttcagcggggggcgctttccgccccatctgcagcttggggagtgcacaggtacaggatgtccagagccaccccaaaatgtaaaggctttggagctccagtgatctgttttccctttgggctagctctcccccttgccccacagctcagggcagagtccaggtctgtgctccagctgcagccgccccgcccctgaagacctaagggggcagggctcaagcccccaaggtcagctggccctcaggatcttccctgcgacgctgaacctggaggttcagaacctgatgactgtggaggcatcagaacctcggctggaggcagtgtcattggagaggcttactccagctggcggaagcctcacgtactgcttgtctctcctgccaggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccaggtatggggcccaggcctgagccaagtcctcactgatactaggagtgccacctcacagccacagagcccattcatttgtctgatacactgtggggaaggcttgtagagtggagcatcccattgtacagatgaggaaactgatgcccccagaaggtcgggaacttgccctgggtttcccgtgacctgattggaggagccaggatttgaaccccagccttttttccctccagagccctaaaccaggaggacaattagaagtgtcccagcaacctcagagggtgggaaaatggagggcagtgggtcccttggcccagcaggttggtggcttctgacaattgagacacacaccctagaaacagctgctaggccgttgctgcccttcccgccaggacacctgcccttcctgtgccatcctcccaggcagcccctcttaccatcacctgttctttcccctgcagctgcccccctccctggcttcagtgcagtggtggtcagctcagtgcccctggggggtggcctgtccagctcagcatccttggaagtggccacgtacaccttcctccagcagctctgtccaggtaccagctaggccccagccctgacccagccctccttccctgaggtctccaggtggtcccagcttctactatgccttatggagggggtggcagggaatctccctggagtgtcattgaagccactgctgcttccaccagccctagcctccccacctcaccctgtactgcagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggttgggctcgctcccctcgtcccctcccgccctgcactcagcagctcctgggtggagtgtgcccactgcctggcgcagcaagcacacgcttggcctcgtcatctcccccattgtaactccaccccaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagagggtgagaactgccagggtgctctatcctggaggcggctgtgctccctgctggcgcctcagtgtggccttgaccctgcctgggaccccgatctccagggccttctgccatgctctccccagtcccttcaaacactgcgcacccagggttccaatctcagcagggctgcttgaaatcctaaaatggtcttatctaatcagaaaaatcatgtttccattgtggaaaatgtagaaaagtacaaagtagaaaataataagctataaggccactacccagagatagccactgctgacattttcacgtttcctttcagtatttttccacatctgtcttcaaagctgagtatatgtaatatatcatcactttccccccccacccccttttttttaagaggcagggtctcattctgttgcccaagctggagtgtagtggtgtgatcatagcttactgcaaacttgaactcttgagctcaagggatcctcccagctcagccttccaagtagctgagattacaggtgtgccaccatgcccggctaatttttatctttgtaaagacggtcttgcagtgttgcccaggctgatcctgaactctggcctcaagtggtcctcctgccttggcctcccaaagtgttgggattataggcatgagccactgcgcccagcccatttgccgtgttttttttttggacacagagtttcggtcttgtcacccatgctggagtgcaatggtgcgatctcagctcactgtaacctctgcctcccgggttcaagtgattctcctgcctcagcctcccgagtagctgggactacaggcgcccgccactacgcctggcacattttttatagttctagtagagactggggtttcaccatgttggccaggctggtctcaaacgcctgacctcaggtgatcctcccgcctcagccttccaaagtgctgggattacaggcgtgagccatagtgccggtctcttttttttttttttttaaactaaacataatctcagaacccagaaccctatcttatcttatgccatgaaaggcatatctcggtgtggctctttttttttttttttcttttttttttggtgaggtggaggcttgccctgttgcccaggctggagtgcagtggcgcaatctcggctcactgcatcctccacctcctgggttcaaatgattctcctgccttagcttcctgagtagctgggattactggcacccaccaccacgcccagccaatttttatatttttagtagagacggggtttcatgttggccaggctggtctcgaactcctgatctcgtgatctgcccgcctcagcctcccaatgtgctaggattacatgtgtgagccactgcacctggcctccgtgtggctctttaaagctccacaatattttagcattcaggtgctctgtcatttacttaactattttctgatacacctcacactgtgattaactttttttatttatcttttttattatttatttatttatttatttgagacagagtcttgctctgtcacccaggctgcagtgcagtggcacgatctcggctcactgcaacctctgcctcccaggttcaagtgattctcctgcctcagcctcctgagtagctaggattagaggcatgtgccaccacacctggctaatttttgtatttttagtagagatgaggttttaccatgttggtcgggctggtcgtgaactcctgacctggtgatctgcccacctcagcctcccaaagtactgggatgacaggcatgaaccactgtgcctggccatcttttttattttttaaagagatgggttctgctaagttgcccaggctggacctgaactcttgggctcaagtaatcttctcacctagtctcctgggtagctgcaaccaaaggcacccggtttatctgcattctcttttttttctttgagactgagtcttgctctgtagcccaggctggagcgcagtggcgtgatctcggctcactgcaacctccgtcttcagggttcaagcaattctcctgcctcagcctctggagtggctgggactacaggcgtgtgccaccagagcgagttaatttttttttttttttgtatttttagtggacactgggtttcactatattggccaggctggtcttggactcctgacctcaagtgatccgcctgccttggcctcccaaagtgctgggattacaggcacaggcgtgagccactacacctggcctatctgcattctcttaatagtttcttagaaatggattcttaggagtaggattacagagtcaagagacacaagtattgtaggctgggtgcggtggctcacgtctgtgcctgtaatcccagcactttaggaggccaaggtgggcagattcattgagctcaggaattcgagaccagcctgggcaacatggcaaaaccccatctctaaagaaatacaaaaattagccaggtgtggtggtgtgtgcctgtagtcctagctacttaggaggctggggtgggaggatcaattgagcccaggaggttgagactgcagtgagctgtgattgcaccatggcactccagcctgggcctcaaagtgagatcctgtctccaaaacaaaaaagatacaagtatccttaaggctcctgctacacatggccaggaaggtagtctattggacagttttaaggtcattatcaatattagctcatttaattccctccaaaactctgtaaagcacattctgctaccatagttgtcatatttttgatgggggaatctacagtgagaggcagtgctgggatctgaaccccatctggacagattagctccagggcccatgctcttgactggctggccgtgctgcccacactgagttgttccttcctggcagtgtaggtgtgcctatctcagggacactagacagctccgagggacctccctgtccttttcctttgtgaactgtgtcacgttctccagagcagtgctcagacctgccctgcctgctctgtgcagatgcccttggccaaggttttcacactggaacaagttggtccctcctccccaccccagcctgtccttgcccctcctccaggtctccttctgcataggagcagctcaccctgcctcctccagagtcctgccctagaagcgcaatccctctccttccatcccctgcctggctgcctggctccttccctcagcctccaagacatgctcagttttcttccctcctaaaacaccacccactgtctcatttccattcatttctttctttctttctttctttttttttttgagagggagcctcactctgtcacccaggctgaagtgcagtggcatgatctccactcactgcaacctccgcctcccaggttcaagcaattctcctgcctcagcctcctgagtagctgggattacaggcgcctgccacgatgcccggctaacttttgtatttttagtagagacggggtttcgccatgttggccaggctggtctcgagctcctgacctcaggcaatctgcctgcctcagcttcccaaagtgctgggattacaggtgtgagccaccgcgcccacccattcatttctcagtcctttgaatctacttgcccctccatcccgccatgccacctaccctaacaaccttcccccttaaacctgcgggtttggccgggcgcagtacactgagtcagtactggtactgacccaggtacccctccagcctcagctccagtcagatgggacagcctgctggtccctggctgcttctgccccctcttctggagccccagccctggaggctccatgtggctcagcagaacttcttctcctcctgctctgtggtggcctcttgagggcagcactcaccttggaaagcatggagtgtttcaaccctcactgctccctgaaggaccaaggtgtcccattttacagtcgggggaggaggcactgtgataaaggggctcttcagacccacgtctgagagagccaggctgccccgcccccgcggccttccacccttcaccgtccagccagggccactgccatcaccgcctgctggtcctcacaggcgtcggggccccaggcagtgagaaggcggctgctgactcctctttcctccccagctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcaggtgaggccctctgggcgccccgctcctgccgggcacaggccggcccaggcccaccccttcaatatcctctctgcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggtgggcgggcaccagggcctgggcgggcaggagcggcagcttcccggggccctgccactcacccccagcccgcctcttacaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggtacctgcctcctctagaggtgggtgtatgcttgggtgtcagagaatgggggatgtcagaaccgctcccctaccctaggggagcacctctcaggccccagaagaatgggcaaggcagggcctagcagtagcaaaaccatttattaagtgcagaacaaaggctgggtccttgtgctgctcccagctctttggttacaaataggtttgggcccacagaggacggaccttgcccccttcatgcctcccaggagacacctagcccctgctctgtgcatgcgggtgggctgggcccccaggggtgcaaggatggagtagctgaggaggctccgggagaggagtcgggaggacgcctagtgggacgtggcgggggtggggcagggtgcggtcaagtttggaagaactgttggtccatgtgggtgctaagggttccgctggtggtcagtgtccggctcacaaactcctgggtcacatgccgggtgagggagccgcctgcctccaggtgctgggcccccagggtcagcccatctgtggaggaggaggcattagatgacctggcttggggtctgcccttctccctctgctagctccctgtcccaggagagccgggatcccctagccctcagtgctcacccactaggaagggctcggtggcgctggtgtgggtggtggtgatgctgctgtactcgctttgcagcgggtgctggaagagcccggcacggctgcccagctgcgggaagggtcctggggtgggcagataggccagtcagagggtggtgccagaaggaggcacggcccgaggaggggtgggggtgaaggaaaggacaggtgcctacctccatcctgggactctatggtgatgatgccctcgcgctctggcccgaagccctcagtggtcctggcctgcaccttgaacttgtagggcacgttctcgctgaggcccggcacggtcagccggctctcggggctgtctccatccacccggaatgcggtggctggccctgagcagggaagatgccttcagcctctgcggccccctctttacccctcccctggccactcctgcccccggggtgggcagcacctcctccttgggccatctcacaggtcaccaggtagccgacgatatccccattgggcctccgtggccgctcccagctcagctgcagcgagtctgggctcagggcagtgaacaccagcgggcctggggcactgggagtgctcaaagtgaaggcggagcctgggggcagtagaggaagagcatcagcctgtgggtgggtggtgggcatgatgggggcagctctggggctgggggaggcaactcacctggcaggggacacagtgggctctgcgggtgcacctgggattcaatggtgatgacaccctcacgctctcggccccagccttcctggctctgggcccgcacgcggaacacgtaggagtggttgggcaggaggtcttccaccaccaccgaggtctgggcagggttggggatgttgagccgatgcagctcacctggggggatcaggtgggggcacacagtagtgcagtgttactcccacccctggcctgatcctcctcgtccctaagctgccatcgagacctagttatcacccacccaggactagctgtggtttgggtacaggttgggtacagtatggtatggctggttgttcagattgtgtactatacaagagtggagcctgtaatcccactcatgtttaggcaacatcctgcatcctggtcatgctgctttgaatgtgcctgcccagggaagtgccacttccttgttcccccaaaggcatctcaggccagcagaggccctaggatcccagcccaaaggggccttgttaggcaaaacctagcagagaatgaccaggagagaggcccagggaggtgggtgagacctcagaagaggggaggcaaagaagtggggtggagaatggggtgggagaccctctcaggctggatgggggctttagcgctcaagggacttgggtgggttcct

SEQ ID NO: 15328 - DNA, 111235 bp, Human
  misc_feature (1)...(111235): n = A,T,C or G
tatttctttggaatggcagagttcagcatttcctgacccccctgcaaaataatgccacttcattaaggcgataatgactcttccatgtctaactcataggcactttccttttttgtctctcaagtaataggctgtggtttctcaaggatttttatgctgtggtttctgaaggatttttgtgatcctttcaaagcagcttttgtcaagcaaggtgttgtgaaatgtgcagggtctgtttataagaagaggtaggtatgtggtcaagttcagggtgggttcggtggaatcagaccaaccagcagcccaagcagagtgttaacgctgcaaatctgtgccacgttcttcttcctgcgtgcaatttgcaggcaaagacatatgcttaattgggtgtgaaacccgggccttgattaaaaggactttatgaggccgcagccttacatttccaaggtcaggccctagtggagagggcgcgcgttccgcggggagacacgaacttttcctgagtgcgcgttccttgctggtcctgaacccctcggccaggcagggcttggcagggccgtttcctgtcctaaccaggatcaagggattgcgcggcttgctggtgaagcttggcagggccgtgacctgtcctaaccaggctcagggggatggcgggggcctgctggtgtcgcatatgttttgcattccagctcaggattttgcagcgcatagagagcgggcgtcaccactagggggatatgctacccacaaaatgcaggtggaggctgggcgaggctagcagccaggggccagaaatccaaagcttgagccaggttcagacttcctgactcccactcccggttagctgtgcaaggatggctcggcctggtccccctaaaaatgtgtccgttctaacttagaggccgctttggctctcagaaagcccccctgacctgaggactgagggactggagaccgctttcagtcgcagaatcgctgagatccctcaaaacaaaggcgtttccagtttgaccccttgctgctcaatgtgtggttggccaaccgacagcctggggcgccctggttgcgggtcaggggagcagcgtctaggccgtgccaggcccgcaagttaagcactgtctgcatttccctggggaaaggggtgaccaaatatctagctatatttgcatttcaaatccacacggataagagttttaaatataagtatgtccaactattgcctaagccacacttacgctaggaaaaaaaaaatctttgcgtttctgaaattgaaatgtgtctgcacagttctttatcaggttgtcgccggggtgtttaaacagtgaccaatcaagtttcacacgctacatttggtcgggcgacctctcaaatctgtctttccctagttctttaaataaatgtttatttggaaagaattctagatccacaggaagctgcaaacaaacgcacagagtcaagcccaccctttctccccctttccaagtaaaaatgtggaatcaccagtcctacgacgaaaccagggcgctgaccttgttccccagacccggcagcccctcttggggatccgcgcgcagcgcgcgtcctgagtagccaggctaattccagcccctctcctcaccaaacgccaatttcactttctatttttgagcttcacttttgctgagccacgccctccctgtccccgggccacccagcctccccatcttccgggtttgggtgcagcaacgcgggtggcccgccagtgcgactccggggagaagtcatcctgggtcccaccccgggggcgccccgggcgcggagggggcgtgggcacctccccagcgccgcccctgcccttggtgactggagtcgcctgcacgcccgggtctccgactcctcggctgggtcgccgcccgggcggagcccacgcgaaggcgacgccccccaaagccccgcggccgggtgggggcggggagaggcgtagtcacgcccaggctgcttccgcccgccccaacagcgcgcacgcggccaccgagctggaggaggcggcgggcgtgagaccgggaatgcttggggcccccgccttcctcgcagccatccagcactcggtgcacgccccgcgaggccagcggctgctccctcccggggctattgctgctagtgccgtgagcaccgcccagccattgtctctgtgtctccgtcagccgtgccgagccgcgcacccagaggcgagggcgcgcatggggagcctccgttgatgctgccgcggctgccgcgccgccctccgaggctgcgtcccggggagtccggcttcccgagcgctccggcctggcccggcgccccggacctgagtgcctccccatggaggcgcccgggccggcccaggcggccgcggcggagagcaactcccgagaggtgacggaggatgccgccgactgggcgcccgcgctctgccccagccccgaggcgcggtcgccggaggcgcctgcctaccgcctgcaggactgcgacgcgctggtcaccatgggtgagtgagtgcgcgcgggaactcggcccacaggggctcgcggcgcggccgggaccccgtagtaggacaaagggccccgggtgcccgcttcctggggagggccctgcagcgggatccccgcgcggggctgcccttgcgccctgggtctccccgggggcctctcggagaactggagcgcaccctccagccccggcgagtcccccggactggctgggggccttccctggaacgccgagggctcctctggaagaccactctgtatccccagaacacacagcactctggggcctgggccgtccgacgtcacaaaacttcctgtaggacatctcgcctagagtacctcgtgcgctctcccaggcagcggccccagggacacgggcgcggggtccctcaggccagcctccccgtgtgcccagcggcagggtccttggcggggaatgtacagatttctccatgggctgcaggagcagctgggctccgggggacagttgttcgtggctttgtggggatgaagacggcggagttggggacggatcctaacatgtcctgacaccgcctgtgctcttcgtcttgtgcgtctgaaatgggtaattcttgtattggacgctttatccgtttcctttgtcgtctgtctttgaacttaacctcgaatgggcagcttgacagaggtttcgagttcacagtgcgtttggatccggacacgcgctggtttatgggggcagcccagagtgggtcagaatatcccagcggcatgtgggcgctggatttaaacagttgtcaccggcccgcctgtgcttcttagggactctgtatggctaagtggggtgttggttgtcaagaaaataaatgggagagcggaggggggtgtcttgggtgtgttggtggggcgggggctctcaaaccctcttaactcctgtttgtcctctcattttggaaaggaggaagctgggctgggaagcccaagggcttaaggtcacaccttagggcttaggaagaccagcgggcatagccagagggccttcagaaccgctgaggaagagaggacttagcttccttcagtgacctctttgccacttagaccttgagggaagggcccacgaggaaagcctgagtttggaaggacagtgtgggacgaggccctctttgtttctgcgctccctccctcctcctatctcattctctctttctctgtttctctttctgtgaccctgttcgtgtatctgcatttcttctcctctgtctctctcagtctttctgtctgttcccttactgtcttggtctctctgtctccctgccttctctctgctttccctcttcttctggtcccccatggaaagctgtcctggtctaatcttagagctgggtgtgttttgcggggaagaagggtggggcaggaaccctgactggttcagccgccacagtaggtggaaatacagctcggcagtggaaaattgatgaggtccagccgttccttggcactcagcaccagagtttgtcattctttggggcacccacatgggtccgttgggaaacgtggagctggggctggaggccggggcagagagcaggatgcgggcaggagggcggcagaggtgaggagctctcgtgtgacagggggccactcagtttgacatcaagtcagcttagggtaccaagcgggtaacctcatttttaaaaatagattgtcgttgtctctagggaccaagctggctgggcagggaggtcagctttttttttcagtccagtcagtgctctcttaatgaggatgatgctgctttctcaaggataacttcctgtgagctccaacgatgtgacaggagagctaggtatcctacactaattgggcaacaggagaccaggacccagggtgtgtgtgtgtgtgtgtgtgtgtgtgtgtctggaacactctctcatgacaacttcacagctttggtgacattatctgcagcattttatccaagcccctttctttgttgttggttaaagagcaatgtgactgtgattcacctaaaagtagtagaataaattctaaaaaacccaagggttttagagtcttcacgattgtctctctgagccacaatttacagcagctttggactcttttacaaggcgtgatggagaagagtgaggggcgagcttgagtctcagtctggagttgaaacccagtctgtgtgggtgtgacccctcttcatcctaaactgtcaccgctggaacataagtttgcctttaagcgctctttccccctccttcctaattctctcaggccccaaacaagcatccccagaagtactgaactttttggggggtgggtggaggggatctgtatgcagatttccagttgagcaatcctcttttctatgacttaaagccaatcacaggctggacgtggtggctcatgctggtagtcccagcactttgggatgccgaggcaggcggatcacttgcgctcaggagttcgagaccagcctggtcaacgtggcaaaaccccatctctactgaaaaaatacaaaaattagccaggcgtggtggcaggcgcttgtaatcccagcttctcaggaggctgaggcagaggaattgcttccacccaggaggcagaggttgcagtgagccaagatcacaccattgcactgcagcctgggcaatggaggaaaaaaaaaaaaggaaactgtcagtgttctagatagaccagttttcctcaagttcaggtagttaggaagaaagagtgcagtttgcaattgtgaaaaatctgataatggatttttttttcttttttgtgcatgaagggattctgtagtacgtctggtttaaaggctgatttaatagttttaggaactttggatcagaacagccatacgactcctcagagaaaaaatgggtttcagtctggttctttaaatttcttgtttatataaccaagccgtgcttgttcctatgagggagaacaattgtgctttaaaaaaggaaaatctgggccaggtacagtggggcgtgcctgtagtcccaggtatttgggaagttgcagtgggaggatggcttgacgccaggagttctagactagcctaggcaatacagcgcgaccctcatctcttaaaaaaaaatagtaataataggtagttgggcatgttggcgcatacctgtgctgttagttacctgggaagctgaggcaagaggatcacttgagcccaggaggtcaaggctgtagtcaaccatagtcatgctactctactccagcctgggtgatagagcgagaccctctgtctaaaaaataaaataaataaaataaaataaaataaaataaagtgagacctgtgtaaaaaataaaatgaaataaaataagataaaataaaataatttatggaagtgaaaaacttaacactacgtagacagaagaggatgtctctctgtgcagcaatccaccagccttattttaccaatcttcccacttaaaatgactgtttgagaattgctttctctgtatatcagataaaaaatacttaggtttggccaggcacggtggttcatgcctgtagtctcagcactttgggaggctgaggtgggcagatcacgaggtcaggagatcgagaccatcctggacaacaaggtgaaatcccgtctctactaaaaatacaaaaattagttgggtatggtgtcgtgagcttttaatcccagctacatgggaggctgagacaggaaaattccttcaaccagggagtctgaggttacagtgagccaaaatcacaccaccgcattccagcttgggcaacagagcaagactccatctcaaaaaaaaaaaaaaaaagaccccaaaaaacttaggttttattccaaaagtgtccttattgaatcatttggcatctataacccagtgcttgtttctcatgggtatcccccatgttagcctgtcaggaaggaggtaattcagcaggtaaaccagtggccaggatttgggtccacatttcatcttccttttcttaacctagttctacatttactcatctgaaaaaaagggaagtaataacagtacctgtcctacacggttactatgaggaagactccaaagttcctggacccgtactaaaatatacgtattttgaaatacaggctcacaggagatttcaaaaacagtacctggagtctcacagacccttcagccagcttctctttggtgacgtcttcatatccatgggacaatatcagaaccaagtcattgatgttggtatatccctattaaagagaacacatacctcattcagcttgttttttttttttttttttgagacatggtctcactctgttgcccagtctggagtacagtggtgcgagctcggctcaccccagccttgaactcctgggtgcaagtgatcctcccacctcagcctcccaagtagctggaactacaggcatgcaccaccatacccagctaatttttgtatgttttgtagaggtagagtcttgttatgttgcttaggtcttgatctcctggtgcctcaagtgatcctcccacctcggcctcccaaagtgctgggattgtatacaggcatgagccatcgtgcctggcttgttcagccttttactagttttcaaaaggtgctcatttgtgtttgcgagtgtgtgtgtagagttctgtgcagttttacccagtgtgtggatttggcagctaccaccctccaaaccatggtacaggatgaattccctcaccgcagacccctctgtcttcctcaacacatttttttttgtaactttcacatgatataccatctgaaaatattttatattcttaagagctaggagatcttcataattaatgatgcatggttctgaaatctaaagcgcttgtactggtagtttttaattctgtccttggtttttagaaataaggcttggagttgcaaggaaaatcgagcccttagagaaaggatttctcagcaaaaaaaatgtatttctgcacagaagggtgcctcctgtgtggctggttgccccaagagcaccctgaacaaaggagagtagaagtttttattcctaaggcaactcctgcccctgtgtcctttccccattggctggggtcagactgcacaatctaaaatagacccgactggctaaacatttcaacgttctttaatgataaggtggacacatgattggagagaggagagaggagggaggggtcgtctgtggcgaactagaaagccagtcttttcccaaataaaggaaggagggtgagctggtgctgataatgccactggtgctgtggcatgcctgggcatgtagtaaagtcagaaagaagaaaaggagaagaaagagatgcaggggtggatactgggaattaaagaataaaaggttgagcaggctgtttgaagagaaaccttgccatatctcatattggttctcctaaattggccagaattttcctttgctctcctcgttgctgggtcttattaatgccttaagatagttcattcaggctgttgtagcaaaataccaccgactgggtggctttttttttttttttttgagacagagtcttgctctgtcacccaggctggagtgtagtcgtgcaatctaggctcactgcaaactccgcctcctgggttcacactattctcctgcctcagcctccagagtagcaaaccacagacatttattattgttcacaattctggaggctggaggtccaagatgaaggcatggcagatttggtgtctggtggggacctgcttcctggttcatagatggtgccttctcgctgtgtcctcacatggtggaaggggtgagggagccctctggggtccctttataagggcagtgatcccattcatgaggctccaacctcacgacctcatcacctccctagggcctcacctcctgacaccattaccttgcaggtgaggatttcaacacaggaattttagggggacacagacattgagtccacggcatccccacacagcatgctgccgggacgaatggcatctgaactggtgagattctactgtgtgcataaatcagcagccttgtgggcagtgttgacatagcaattaggagtgttgtttgtagcctaacaatacacagaaagtggagctcagccctttgatcttatttatcttgtgtgggtgctccgtgtgagacaggctcatgcatgtgtgaatgacagtttcctttaagtgcatcatgcaaatgccaagagatgagatcaaatattacacgtcagagaacatttccaaggatagaagtcctgccggtttctcctcttcattgtttatttcattttatttttttaatttaagttaaattaaaatacatgttaaattaaatttaagttaaattaagatacatgtgcaggacttattttaaataaaagagacagggtctcgctgtgttgcccaggctagtcttgaacccctgggctcaagcattccgcctgcctccgctgctggcacataaatgccaagagtgcagggacctctgtgtgttggagtcgctttcatctcccacatccaaagaacagacccggcacttagtgtgtgcccaagaccatccactgcatgaatagagaaatcaaccctcctcatatgcctgggatttcctgaggtgggaaaccttcaatgctagctgggaaagtcccaggcagagacagggacaagctggtcactctgtgtgtgaataaataaatgaatggatgatggcattatcggcagttgttctttatgacactcactgatgccaagtactggacgggtacaatatgtacattagtttatgggcagaagttccaccatgacaatattaacattattttcttttttctttttttttttttgagacggagtcttgctctgtcgcccaggctggagtacattggtgcaatcttggctcactgcaagctccgcctcccgggttcacgctgttctcttgcctcagcctcccgagtagctgggactacaggcgcccaccaccatgcccggctaattttttgtatttttagtagagactgggttttaccgtgttagctgggatggtgtcgatctcctgacctcatgatccacctgccttggcctaccaaagtgctgggattacaggcgtgagccaccgcgcccggctgcctctttttttttttttttttttaaagacaagagtttcactctgtagtgaaggctagggtgtagtattacagccatagctcactgcagcctccacttccctgggtcaagtgatcctcccacttcagcctcccaagtagctggaactacagatgtgcactgccacactcaactaatttatttatttatttttatagagttgggtatggctatgttgcccaagctggtctcgaactcctgtgctcaagtgatcctcccacctcagccacggaagtagctgggattacaggtgtgtccaccgtgcttgtagtcttcttaatggaaagagggtctgagagaagggatgctatgtggcagtaggtttcgcctgcagcacgctgcctcctccctgggaatgtagggcatgcacactggatcagacgacaaaagcaatgtcatctgcagttcataggcacgctgcaaagaagggagatgttaaactctcgaaagcagcagacactccccaccaggaagagacatggtttgtgaaaatcaaaggagggtgaaggcatgacaatcgtgagcccaggaggttgaggctgcagtgggctgagatcttggtactgcactgcagtctgggtgacagagaccttgtctcaaaaaaataaaaattcatgggaagccaggtgtggaggctcatgcctgtaatcccagcactttaggacgctgaggtgggaggatctcttgagcccaggagctcagtatctgtctgggcaatatagtaataccccatctcaaaaaaaaaatttttttttttttgagacagtctcactttgtcacccaggctagagtgcagtgctgcaatctctgctcactgcaacctctgccacctaggttcaagcgattctcctgcctcagcctcccaagtagctgggattacaggctcctgccactgtgcctggctaatttttgtagtttttatagagatgtggtttcaccattttggccaggctggtcttgaactcctggccttgtgatccacctgccttaacgtcccaaactgctgggattataggcatgagccaccacgtctggccaaaaaaaattttttaaagtagctgagtgtggtggcatgggcttgtatgtagtcccaactgctagggaggctgaggcaggaggattacttgagcccaggaggtggagactgcaggagtcatgatggtgccaccgtgctccagcctgggcaacagagtaagagcctatgtcaaaaataaaaggaagtatcaagggagatgattacacagtgcctggcacactgtaggtctccaaaaaataaaccttttctatccatcagtttcctcttctctccagcatgaaattgcgtatgtaaagttgaaaagaaaaaagagagagagaatctttcaaaaaggtggtaatgttggtggcattgtggttgtttaaaacaaacaaacaaacaaacaaaaaaccttgggggaaatacagagaaagccccaaggcagtccttccaaaaagctgaaagtgctttgctttgtctggaattgtgaccgagttttccctgttagaaaagtctgtggttagaagcttcctgttaagccagcttcctggtaagaaggtggaaccgttgtttcttctgtgtgacgggttccctctgccgtttctgtaggttgcctccctgtggtcgtttactgtggtgggtccagactcaaaaccaggtttggggccaccatcatcatatttgtgtcccccaccccaagattcttatgtcgacaccctagtccccaagatgatgatattagcaggtagggcttttaggaggtgatgaggtcatgagggtgggtcctcatgaatgggatcagtgtctttataaaagggaccccagggagctccctcgccccttccactatatgaggacacagcaagatagcactgttaattaggaagctggtctctgccagatgctgaatcttccacaccttcatcttggacttccagcctccaggactgacagcagtaaatgtctattgtttctaagccttggtctactgtgttttgtgatggcagcccaaatggatttagatggggctctattcaccccatgcagcagggtccatggaaaggcagctgtgatgagatgatccatcattacctctttcatgcagactgaacatctctgcttttctgttctgttctcttccactttttcatgctatattttctcagcattattcctcttgtttctggcctcttttgaagtcttcttttccagggatctgcatttcccccatcctcttgaacaagaaactactggccctgggtctccttaccttgcctcccacgtgttgctcatctccttggagatggaaactgaagaagaggaagaaattttaacatgaagaggaacatagaacacacagatcccgagagatggagaaagccaacccagtggctcagggagacagctgggaggggaaatggggaggactgctgaatagaatatccagtctcctttgggggcgataaacatattttggaactagattgagatgacagttgtacaacactgtgaatatgctaaatgtcactagatggtcaattttaaaatgattcattttatgttatagtgaatttcaccttgatgggaaagaagataaagaggaagctggtggctcgagcctgtaatcccaggactgtgcaaggaaagagacagagtttgacgctactggtggccaggtcttgcagagcatggtggcagactttttttttttgttatcgagtctagctctgtcgcccaggctggagtgtagtggcgtgatctcagctcactccaacctccaccccccagttcaagtgattctcctacctcagtctcctgagcagcagggactacagatgcctgccaccacacccggctaatttttgtctttttggtagagacggggtttcaccattgagatcatgagtggtgggattcttggtcttcttgttctgttttggagatggaagccacaggagccccttcgagaatgaatgtagggtgtaactgtattagtttgctctgactgtcataacaaaataccacagactgagtgacttatttaatagaaattaattttcccacagtcctggaggctggaagtctgagatcaaggtgtgggcaggcctggttcctcctaaggcctctctcttgggcttgtagatgctatcttctccctgtgtcctcacagggccatccctccattcgcctttgtgtccttatctcctcttttttaatttttatttttttagagacaggattttgctctggcccagcccagagttcagtggtgctatcatagctcactgcagccttggcttcctgggcccaaagcaacgctcccacctcagcctcttgaatagctgggaccacaggtgtgcaccaccatgctcagcttttgtatatatatttttcctagagatggagtctcccaatgttgcctaggctggtctcaaatcctggcctcaagaaatcctcctgcctcagcctcccaaagtgctgcgattacaggtatgaaccactgcacccagcttcctcttcttactaggataccagtcctattgggtcagggtccaccctaatgacttcattctaccttaattaactcctcaaggacagcatttccaaacagtcacatgctaaagtctggggatgagggcattgatatatgattttttggggcacataattcagatcattgcccctgtgaaaattgtaatgcatctagggatacattggaacttctcctaaagcaatattgtagtgtcaccccagttaaagctggcttcttagaagatcccccttgttggttgacttctgcaatctctctcatgttccttcacactgtcttagtcttgcatggctgctggaatgaaggaccacaaatacagtggcttaaactcacatgcaatgaagagatacctgcactttcaggttcactgcagcctgagtcacacaataaccaagataggtcaacaacccctgtgtctgtcagcggatgagtgggtgaagaaaatatggtctgtacacaatggtgtactattcagcctgtaaaaacaataaagtcctgtcatttgcaacaatgtggatgcaactggaggtcattatgctctgagaaataagccaggcacagagagacaaatacggcattatctcactcctttttttttggacagggtctcacttggacacccaggctggagtgcagtgatgtggtatcactgcagcattgacgtcccaggctcaagggatcctctcacctcagcctcctgagtagctgggactgcaggtgtgcatcaccacgccaggctattgttttgatttttttttgtagagatagagtcttgtcatgttgcccaggctggtcttgagctcttgtcctcaagtgatcctcccagtttagcctcccaaagtgctgggattgcaggcatgagccaccacgctctgcctgacctatgtactttagaattccagaagcaaatctcgtatcctgctggaggagcaagacggaaacgcaggtgctagagggcagattgtttgcacagaaacctgggcatgtggatgaatttggtaatactcacgtgtgtgcgggtaaacttggcagacccctttttttccaaggttcccttgtgcaaaaagaatgaaaccagtgcaaccaatacttttaagaagcccctcctttctggagtgttttcacgttgcatttctcgggtgggcatgttttcctggcatctccgattctgtgctgtgttgggtaacacaggatgatggacattttgcttccctattaggatcttaagtgaaagtccagttggcatttgcatttgatctgagtaggagaaaacatgataaatagccattagaggccaggcctgggggctcacacctgtaatcccagcactttggtaggccgaggtgggcagatcacctgaggtcaggagtttgaaaccagcctggctaacatgacgaaaccccgtttgtacccaaaaatacaaaaactagctgggcacggtagtgggtgcctgtcatcccagctactcaggaggctgaggcaggagaatcacttgaacccgggagatagaggttgcagtgagccgagtctgtgccactgcactccaacctggggtgatagagtgagactccatctcaaaaaaaaaaaaaaaaaacaaccaaaaacacccaaaaacacattagatgcatttgaagcctcccagcaattctcccatgatggcagaataggcatccaggagactcaccctaccctgtctgaacacctttagcgaagatgtaaatgatctgcagaggatactcaggtgcgaggatggaaattccttctccctccagcactgatggcttccaccttcctgtggtctaaggagaccacacagaggttgtcagtgtgggaggctgttgccagtatggtgagtttcctacggaggaatttcctgtgggacacctctgggcagttcttcccgcctttcatgtcttctgtcagatgatagagtggccaggtcaagggattatcatgattttatttgttttttgttttttagagacaaggtgttgctctgtcgcccaggctggagtgcagtaggggtgcaatcaatagctcagctgcagcctcaaactacagggctcaagtgatcctcctgcctcagtctcccaggtagctgggactacagggacacaccacaatgcccagctcattctctcataagatggagagaagagaagagaggaggacataaaactgtccatatgactagtttgggcctttccatcctgcttaatccagaactgtcaaggttagaccctggtcattctttaatatgtttgaaaaatacggctgggctttggctcacacgtgtaatcccagcactttggaaggccagggtgagaggatcacttgagtccagacgtttgagaccagcctgggcaacataagaagaccccactgctacaaagggggaaaacaagtcagccacgcatggggacgcatgcctgtggtcccagctattcggggggctgagacgggaggattgcttgagctcgggaggtagaggcttcagtgagctgcgattgtgctactgcactctagcttgtgtgacagagtgagaccctgcctcaattaaaaaaaaaaaaaagaaaaatagaccttccttctatacaatgtcttccctgctggcctccatgccctcgtacctgtttaaaaatccactggaatttttcaccaggacatagaaaaaggaagttgtctcacgcagttcctgttaaattgcacaagtccacacagatccttgcaacccacgctaccatttacttagcatgcgttgtgtgtgggcattacattattctccgaggtagttattttggatgttatactggggaggtaccccatcaaagagatttggagggcaacctgtggagggttcttttaaaattgttgacaactaatttggtggatgttttcaccttggtgaatcgttcccttgggagtcattttgcagaacaaaggggttgcacacaggtgtggccagagaaaccttggcacagaagaaagaagtgctttgtcatgcttagggcacctgggatctctttggatgggcaggcagagggggaccctgtgaagcctgcctgcgtttatttgggtatgcatgcttatgttggagtcttggcaatgagaggacaagagtggagggaacagagctgttaacagaaaggggtccatatccagacaccaagagagggttcttggatctcgcgcaagaaaaaattcagggcaaatccatagagtaaagtgaaagcaagtttactgagaaagtagaggaataaaagaatggctcctccataggcagagcggcctcgagggctgctggttgcccatttttatggctatttcttgattatatggtaaatgaaaggtgaattattcatgcctcccctttttagaccaaatagggtaacttcctgatgttgccgtggcatttgtaaactgtcatggcgctggtgggagtatagctgtgaggacaaccagaggtcactcttgtcggcgtcttggtttgggtgggatttggccagcttctttaccgcaacctgttttatcagcaagctctttatgaccggcatcttgtgctgaactcctatctcatcccgtgacttagaatgccttaaccatctgggcacacagcccagcaggcttcagcctcatgttaaccaacacctcttcaagatggagttgctctggttcagatgccactgacagagctagcttatagttgggacaatgtcatagggaattattcttaaaagattgcaaaatccagcttggatgagattccagaaatcaaaagggtgttgagaaagcaacttgtctagaatttcctcttcatgggctgttgattctgttcgcaatcacaccttaagaaaaaaataggccaggcacggtggcttgtgcctgtaatcccagcactttgggaggctgaggcaggagttagagactagcctggccaacatggtgaaacccgtctctactaagaaaatacaaaaatcagccaggcatggtggtgcgtgcctgtaatcccagctacttgggaggctgaggtgagagaattgcttcaatctgggaggcagaggttgcagtgagctgagattgtgccactgcactccagtctgggtggacagagcaacactccttcttaacaacaacaacaacaacaacaacaacaacaaaataataaaaatagaagagaaaataagtgacacatagtggctcatgcctataatcccagggctttgggaggtcaaagaaggagaatcatttgaggctagtggttctagagtagcctatacaacatagtgagaccttgtctttacaaaaatagaaaaaagttagccatgtgtatggtgggtctcatacctatagtcctagcaattcaggaggctgaggcaggaggaccacttaaacctaggagttggaggctacagtgagctatgatggcgccactgcactccagccttagcaaaagagcacgattctgaaacgaaagaaaaaaagaaacggacataaaatataaaaagaaagaaaacagaaaaaaaaatatatttatatagaaagaaatctgtaatgatgcaaaacattccgtggacacgaatagaatagttgttatgcgtgattttgtttattaaagctttttttagttcatccgtaaagtttagtgttttcttttgagaacaaattctgtcttgtcaacttcattgattttcaggctgggcgtggtctctcgacacttgtaattccagcactttgggaggtcgaggtgggaggagggcttgagaccaggggttcgagactagccttggcaacatggtgaaaccctatctttacaaaaaaaaaataaacaaataacaattagccgggcatggtggcacatggctgcagtcccagcaacctgggaggctgctgtgggaggatcacttgagtctgggaggttgaggctgaagtgagctatgattgcgccattgcactccagccttggtgacagagtgaaaccatgaaagaaaagaaagaaaagcaaaaaagaaaagagaaaggaaggagaaaaagaaaaaagaagaaaaaagtaaaagaaaataatatatagaaaaagtcagtaatgtctcaaaatattccctacacagttgaatagaaattgttgttggatgtgattttatctgttaaggcttttgtttagttcattgttaaacagttcagtattttattttgagcacagattccggtttatcagttgcactaatctttgcaaagaaactactttgggtttctttaatgtttctgtgttgacttcctgttttcagtttcattgcagtttgctctggtttttcttttgtttttctccactcattttaggtttctggaattttcctgaagcattgcatgctgatacagattctgagctggtgctttgactgtcacaagccagagggtcctagaagaagtagaatcataactgaggaaaacttaggaaaccccatccgttctgcctttcaaaggtcttcagggcagcgccacgtttcaccacctgattttggtgtttcacagtctgatgtgttcatagcttttgactattaaactgattgagctctgcgttttttaaatttctgttaccctgctggtgctgtttgagctccagcttcctcctctgtgtaatcagtatccctagttgcctctttacccaaaaagccacagaaataagtgcagagaaaacaggttagctgccacctgcgacagaagcgtgtccttaaatgtgtccctggtctcctggccacatcactccagtctctgcctctgtctccaaatggggccttctcttctgtgtctctgtctcgtcttctgtgtctttattttatttatttatttgagatggcgtttcaatcttttgcccaggctggagtacagcggtgtcatctcgactcactgcaccatccacctcctgggttcaagtgattctcctgcttcatcctcctgagtagctgggattataggcacctgccaccacccctggcttattttttccatttttagtagagacaggatttcaccatgttgcccaggctggtctcaaactcctgtcctccaggtgatccacatggctcgacctcgcaaagtgctgggattacaggcataagccactgtgcctggccattttttattcattctcttttgtctcttagaaggacactcgttgttggatttgggtcccaccctaaatccaggatggcctcatctggagattgtttacttaatagaaactacaatgaccctattttcgaataaggctctattcacaggtaccaggggttaggatgtggacatatttttggggggcaccattcaacctaatccacccctcaacctcagtacgtccactgcgttcaacatgaactgtgtctccttctttccccaaacagaacaacttaagagatcctgtgcacctgtacaccttgcgtaggtcatcagcactcactgcttatatgcctaagttctaagctgtgatcatctccaccctccctcttgcagcccagttgagcccattctctgcccaagcaccttataaacaggccattaaccctccatctccatatgtttcacgcccttatttcatacattatagtatttaatgttcttttactgatttttcgcagggtggaaaatgtcaaggaaaggaactgagtttgacagttttaaattcatacattctgctgtcaacattactttgaaacaattatttaatgcagtgcatcggtttcatttaacataaacctatgtagatgaaatattttgatagtcacattttaaaaggtgagaaagttatatagtgaaatgcatctctgtttttgtgcctcacctgtgcagaatttgccctctcctcccacccaggtgaccatattaatgtgtcttgtatatttctccaaagccctttctacatatggaagcaagtatcacttatggagaagggcctcacttttttttttttttaaacaggtggggttccctgttgtccaggctggagtgcagtggtactatcataactcactgcagcctccaactcccgggctcaagcagttctcccatctctgcctcatgagtagctgggactacagatgcataccaccacaccctgctcatttaaaaattttttttgtgcagatgatgtctggctatgttgcccaacctagtcttgacctcctgggctcaagtgattcttctgccttagccttctaaagtgctgggattacaggcatgagccactgctcccagtctccacccatctgtaggtgtggtacaagagcatgttccctcccaagctaatgtggcatgtactggcctcccaggctgtagacaagatggatgggggctgtgcccacttcttgagttacctttttttttttttttggaggcagagtctcactgtgttgcccaggctggaatgcagtggtgcaatcttggcctattgcagtctccatctcctagctttaagcaattctcccacctcagcctcctcagtagctgggattacaggtgcctggcaccatgtgcagctaattgttgtatttttcatagagacggggttacaccatgttggctgggctggtctcaaactcctggcctcaaatgatcctcccgcctcggcctcccaaagtgctgagactgcaggtgtgagccagggcacccagctgggttgtaacttttttttttttttttgagacggaattttgcttttgttgcccaggctgaagtgcagtagtgtgatcttggctcactgcaacctgtgcctcccgggttcaagcgattctcctgccttggcctcctgagtagctgggattacaggcatgcaccaccatacccgactaattttgtatttttagtagaaatggggtttctccatgttggtcaggcttgtttctaactcccgacctcaggtgatccacccctcttggcctcccaaagtgttgggattgcaagcgtgagtcagtgcacctggccggttttacattttttgaagtgcattttccacatggccacctctcttggagtgcctgtgaggaacacaatgctgtccttcttgatgtctctgcagggccactgcgacgctgtcttcttgcaaagatttctgtccatgatgtctcaacattgaatgtttgggtttttttctcttgcattttagggagaattggggctcatccatcctcaccttctctctcccattgaattggtgcatcctgttttgttagcacctggaatgcccatgttcaaggttctttaagcacctcagtttaaggaaagaaatgcagaattttgtttttgttttttttttttttgagacggagtcttggtctgttgcccaggctggagagtacgcagtggcgcagtcttggctcactgcaagctctgcctcccgggttcatgcctttcttctgcctcagcctcctgagtagctgggactacaggcacccgccaccacatctggctatttttttggatttttagtagagacggggttttgccattttagccaggatgatctcgatctcctgacctcgtgattcccctgcctcagcctcccaaagtgctgggattacaggtgtgagccactgtgcccggctgaggcttaggaattcttatagttgactgacatttacaatttattaaggaacttactttttaagtgtataatcctcaaaacatctttaaaaaaatggtgatttttttgttatccaagttactttgacatcagccatttgctgacccaccacataatttctcattatgttaccttattactggctgagttaatatgcttactagggacctgtatatgacttttccaattaaaagtaagttaagtctgggcgcaatcgctcacgcctgtaatctcagcactttgggaggctgaggtgggaggatcacttgagcccaggaatttgagaccatcctgggcaacaaagagatctcaaaaacaaaattagccaaacatggtgttgcatgcctgtagcatcagctgcttgggaggctgaggcgggctgatgggttgagcccagcagtttatgctgcagtaagctgagattgcatcactgtgctctagcctgtgggacagagtaagacctgtctctaaaaaaattaattaattaattaattaaaaataaataaataaaagtaagtccaaatggagatggttggtggtgttggtgggaatggatgacattatgaatgtatttaacaccactaatctgtacacttaaaaattgttaagatggtaaattttatgttgtgcatagcttaccataattaacaaataatagatttaaaacaaacaaagtaagtatattcagtgccaggtgtagtggctcacacttgcaatcttagcactttggggcattgaggtgggaggattgcctaaagccaggagttcaagaccagcctgggcaacagagtgagaccccatcttaaaaaaaaaacaaaaaccaaaagaagaaaacattcactttctttctggatcataagtagagacccagacctgcctatgtgtcttcaatggacatcttaagacttatgttttggacatatcagacttttggaataaaggagctgagttgggagtgcaaactcctcttcttgtccattgctctgtggcaggagattttgctctcagcccccacttactggtgtgagatccttgattctggaaggtgagctgtgctgttcagcccacaggtcctcatgaatgtctatattcagtgccacgcagaataagaagaaacacacaccagctctgtttctatgaagcttactttttgttgttgttgttgagagggggtcttgctctgtctcccaggctggagtgcagtggtgcagtcatggcacttattgcagcctctacctcctgggctcaagagatcctccctgctcagcctcctgcgtaactgggaccacagatgtgcaccaccatgcccagctaatttttaaattttttgtagagacagggtttcgccatgttgcctgggctggtcttgaatgcctgggctccagtgatccacctgccttggcctcccaaagtgctaggattacagacatgtgccaccgagcctggttttgcttactttttctttttttttttaagttcctcttagcctatcttggggaggtgggtcagtgttattcagatgtacatacaacacaatcacccacactgggagaagtccttgctaaatggatagggctgggtaaccactgccacatgggacatttgggaagccgatgtttgaatgttttcacgcttacagatgcattcatttactacgtttattattctgtgtgatatgctttctgtgtgttatttcacttaaacccagtgggggtaaatattgtgatccctatttggtagatgaattttagagaggttagagggcttgtcacagtcacacagcttttaatcttgatgggatgacacctctagaatgaggcttaatagtgagatggctgcggaaggaaaaaagtaggaaggagagcaagagagaaggaaggaaggaagaaagtagggagaaaggaaggaaaggagagggaaggaagggaaaaagtaggaaggaaagaaaaggaaggaaagaagcagacaggaaggatggaaagaaggaatgagaggaaagtaggaaggaaaccgatgaaaggagggaagggcgaaggaacaggtcccctgttcaggtgagtttattcccaggaaggacccaagatgaaaagtgtgtaagaattgttttaggacaggcattgtggctcatgcctgtcatcccagcactttgagaggctgaggcacgaggattgcttgaggccaggggttgaagactgccctgggcaacacagcaagaccctgtcgctataaaaaataaataaaattagctgagtgtggtggcttgtacctgtagtcccagctactcaggagactgacacaagaggtttagggaaaatgaaaaacagaacaaaaaacaggccgggcatggtggctcgtgcctgtaatcccagcattttgggaggccaaggagggtggatcaggaggccaggagttcaagaccagcgtggccaagatggtgaaaccccgtctctactaaaaatacaaaaaaattacccagatgcggtggtgggcacctgtaatcccagctacttgggagggtaagggagaaaattgcttcagctggggaggcagaaattgcagtgagccaagatggtgccactgcactccagcctgggtgacagagtgaaactcttgtctcaaaaaaaaaaaaaaaaaaaaaaaattagctggctgtggtggtgcatgcttgtaatcctagctacttgggagtctgaggccagaggattgcttgaacccaggaagtggcggttgcagtgagctgtgattgtgccactatactccagtctgagccaaagagaggactccatctcacataataaaaataaaaataaataaataaaaacagaaacgagaacacagacacacacagaggatggcctggtgaggacacaggaagatggcatctccaagccatgagagaggtctcagggggaaccagccctgcccacaccttgatgtctgacttccatcctccaggcctgtgggagaagaaagttctctttaagtcccctcgtctgtgtggtgttattatggtagtctgagcaaaatactttatttagatagaagtctgccagaattagggccctgtaatgctttccaggatgaattgaggtcagagcatagttcgtaggttcttttttacatttactattagccactagatttttttttcagtagactagcaaatactgcagaagctgaattagacgacagcttaagtcagatctttatgcacctcagaatatttgtactgattaaaagaaataaccaacacttgatagggggaaagattgagacacagaaagtagtctctccctgtgaccaatcctaacaaattcttgcttaactaccttattttttttggatgaaaatgtgtttcttacatcagcagagattatgaagggatttacatacagatgactaaaatatcagccattagtctcctgtttgttttttgttgttgttgtttttggtgggttttttttttttttttttttctggagacagggtcttgctctgttgcccaggctggagtgcagtggtgtgatcttagctcactgcagcctcgacctcccaggctcaggcaatcctcccatctcagcctcccaagtagttgggacgacggctgtgcaccaccacacctgggtaattttttgtttttatttttgtagctgggatctcgctatgttgcccaggcaagtcttgaactcccggcctcaagtgatcccaccatcttggcctcccaaagtgctggacttataagcgtgagccaccctgcccagcctagtttacaatttgaacttggtttttcatctcggctcctttgaagacttctgtcttctcccatgtttggggcagctgtgtgttgtggacattccttagtgatcggcctgggaaggctcagacatgtctaggctgcctttgtaggaatagggattagtagctccttagccccactctttcctgggatgttgctgtttgctgaggtctgcacagttcagaccaccctggaagcctctctcaggttctcagagatggtggagttatacctttgaccgtgagctcgcagcattgctagggaatgtacttggctaaatttggaactatttggttgaatttgtaccccttgggcatatttgctttggtaacataccacagactgggtgccttaaaataacagaagttaattgtttcacagtcctggagaccacaactctgaagtgcagatgcagcagggctgtgctccctctgcgggctctaggggaggctccttcctgcctctcccagctcctgggggctccaggcgtccctgagcttgtggccgcatcactgcggtctctgcctccgtctccacgtggccttctcctctgtgcctgtgtcttctcttcttctcttacaggaacacccgtcattgtgtttagggtccactccaattttggatgacctcaccttgagatctttaacttaattacatctgcaaagacccttttcccaaatgaggtctcatttacaggttctgtgggtcaggacatggacatatctttctgggagaccatagttcagtccactacagttgtatccagttgtttctggaggctccaggggaagctccttcctgcctctcccagctcctgggggctccaagtgtccctgggcttgtggccgcatcactctactctctgtgtctttctccaggtggccttctcctctgtgtctgtgtctccttattagtttcaccactcatattggactgcctccaggatgaccttaccatatatatatatatatatatatatatatatatatatatattttttttttttaaatttcatttttttaaaaagtggagacggggtcttgctgtctttcccagactggtctcgaatgcctgtgctgggattacaggggtgagccactgtgcccagcctttgtgtatatcttaatcacatctgcaaagaccctgtttgcaactaaggtcccattcacaggtaccaaggattaggatgtcaacgtatcttttccagggcaccccattcaacgcacacaaagtagggagaggggagattggctgtgtttaggtgacctgtgaaaggccgagctagctgtgcggtgttgctcttgcagcacagaggaagaactgggctcagatggtgtcagctgttggtgtctgagatcatccgtgaatctactcccgggaatgtgctgcagtgagacacggtccttctcccgtcaccttcctcaccccatcccatatacccatggaccccaagggaaagtactcagggttggttggtttcttttccgttttgtgaccgcgtgaaattccatgtcacggtccctgtgtttattccatacagatctcctaaagtgttttgagttctagcaaaatttaaaaatataaccaaagaaacttaaatccttgtttctcctctttctggacacttctttagtatgaatggcctgctgtcttccctctgtttctgctggccgccacgttccttccctccaaagtcacaggcaagagggatttagggtttgctgggcttgaggaagagaggaaaagcccatctcttttcacagtgagaaacatgttttttgcgctttctcataccccactttgtacattttaaaatttaatttttctttagatttctgaaccgagagattttatttatgtatttatttatttatttatttatgagacaaaatctccttctgttgcccaggctgcagtgcaatggtgcagtctcagctctgccacctccgcctgccaggttcaagagattctcatgcctcagactctggagtagctgggattacaggtacctgccaccacgcctggctaattatttttgtatttttactacagacgcggtctcactaaaattaaaagaaaagacataaactgcacatcagatttccctcgtgcgtaacactactacttagcttggagagagatggaggggatctctagggtggggaatggaccacttaccttcaagatctctctttatcaggaaggaaatatctgacctgcctagaaacacttgaaaatactctttttttatgtcttattgggcaaagctgggtcagatggccacccttagctgcagagaaggctacaaataggcattttctactcaagtgggataatggttatctggcaaatgtgtactggagagcctcaggaaaatctaccagcaccattaaatgttgcctttgtcttctgtgcacttaagctgataaactttaaacattacagcatgccacttctgtctgctttgaataaggttgtttaccgacatacttctgcaatctgattgtggcattggtgggactggccacatctaccccagggtagcacaaagatctgctgcagtgcataaataacgtgttttgagttttgtgtgtttataactcacacagctcagagaaggctttagtcacagaagtgtaaaaaatctgtggagtcatagctgttgttcttaaagtaggcatggagaattatctccattgagggtcaaatacaagtgctaagaagacagaatgttatgcggtaaacacagccaagtaataaatggttttcttggagtgggtgatagagaaagataaataaggaggaaggaagcagacagaggaagaaaagtcaaggaccatatttattgcattattagaattttagggtgtggcaagaatttaatgtttcctaataatatgcaagttctgttggaaagaagagcaacaggagactaaaaggctgctctgttgcccatttcataggtccaatggcaggataagcttgggttggatgccagtgttcctgattcctaattgtgttttatccggttgaaacatcagtggctgtagttaaaaacacctaaattttattaattcacagtcctgaaagcccttcttccacttcctgtctttgacctgattacacctaattttgtccacaggatgttacactgttagtaataaaacctattttatttccaaattaaccaagagaatatactttaaaaatttactattttcattatttgtttactttttttaaaaaattgaacacttgtcagctattgacattgtttacttcttacactttctctttattttggagtttactttctatttctgccataataaaatattcgttattggaaactttacttaaaaagcaaaggttgcttctccgcctttcccagttgccctataagctagtaaattcatcattcattagcttatatattttacaacacggggattttagtttacagcaaatactttaaaaaattcttttcatgttacaatgtgcaatcaatggcattccagactcttggaaggaaatccattgtatggttgtgttcttttttttcttctcaaaccaataaaaaattcccagtcacaattttaaaaattatctgtccttggtggtgcacagcccatagtcccaaatgcttgggctgacgtgggaggattgcttgagcctggtaggtcaaggctgcagtgagctatgattgcaccactgcactccagcctgggcaacagagagagaccctgtctcaaaaaaatagacgaaacaacataacgtgatccaccctctaagcaaattttcatgtatacaatttcactattgtatatgtgagatttttatatatgaaatttcacatgtcaattcagtattgttaactgtaggaactgggtgtatggtcaatctccgtggtttatgtatgttgctcatcctttaatcaatatatttccccttccctatcaaggcctatcttctgataactgtctctctactctctacttctatgagtttgactattttagattctgcgttagtccattctcatgctgctaataaagacatacctgagactggttaatttataaaggaaagaggtttaatggactcacagttccacatggctgcagaggttctgacagtcatggcagaaggtaaaaggaggagcaaagtcacgtcttacatggcagcaggcaagaagagagcgtgagcagggaaactcccatttattaaaacatctgatctcgtgagacttattcactatcaggaggacaacatgggaaaacccacccccatgattcagttacctcccacctggtctctcccacaacacgtggggattatgggagccacactttaagattagacttgggtggggacacagccaagccatgtcagattccttgtataagtgagatcatgcaatatttaatatttgtttttctgtgcctatcttatttcactgaacataatggcctccagttccatccatgttgctgcaaatgccagagtttccttctttttttagggctgaatggtattccatcgtatatatgtaccatgttttctttatccatttgcccttggacggacactgaggttgtttccacgtcttggctgttgtgattagtgctgccataaacatgggagtgcaggtgtctggaagatcctagttctcttgggttttgcaatctagcataaagcaggcacaggagtatcagccaatgaatggataggtaaatggatcaatattgattagtgagtttgctcgtcaacagatgttggttcctcagaaggataaacttccaaaccatcctttctctgaaagtcagtttctgagaagcctcctctgctgtttggggtgggtgtgatcacataatacgggagggcagttttgttttagttactcatctctgtctgcagctgtgaatgggttgtctaaaaatattgctgagaattgacttgcatgtcagtaaggggctgctgactctgggatcaaggtagatcaaagacaatttagggatactctagaaatcctgcatcagttgcagtggctcatgcctgtagtcccagcactttgggaggctgaagcaggaggatcgcttgagcctaggagttcaagcctagcctgagcaatgtagtataacctcttctctacaaaaagtacaaaaattaaccaggtaggctgaggcgggaagattgcttgagcccaggaggcagaggctgcagtgagctgtgatggtgtcactgtactccagcttgggcgacagagtaaagtcattcattccagtaactgaagaacatttatgctacgtgaagaatatttcaatatgcatgtgaacacatgcataccttataggatcaatgtgttacaggaagaggaggaggatgaagagaagaagaggaggagaaagaaggagaaacaagcaaagcgtgtttacattgaaaaagtgctcccaagatactatagagattttgattttcttttatatctcattgactgttagatttcttcatttagatgcaccccagtgggaggaagaggagggagaagaggaggagatggaggaggaggaagtggaaaataaaaggaaatagaggaggaggaggaggtgaaagagaaggaggagaagattgaggaagagaaaaaagagaaggcagagatggaggaggaggggaaggaagagaagaaagtgtttggattgaaaatgtcccagcagaatacagtagagctgttggttttcttttgtatttgtagtggttgcagttgtctttctttctgtttgtgggtacctatagcacttcatcgcaatccacggcagattgtagaatatggactccatgctttgagcaagttagtgtgtcttaagaagagagcagtgttgaggaggtctgcctgttttataccctgtctggattactgataaaaccagagagcctgaagagaaaaagacatgttacataaatacatttactgttactctaatgcttctatatctgggcctgtggggcatatgtgggtgtgctctctgcaaagactgatctgcagaaattatggccagtttgtccccaaattgaagaagcagatggctctctctgtctccttctctctcgctctttctctctctgcaatttctgtattcagtggaaaattccaggtgatcgcctctcactaaatgccatcagcccacgtgcaccatgacacaaagtctctgaaagtttcacttggggtctgtgtttgctgtcctggtgcagccccccactgattgcatggctgcggtggtttttccctttgtcaggagacttaatgacctctgtcgatttcttctctctccaggcactgggacgttcgggcgggtgcacctggtgaaggagaagacagccaagcatttcttcgccctcaaggtgatgagcattcccgacgtcatccgccggaagcaggagcagcacgtgcacaatgagaagtctgtcctgaaggaagtcagccacccgttcctcatcaggctgtgagtcccctcctgaggcctctcccgacgcactctccctagacccctgtgtgtctcttcttataagaagctgggtgggccgagaccatggcctgcgtgcaaagccttaggccacagcagtctccacctgtcaggtcttatcagcctctgatcttagagctggaatnnnnnnnnnnnnnnnnnnnnggaaagtccaagatcaagacacggtggattcagtatctggcgaggacccgcttcctggttcatagatggcaccttttcactgtgtcctcacatggtggaaggggtgagggatctctctggggtcccttttataagggcactcgtcccattcatgagactccaccctcatgacctcccaaaggacacaccacctaacaccatcacctgtgggtgaggatccaacatagggatttgggaggacacaagaaattcaggccattccagcagggtaattccatttccacccaggtgccttagatgaggatgtccttcgtgtctctcttttccctctatgggtgccttttatccaattcccatgtcctctcgccaccatcttgctactacgcctctcttgtccacctcccatcttctgctttatctaggtcccatctctctaccgtgattttctgcactgtacttcctcctatctggtctttccctcccacccttgctccccttgaagacatccttcaccttatagcctcattgatcctccccaagtacctctgcaatgaccagtctctctccagtcatcctcaggaagctcctgaagtatcccatataaagccccaggatgcagcatcttcctatcaatatcctcacagactggcttcctgccagcacctccctgtagtagaaggtagaaggtgctgtttacacgctcactacgggtcttctcctaggccactcctccttgacaggcctccttctttgcctttatcattgtccttcacttcccccacctgagaaacacacacttgttttccctcattcacctgtagtccccaggacacaggatgcctcccatcatgttcttgaagcacctcgtatgtattggaacaagtgcacctgccttttctagacccaacatggcctgagttctgaacaaaatcatatgcagaggatgggcgcagtggctcatacccgtaatcccagcactttgggaggccaaggcaggtggatcacgtgaggtcaggagttagagaccagcctggccaacatggcaaaaccctgtctgtactaaaaatacaaaaattagctgggcatggtggcatgtgcaggagagcagcgtagaggatgggcttacgggtattttaaaatctaaaatcccgcagaagaatcgcatagacatgggagtgggtggagtgtgcaagtgagagaattccttaggatagaattcttgagctcccacaagttaaaaaataaagaggagcttgcaaaacagagctttagttagataattctcctttcttcaagccaggatagttcaacagctgttttccttagcagataaggtggattcctgcagggacatggattctgattttgatgttcctgctttcttctttttcgttggagtctcgctctgtcaccctggctggactgcagtggcgctatttcggttcactgcaactgctgcctcctgagttcaaatgattctcctacctcagcatcccaagtagagtagctgggactccaggtgcatgtcaccatgcctagctaatttttgtattttttgtagagacggggttttgctgtgttggccaggcagatcttgaacttgtgacttcaaattatccacccacctcggcctcgcagtgtgctaggattacaggcgtaagccactgtgccaagcctgcctactttcaattaaggaacaaagtcttctatatttctttttttgttcttttttcttcttttttttaattatacttttaagttttagggtacatgtgcacaatgtgcaggttagttaaatatgtatacatgtgccatgttgctgtgctgcacccattaacttgtcatctagcattaggtatatctcctaatgctatccctcccccctccccccagcccacaacagtccccagagtgtgatgttccccttcctgtgtccgtgtgttctcattggtcaattcccacctgtgagtgagaacatgcggtgtttggtttttttgtccttgagatagtttgctgagaatgatggtttccagcttcatccatgtccctacaaaggacatgaactcatcattttttatggctgcatggtattccatggtgtatatgtgccacattttctttatccagtctagcattgttggacatttgggttggttccaagtctttgctattgtgaatagtgccgcagtaaacatacgtgtgcatgtgtctttatagcagcatgatttataatcctttgggtatatacccagtaatgggatggctgggtcaaatggtatttctagttcaagatccctgaggaatcgccacactgacctccataatggttgaactagtttatagtcccaccaacagtgtaaaagtgttcctatttctccacatcctctccagcacctgttgtttcctgacttttcagtgatcaccactctaactggcgtgagatgatatctcattgtggttttgatttgcatttctctgatggccagtgatgatgagcattttttcatgtgtcttttggctgcataaatgtcttcttttgagaagtgtctgttcatatcctttgcccactttttgatggggctgtttgtttttttcttgtaaatttgtttgagttcattatagattctggatattagccctttgtcagatgggtaggttgcaaaaattttctcccattttgtaggttgcctgttcactctgatgatagtttcttttgctgtgcagaagctttttagtttaattagatcccatttgtcaattttgtcttttgttgccattgcttttggtgttttagacatgaagtccttgcccatgcctatgtcctgaatggtattgcctaggttttcttctagggttttatggttttaggtctaacatttaagtctttaatccatcttgaattaatttttgtataaggtgtaaggaagggatccaatttcagctttctacatatggctagccagttttgccagcaccatttactaaatagggaatcgtttccccacttcttgtttttgtcaggtttgtcaaagatcagatcgttgtagatatgcggcattatttctgagggctctgttctgttctattggtctgtatctctattttagtatcagtaaggtcttttatatttcttaaatctcatataaagccctagagactttagatattctatccaaagttatttaagttggtttatttttatctttttatataaaaaagtatatatatatttcttaatttagagacagggtcttgctgtgtggctcaggctggagttcattggagcaatcaatgctcactgcagctccaatctcccaggctcaagctgtcctcgtgtctcagcctccagagtagctgggactactggcatgcaccactacaccctgctaatgtttttagttatttttaattaaaaaaaaaagtatatatttttcacaacttctttggtgaaggtaatgtttttggttttttctataaacagagtcttgctatactgccgaggctgggctttaactttaggcctcaagccatccacttgccttggccttccagtgtactgagattacaggtatgtaccaccatacctgcctcattttaaagtcttttataaaaatgaggtctcactttgctgccaggccagtttcaaactcctgggctcaaatgatcttcccaccttggctttccagcatgctgagattacagatgcgagccactgtgcctggcctatttttgtttcttaaggagtgaaatttctgtgcaccatgatagctttctgagtggaaagtttggatgcttcatgggttgtcctttgcctgtacagctcaccggctcctccgagtgctggttacagtcgaatgtgagctgtatgtcaggtctgcgtggtggtgttgccaaaaagcatgaatttttcctcatcatttaaagtctacacggaatttaaggccactttcgatattattcttgggaggattttattcagtgttttgggaaaacatggcaggagctcatttcagaattatatgatttggggatgagctcagtggctcacacctgtaatacctgcgtttttggaggccaagacgggaggatcgcttgagaccaggaattctggaccagcctgggcaacatagtggaatgtcatctcttaacaaaaatatgaaaagaaattttagcctggccaacatggcgaaaccctgtctctgctaaaaatagaaaaattcactgggcgtggtggtgcaggttggtaatctcaactacttgggagactcgggcgctagaatctcttaagtttgggaggcagacattgcagtgagccgagattgcaccactgcattccagcctgggtgacagagcaagacttcatctcaaaaaaaaaaaaaccagagaaaaataaataaaattattcaattttgaaatagtgcagaaaacaaggcaggctctgaaatctgcagctcttgtgaaatgttttggatctagagaaatgattgtcaacaatgagcctttaaagacttaagggtgataacaatttacaggtgacttttaacagtgatagcaatttacaggtgactttttccaaaatttacagaaaacaagtttgccacttggacacattgactcatacctataatgtcagcattttaggaagccaaggtaggaggattccttgtgcccaggagtttgagaccaccctgggcaacatggcaagaccctgtctctacaaaaagtacaaaaattagctgggtgtggtggtgggtgcctatagtctcagctacttgggaggctgaagtgtgaggatcgcttgagcctgggaggtggaggttgcagtgagctgtgattgtgccactgtactgcagcctgggcaacagagtgagaccttttctcaaaaaaagaatccaaaagccaatatgcagttggagagggtgagtaacttagcccatgagaccttgtagtgacttgctgagaattgatttttcagtaccctgcagtgttacgataacccactatagcattttgtgttttctgtgcatgaatgcttgagagaccatgtggctttaagaagtggattaaagttgatccagggcatccaggcacttgatgttccctatatataacacaggagagaatgcttgatctggctagctccgtggataaaacgctgaagggtgtccagtgtatccccatggataagatgctggagggtgtccaatgttgcatgctgaggagtatgtcttagaggagaatcctagatcctctgtgaggaattaatttcatcctcccagttgtgcagcttctcttctaaatgtaggttgcctggctcaacatctgcttccctactggcagttttaggtcttggatttcttgatgaaagtacaaaacaaggactttcaaaggaagtgtcttacagttacggctggatgagtttctgtggtggggacgccctgcacactgtagggtgttggggagtgtccctgggctctgctcagcctatgccaggggcagcaaccccagttatgaaaactagaaatgtctccagacatcaccaagtattccttggggggaggaagggcaaagttatctccactagtgaaccactgcgatagacagataatcgacagagagatgatacgtaggtatatgttgagatggataggtgataaataatagatattaagatagacaggtctaagtgatgggtgattgataggtgaatagatgatgggtagctaacattaagatagatattaagataggtgatagataatagatattaatacagacagatagctatagatgatagatattgagatacatattgagatggatttgtgattgatagattgcaaatagacagagctctcacgttatgggaaaacattgagcttgtttttcttgcgtttctggaagccgcatggagtgctactcatgacaggaatcaagttgaacagtgactgtttggagttcaaagtgccatttgaacaacatggtaggtttgcaaatggcattatcagcatgtggtatttgaacagctacaggttgtaagtttgaaaagacaccagggaatttatgtagtgtacatgaaagaccacattctgttcagtgataattccatttctcaaggccatctcagactcttacaagagccaaataactaagtgttcaaggtgcagaagaaatccagcaaagtcactttcccagagggaaagttttgtgctcctcccagagaccatgaccatgatgcatacaggaatttctgacatttggatccagaacagggtttctcaacctgagcactgctgacatctgggcgtgggtgattctctgtggtggggcatcctgtgtgcactgtagggtgttgagcaatgtgcctgggctctacccaccagatggcagcaggactcttccccagtggtgacaaccagaaagatcgagacaaccaaaaagttctctagatgttgtctgatatcacgtgggagactggagggtgtgggggtaaaattgtgtgtagttacaaaccagtgcaacagagagatgaaaggtggatggatggatggatggatgatagataattattattcatagatacatggttgataaatggatagatgatatagatagatgatagattgataaatggataaatgatataaacagatggatgaatggatggatagctaaatattcataaatagatatatggtaggttgatagatgaatagatgataaggacagatgatagattaatagatagatgatatagacagatggatagataggtgttcataaatacatacatgactgatagttggatagtttgtatagatagatggtaaattgataggtagatgatgcagacagatgaatggatgaatggatggatggacaggccctagaacccaatgacttggctttgccactcactagttgttgcaggctttctctgaacaaggatgagataccacagtcactggtcactgtttgctacgtggtagtttttttttttttttttttttttttgagacagagtctcactctgtcgcccaggctggagtgcggtgatgcaatcttggcttgttgcaaccgctgtctccagggttcaagtaattctcttgcctcagcctccagagtagctgggattattggtgctcaccacagtgcacagctaattttgtatttttagtagagaccaggtttcaccatgttggccaggctggtttcgaactcctgactcaagtgattcatctgtctgtgcctcccacagtgctgggattacagacatgaaccaccccacccggccctcacgtagtagtttcttgaattgctcatttttgcccgttacagttactttttttttttcttttaagatggagtctcgctctgtcgcccaggctggagtgcagaggtgcgacctcggctcactgcaagctccgcctcctgggttcacgccattctcctgccttagcctcccaagtagctgggagtacaggcactcgccaccacgcttggctagttttttgtatttttagtagagacggggtttcaccgtgttagtccggatggtcttgatctcctgatcttgtgatccacgtgccttggcccctcaaagtgctgggattacaggcgtgagccactgcacctggcctacagatacattttgctacctgccatgagggagaatctgtattcagtttagaatcatcgtcatcctggggagagaatgtgccttagcatggctgaggccaggctgctggtcccttcagatggtgcttcccgctgtgctgtcgttctaggtggccccgttgcaatgctgacttgacttgcaccaaggcagtacagaatggatgggatttgctaaaggtgcccacctgcctccaccttttgctggcagttccaggtgttggactttttattgatgaaggtgtaaagcaaggattttcagtggaggtacctcacatttacagctggatgagtctctatggtggggccatcctgcacactgtagggtgttgaacagcatccttgggctccccccagcaggggccaggagcagcaaccccagttctgaaaaccggaaatgtttccagatgtcaccaatgttccttccaggagggagggcaaagttatctccactagtgaacctctattatacatgaccaacagagagatgatagatggatactatagtaggtatatgttgagatggataggtggtagataatatatattaatataggactaaatgataggtgacggataggtgaatagatgatgggtagctgatagatgatagctattaagataggtgatagacaatagatactaatatagatagctatagatgatagatattgagatgggtaggtgattgatagattgatgaccgattgcatatagacagagctctcatgctaaaagagaatttctcaaccacagcagtgctgacacatggggcgggatcatggaggactctctgtggtggaagctctatgtactgtagggtgttgagcaccatccctgggcttcagatgccaggagcatccatcccatctgtgacaaccaaagatgtctctagattctaccaggtttcctctgtgcggacaaaaagttatccccagttctgaaccactgtgatagatagttgatggatggatagatattgataactgagacagatatttgataggtgacagatattgaggtagatgatagctataggtgattgatgattgctagatattgagataggtgattgtccgagacggatacattgcatttttagtatttaagggcaaagcagatgcttcaaaaagggaggcttattttattatctataattttcttttttattattttttactttcattccctttttctatgtatgaaaagggaggtttaaattcttgcaagagaatgcaattgtagtgtcttctgaatggagttttccatttgatgccaagccttccagtgccttggtctaaggagaactgcatagggtgagaagagtcccagcgataacgtggaaaaggggccttaacacctctggagggcaagaggtagggggtgaagacgcagtggacacctaaggagaattttgcaggaggagtaggggtttattggctgaaaggggtgggtggtggaaaatcattctagacagggagtgacacggaagcaagccatgggtcactacagggcaggagggacatggaggagaaactcaaatctgagttcagccaggaggtggacacaggaatgcagtgagctcagatgtgtaggagactgccgtggggactggggtatgaggaaggactggctctggcttggctgtgcatttgggctgctggacagtgaggagatccaaggagagagagtgcattccaatttgggaaactttgagggcaaaacatctgcagcaactgtctcagaagagagcctgaggcagggtccttggagggaggaagccacaggtggatggagccaccgagggctgctaggtcaccttggttaagggctagttgcagtgcagccaggtcggaaagtagagccgttctggagcctcacgtggcatagatgttggaggagatgggatgaggatggctcattttcttcttctcaccacaaaagcccagcttaatggcaggctctggagagaggaggaccaacttctacggtaaggtgtctccaaattagtgaggctgatttgcctgttcataaaaacaaaaacaaaagcaaaaaaatcctttagaggagaagccatccccacagaccctgcaaataaaagacagcagatcagcttcgcagatggaaaaatgctgctttcagctaaagatgaggacagagctgctcagctgaggtcactggagaggaggcggaggggacttgggaacctcccttgtctcagttgttgttgacgacattgatcctttcttcatgttgacttttccccccattcatagattcatagattgctctctatgctggaatacgttctttaggatttgtttattttgttaacatatatcacataaaattttgctattttaacttcctttttttttaaagaaatgtggtcttgctgtgttgcccaggccgctgtgcactggtgtgatcgtagcttactgcagcctcaacctcctgggctcaggtgatcctcctgcctcagcctcccaagtagctgggacttacaggtgtgtacttcgacacctgcctaatttttaaaattttggtagaggtggggttttgctgtgttgcacaggctggtctccaactaccgggctcaagcagtcctgctacctcaggctcccaagtagagctaggactacaggctcatgccaccatgcccagtttaccttttaatttttggtaaagttgtgattttgctttgttgcccaggctgttctcaaacttctgacctcaggcagtcctcctgccttggttgagattacaggcatgagcctccatgcctggcctcattttaaccatttttaaaatgtacggttcatgactcaggaggctgaagcaggaggaccatttcaacccacaaggcagaggttgccatgagctgagtttgtgccactgcactctatcctgggcaacagaaaaaaaatatataagatgcacagtttagtgacatggagcacattcatgtttctatgcaaccgccaccccaaccccatccccatccgtttccagaactccttttcatcttccccaactgaaactctgtcctcatgaaacatgccctattgcccctccctccagacctgcccaggtaacctcccgcatactctctgctctatgaatttggtgattctaggagccttatataggcagaatcatacggcatttgtccttttgtgactggcttctttcagttactgtaatgtccttcagattcccccatcctgtagaaaggaatttccctcctttctaagcccgagtagcgttccatcgtatagaggatacagcatgttgtgtttacccattcattcatccttggacactggggtgccttccacctcttggctgtagtgaataatggtgctatgaacaaggttcggcaaatatctgttccagtgcctgctttcagctgcttgaatacatttttttaatttattattattattattttgagatggggtctcactctgttacccaggctggagtgcagtggtgatcttgggtctctgcaacctctgcctgccggattcaagcgattctcccacctcatcctactagtagctgggattacaagcatgcaacaccatgcccggctcattttgtatttttagtaaatataggttttcaccttgttgaccaggctgatctggaattcctgacctcaggtgatctacccacctgggccttctaaagtgctaggattacaggcgtgagccaccacccctggccccttgatacatttttagtattgtaattaaatgcttttcccactgttgcagggagcctatgcagtgtttttagttaaatattttttctgaggcttacctcaagttttcctgtcttccacttaccctccctcattcccaggtaactgtatttcacagcctggtatggatccttctgtactgttctttgtgttaaaaagccccctcacacacacaagcatgtgcacacacaagcacatatgcacacaagcacacacacgtgcacatgcacacatacacatgtgcacatgcacacatgcacgcacacatgtatgcatgcatgcacacacacaatgcgcacgcatgccccatgcagtttggcctcatgccactagagtatgcatcatttttgtctcttgttttcttggagatccctctggggtattttgaggaggagaagttgtattattattgtgttgttgttaatttttagacattcagggacacacgtggagttttggtacatggatgtatcatgtcatggtgagctttgggcttctagggtaccccttacccaaatagtgaacattgtacccgataggtaatttctcagccctcaaccccttcccagccttccccttttgggagtccccgtatctgttatttccatttctatgtccatgtggacccactgttgagctcccacttttgagcgagactatgcggtatttgactttctgtgtctcagttattttacttaggatagtggtttccagttccatccctgtcgttacaaaatacatgattttttttatagcaatgttgacatactgtattttctgtggcttttatatactaaattttctttatgcagtcatctattggaatggctgttacaaaaactcaaaaaattccacacatggtggcccatgcctataatcccagcactttgagagacccaggcaggaggatcacttgatcccaggagttttagaccagcctgggcaacatagtgagacccagtctctacaaaaagctcaaagaaatagtgagggatggtgttgcatgcctgtaatcacagttcttcaggaggctgaggtggaagaattgcttgagctcaggagttgaaggctgcagtgacctatgatcgcaccactgcactccagcctgtgcaacaacagagtgagaccctatctaggaaaaaaacagaaaagtaagaaaacaacagatgttggtgtggaagtggaggaaagtggccgtggatgcgctgctggtgcggaggaggtcttccagtgcatgcagcaggggaggtgacctcacttctcctcgagaggagctcagctgtgcaaggcagtgttggagaggatgggagggtgcatgtgaccctaggagcaaggctgtgtgcctgtgggcatgcacttcctggtgacgtttccttggaccccacagtgggaaaaacaggagcccctctgccctctcattcctctttctctgtatttgcatttgctgtcttgctggtctcaagattcccaagcgctgctgccagcccaccccttcagcctgccaagctacatgtgtgcgcccacttgaccactctctgagccttctgctcaggtgcctcccaccaaaaatgagttcctgctcttcctccttgcccctcagccctagtcatttcctcatttgcagttccccgtttataagtgccccttctgctcttggagctcagccaggaaccattttttatttccttttctttggctctgtattcactctcatcctgaatcctgcccttttaatttttttttttttgaaaagatgtggtcttgccatctcatccaggctgaagtgcagtggtacagtcatgtctcactgcatccttgacctcctaggctcaagggatcctcccacctcagcctcccaagaaactgggaccacaaatgcacaccactatgtccagctaattaaaaaattttttttgtagggacaggatctcactatgttgctcaggctggtctcaaactcatggtttcaagcgtttcccctgcctcggcctcctaagtagctaggattacaggtgcacaccaccatgccttgaccctttccaattctcaaacacatctccagagcccatctacatcaatgatgtcttcacagaagccgccgtagcttatctaaattccctccccttctctccattgatctccgatctctgcagaactcaccccttcctgctgtatcagcccaaacctttctgacatgaaaataggctgggtgcagtgactcaagcctgtaatctcagcacttgtggaggctgaggtgggagaactgcttgagaccaggagtttgagaccaacctgggcatcatactgagaccccatctctaatttttttttttttgcaaagacagggcctttctctgttgcccaggatggagtgcggtggtgccatcatagttcactgcagcctcattctcctgggcccaagttatcctcccaccgcagcctcccaggtagctgggactgtaggcctgtaccaccaagcctggctaatttttaaattttgagggtcttgctgtgttgtccagactgatcttgaactcttgagtacaagtgattttcctacctcagtctctcaagtagctaggagtacaggtgtacacctcaggcccacctaatttttaatttttttttatagagacatggtcttgctttgtgcctaggctggttttgagctcctgggctcaagtggtctgccaccttggccccacaaagtgctggagcactttggcctctagccttcttttatgtccctccccagtcttcctttggccttcagctgtggggacagagatgccccctgcctccctgtccccaccttctacctggtcttgcaagaccccctccaggcatccttccaagtttacagtgtaatgtctgttccccctcaaacctgcaaagctcatgatagtcacaagatctgcccttcctgatattgtgtaccgaggacattgcttggcacataaggggcccttgtccaaaacatctggaaaccaataaagaatgtggctggtgagttactgattaatgtgttgatgaattcattgattgctgaggctagtacgtacagtaagggttaggttttgaacatgcttctcatatctatcgtgataaaccctcttatcgtctattgcttttgaacttttatagacttgatgtcagggaaagagtcccgcatttaactggaatcgttgaactgatgcaccggtttctaattttccaaactcagatttgaaatcacctgtggtcactaaactctgtcctatcccacagcccctgcacatggtgacttatgttttgtaaatgttttttggagatagtaaagtcaatatctctttgaatattttgttccttacctttggtaagacctagccctgcacaaattctgtccatgtaagcaaagtctttttttttttttttccagataaggtctggctctgtcactgaggctgcagtgcagaggttcagtcatagctcactgcagccttcaactcctgggctcaggcagtccttccgcctcagcctcttaagtacctgagactacaggcatgcacaaccacacccggctaatctttttatttttttgcagagacagagtgtccctatgttgcccaggctagtttcaaactcttggtttcaagtgatcctcttgcctcagtctcccaaagtgctgggattacaggtgtgagccaccacactcgcctgcaaagtctgataaaagatttgaaggaaggatgtctcagagaactttttttttcttatactatttacttaatcttattgatttggggaagggcaagggaatcccagttttctagatttttttttttcttataggaatatgtttttacttggtacctctctctgtgtaaactattgcttcttaaagatgctgaggggtgatcccgcattagtgtataggtaaaaatgatgtctccatttcatatatactgattaggtgacttttttaagccttgtggtttgttgatgttgattttactgagacacttgtggaacagatgtattttcatacaaccttacacatctcagtagttttccccactcgtgcagtaactttttctcccctgctttctctcctcctctccccacctcttcttccttcccctcctctcctcgtcccttccctcctcttctcatttgatacaaagccctagctctcttcctctacagatcatcctacccatggttgaaattgcaacttcccctgcaagccaagtgaccgaacctgagatgtttgtattgtcagggcttgcatattctacatgcctgcataatccccaaagttctttcattccttgcttctaacctacccaaatccttctaatctcccaccacggttaattatctctgatgctcctgaaaggtgacctgctgctacattgtgacaaggtgatgcattattcttaagaggatctgtacagattattatcccagagtgggatagatgggggaggatacagtatatatccaaagaatatgttgcaaactaataggagggagagagagagagggagagagagagagagagagatgaatggggaggatacaggatatatccaaagaatgtgttgcaaactaatgggggggtgagggaatgagggagggaatgcatctttttcttgcatatttcagccattctcttcagccacattaatagttgtacacagcggtcttgttattgccttgaccatttttgtggcctgaagaaatttagaaagtcacgagctgacacagaagtttattgtaaaagttcaccagtacgatagtatttggatcttggaaaatatttccccaccagaacagtgaaactgtggttgtcttctaaggtcatccacagaagtacagtttgactctcatgcgtttgagataccatgtgcttaatcacgaagtattgctgagaggaacactcttgcccaaccaataatggtgcaaaacagaacaatagggcatttagctaggagaaaatgacttgagatgtcagctataagatgaaaggagtgtgggtatgtggtaggtctttataactccaacagattgctctagaaaacaatcactacataccaaaatttagccagtcttagtggcatgtgcctgtaatcgcagctactcaggaggctgaggcaggacaatcacttgaacccaggaggcggaggttgcagtgagccaagatcatgccattgcactccaagcctgggtgacagagcgagactgtgtctcaaaacaaacaaacaaaacaaagcaacaaaaccactccaacagatacttctccctcctcatatactctccctggatccctttatgcctcaagaccacagattttgaacttgctgagctgtagtgagtggagaggtgggacacaggtgcacagccttcagtaactgaaggaaaaaaaaacaaaagaaatttctaatcctgagcttcctgagctcccttcagccactcagctgctgaggggcaggaatctagcagcaaggtggagagcggaaggcattcctacaacctgtatttgtgggtcattagtccccgaactccagcatccttgcagaatctgcaaattttaaagtgcatcaggtaagacttttttatataagaggcctatattttgctaatacatataaacattgtgtttagtcaaataaatgtttatttaaaattgacagtagcatgttgttttatttatttatttttttcttttagggataggatctggctctgtcacccaggttgaagtgcagtgatgttgtgatcatagctcattgcaagcctccaattcctgggctcaagtgatcctcccacctcagcctcctgaattgctgggacgccaccatgcctggctgattcttttattgtagagatggggtcttgctgtgctgcttatgctgctttcgaacacctggcctcaagtgatcctcctgccttggcttcccgaagtgctgggatgacaggcattgagccactgtgcccagcctatgacttttcctagcattaatctctgtgtcattgtaagctgtctcctgggtctttgccttcattctacactgttttggtggaatggcctgtgctggcagacaagcccatctggttgaccttgagcatccttccctgtcctcaggaaaggtttcctgcgcattgttttgttttctttgtacaccgactggctgcaactcattggaatgaccttgcaagggagcatccatgatagtgtcatgatcagatgaaacataacagtatgtgtcctggtcatggttaagattgtcttttatgcttccgattcttctgggtgccgtctgctggtggccctctcatgtgctaatggaaacatgggcatgctggtgtcttctaggtcctctccaaaaacaaagcccaggttaggcacagtgtctcacgtctgtaatcccagcattttcggaggacgaggtgggaggatcacttcagccctggagttcaagaccagtgtgggcaacacagtgagatcctgtctgtacaaataataataataatgatgataataataataataataataataaaataagccaggcgtggtgacatgcacctgtagtcctagttgggaggctgaggtaggagaattgcttgagcccaggaggttgaggctgcatgagccatgattgtaccattgcacttcagcctagtggatagagtaagaacctgttcccaaacaccccaaacaaacaaaatcccaaaacccttagttccacatcttgcatcatttcccccacctcttctttaggagcaaacctttcattatccatgcatatctctccaaactgtatttatatttgtgctgagatgttgaatgcacaagacgtacctcagtatcttttgttccctactttcatctctacccctccctcttccttgatctctcattgctgtgttttcttccactgatcaacacctttgtaaggagaaggcaccttgggcaagctaccacaagcaagtaattaggaatacctcatttggggctttttaaaagggctttttcccagtaggtttgggatgcagtctgcaagtttattgttgattcccaggcttttaatgatagttccaggttactgaattgggtgtgatctctgaagatctatgtgttgttggttagtaggttagggctgccataacaaagtagcatagattgggtggattaaacaacattgatttatttttttaccattcttaaagctagaattttgagaagaatatgttagcagggctggtgcctcttgaggcaccttggcttgtagatgccatcttctccctgtgtccttacatggttgtccttctgtgtgtgtctgtgtcctcatcctctcctcttagaaggactccagtcctgttgggctggggcgcattctaccaccacattttatcttaatcacctctttacatgccctgtctccaaatacagtcatattctgaggtcttgagagtctggtcttctacatatggatattgggaggatgcagttcagtccatagcgcactgttagctggtgtattacaagatgttgatatttactctccatttattccatgacaatgagacctttacccatttcccaggatacacatatcttaacatctgctgttgtctaaatgcatccctcaaattcatatgttgagacagtaacccccaaagctatggaattaaaagatggagcattgggggaagcaattaaattgtgagggtgaagccgttgaacaggaccagtgcccttggtgaaggggcctgagggagcctgtttctccttggtctgtgggaggacagtgtgagaagggcccttccctcaggaatgggcccttaccatgcagttcattagtgggaagtccagagacttccagcctctggaactgagaatagtacatttttcttgtttgtaagaccctctagtatatggtatttttgtgatagcagccagaatggactaagacaacatctatgtaacatctatggaacttgtactttaatatccatctacatgcttatcccaatatctgattatacacctcttaacatctacacacgtcttagcatcttacctatactgatgaattatacctgtctatatgtagacctcagcacctgtctatacccagagtcacatctacacacacacgtatcctaacatctgtctgtatgcacaccttagcatctgtctatcacatatattagcatctatggaccttgagaacttgtctggaggttctagcaggggaatgcagctattcgtatacccttgactgaagaccagtcctcctctattggggttggtcatcctctttgaccgaacacgcagctttgggagggacgcatatggagcggtgaggaggaaggggacaactgcctagccagtcagatcagctgaatcaaccctggtgatcaatggcaggcagatgttgcagccagattgccctcacatccatatattagcatctgtctacatccatatcctaatatgtgtctacactcacagagcaacaccagtctacatccatctacacccatatcctaacatctctttatacttctatgttaatatctatctacattcatattctaacatcggtctttatgtgtatattaacgtatgtctacacctatatcctagcatccatattataacattgttctctacctatgtgttaacatctctcttcacccatattctaacatttatatctatccatattttttgtaatgcctgtctacatctatatcttaacatctatctctacctatatattaacatctgtctacacctatattctaacatttatctatatctgtattctaatatttgtctacatccatatataacgtctgtctacagccatgtcctaacacctacagccatatattaacatctgtctaaacccatatcctaacatccatctacacccatatagtaatgtagtagcatccatctatacccatatcctaacatctctttgtacctacatattaaccccttctgcacttgtatcgtaacatttatctatatccgtgttgtagtatctgtctgcacccatatattaatctgtctacacctatatcctaacacctatctataactacatgttaacatccatatatatctgtatactaacatatatctatatccacattctataccatattataacactgtgtaaacccatatattagcccccatctgcacccgtatactaacctctgtctctcagcagattgtaacatttatatgtacatgcattctaacacctatctatacccatatattaatatctgtctttacccatgtgctcatacctatgtgctccatgtcccaatatctgtacctagctattactgtgtgtctgtccacacattttgtcatctagctgagtctctaccccaacatctagcatacggcatatccctttccctcctgtggcggggccctgagcgtgtgctgatgcctagctgatggtgtacccctgccctgccttggcggggccctgtgtctgtgctgacacctagctgacagcataacccctgccctgccctggcagggccctgagtgtgtactgacacctaggtcatggcatatcccctcccctcctgtggcggggctgtgagcatgtgctgacacctagctgacggtgtaccccctgccctgccctgggagggccctgagcgtgtgctgacacctagctgacggcgtaccccctgccctgccctggcggggccctgagcgtatgctgtccctgcaggttctggacgtggcatgaggagcgcttcctctacatgctcatggagtatgtgccgggtggcgagctcttcagctacctgcgcaaccgggggcacttctccagcaccacggggctcttctactctgcggagatcatctgtgccattgagtacctgcactccaaggagatcgtctacagggatttgaagccggagaacatcctgctggatagggatggtcacatcaagctcacggactttgggtttgccaagaagctggtagacaggtaagaggaacgtgaactccgatggaatctacactgcttggcaatgagaaaggtggtggtagttgtggcaggtcaggcagggaaagattgggaaccagagtttaactctcatgtgtgggagacacttgcaatcagggatgagagagccaggttgacccacagctcattttaggtgggctgcgattgctggcaacttcaatggaagtggagggtattatcgttaagtgaagtaactcagaaatggaaaaccaaataggatgtgttgtcacttataggtgggaggtaagctatgggtgtgcagggcatacagaggagtgtaacagacactggagactcagaagtggggagggtgggaggagccagttacagaggtaatttcctgattacagattcaggaggcaattgtatctgtgtggtttttttttttttttttaaacagacagtctgggaaccctcagtgttaaaattattcttacatttcccctgacaaaaatgacgacaactatctatactctcctactccgaagtttccattaattactgttttactgcctcaaaatgataccttgagggatgaggtgtggagttttggtgaagtgttgaaattggcaggaaaaacctgttactgccaaatttggtgacagtgacttcattttactgtgtcagaataatgacatgaagagtgaatttgagtaaggtatgtaaactaccatgaaagaccgaagacagatgtagtgagaaatgagatgtgaccaaaagcaagacaggttgggcgtgatgattccagcattttgggaggccaaggcaggaggatcgcttgatcccaggagttcaagaccagcttgggtaacatagcaagactccctctctacaaaaaatgagccagatacaactatagtcctagctatttgggaggctgaggtggcaggataatttgagcctcgcaggttgaggctgtggtgagctgtgattgcaccactgctctccagcctgggtgacagagtgaggctccgtctcaaaaaaaaaaaaaaaaagcaagatgtgttcctgtcaagattttgacaccatcctcattaattaaagaggttgataaaagcaaaaaaaaaaaaaaaagagaaatgttatttttattatatataattttacattatttttcctgctatattatgaaataaaaagctttttatacttttctatgacaaccacgaggggaaaaaaatggactttgtgtatattgtaagcttaccagtcagaaattgccacattgtagccgtgtgtttgtgtgtgtgtctgtgtgtgtgtgtgtgtgtgtgtgtgtgtgtgtgactataccttatttttgttttcttggaatcagttttttattttgaaactgagtctcgttgtgttgcctaggctgaagttcagtgcagtgagctcactgcaacttccccctggggcgtttaggtgattctcctgcctcagtctcctgagtatctgggattacaggcgcccgcaaccgcgccgggctaatttttgtatttttagtagcgatgtggtttctccatgttggccaagctgctcttgaagtcctgacctcaggttatctgcccaccttggtcacccaaagtgctaggattacaggcgtgtaaacatgctgcaggcatcctcagtattaggtctgttttgcagttacccaacacaatttttcagggtacctcctctttatatctgaacaagttgtttgtaattctgaacatttacatccttccaaagacgctgtggttggaaaattgatctcaactctgaactgtgctattatactatactgcagtgaaatactatatacttagtttcttttttttttttttttccaagacagggtctcatcctgtcacccaagctgaagtgccgttgcacaatcttgtctcactacagcctcaaactcctcggctcaagtgatcctccctcctcagcctctgaagtagctgggactacaggcatgtgccaccataccaggctaatttttttatttttaattttagagatgtgatctcactttattgctcaggctggtcttgaactcttggccccaagatatcgtcccacctcagcttcccaaagcactggaattagaagcatgtgccactgtgcctggccaattctatttttgaatttaacatttttagcaccagacagttgttaaatcagtatcattttattatttgtttatttatttagatggagtctcactctgtcgcccaggctggagtgcagtggtgcgatttcagctcactgcaacctctgcctcccaggttcaagcgattcttctgcctctcagcctcctgagttgctgggatgataggtgcgtgccaccatgcccggctaatttttatgtatttttagtagagacggggtttcaccatgttggtgaggctgttctcaaattcctgacctcgtgatctgccctcctcggcctgggattacagacatgagctgctgcacctggccaagaattattttataaaatctaatcttacatagtttatgaggtaaagggccttttggcttaattcgcctcaatggtccagaatgctatgccaaactgggacaattgtttaattgtatagtgttcagcatatgggaggtattgtccttgcaaagccactgtggtgccttgtgtgtctgttttggtgctgggctctctagagagtgtattgtctatataatgaacatgcactgtttaatatgtaggagaaaagaactgttaatattttaaatcccacccagttaagccaagaacaatactgtttacacaaagggcttcacttggccttaaaggtgtgttttgagggcaagtctagatgtttttattattattgttttttaaattttcctcttttttgagacacaatcttgctctgtcgccaggctggagtgcagttctgtgatctcagctcactgcaacctctgcctcctgggttcacatcattctcctgcctcagccacccgagtagccgggactacaggcgtgagccaccacgcctggctaatttttgtatttttagtagagacggggtttcaccatgttggccaggctggtctcgaactcatctgaggtgacccgctggctttccttccaaagtgctgtgattacagacttgagccaccactgtgcctggcctattttggcctattttttcttttttcttttttttttttgcagaaggagtctcgctgtcttgcccaggctggagtgcagtcgcatgatctcagctcactgcaagctctgcctgccaggttcacaccattctcctgcctcagcctcctgagtagctgggactacaggtgcccgccaccatgcctggctaattttttgtatttttttttttttttttttaagtagaagtgaggtttcatcgtgttagccaggatggtctcaatctcctgacctcgtgatctgcccacctcagcctcccaaaatgctgacattacaaccgtgagccattgcctattttttaattttctaaaaactggaaacaggttctcactatgctgtttcccagtctggtcttgaacttttgggctcaaggaatcccccctgactcctcagcttctgtaagtgctgagattacaggcttgagtcactgggcccagcctagacttttagtccaaagaagataatagggggagggatatgtctgtaggtgaatgagtggatctttcccttctctatcctggcattttctctccttcatctcatcgattaaaattctggtctgtgtatgtgttttgtttttgagttattttgtgttggttcatttgtttctgtttcttttttgtcagtacccctattgaaacacaaattctcttttctctgtcctgtgtgcccaccatattgcctggtaggatgacgtgttagagatgcccacacagacctggggagagattgggctgtgttctttctaacaccgccacagcactgataataacatgcagtcacaaccactccatttacaaagacaaagaggggtgttttctgcctccagacagttttagtaatgtatgctcctaaaatttttctttatctagggcaacactgtccagtagaagtccaacgcaaatcccatctgttattttaaattttctagtgtagtcatgtgttaaaatataaaacaaacaggtggagaaaattttcataatgtagtttatttcagtaattcagtacatccacaatattttcatttcaacatacgattcatacaaaaattgagatattttacatgaatttttcctgctcagtttttgaaatcccatgtttattttacacacacagttcatttatatcagggtgccgattctcatcagaaataataatggatctggtcgggcatggtggctcacacctgtaatcccagcactatgggatgctgaggtgggaggatcgcttgagcctaaggagttcaaaatcagcctggacgacatagtgagacaccccatctaaagagagagagagaatgggtcctccctcccctccctttcgagaaaagcctgacaaatttatttgatcatagttttacatgatgcatcatgtaaaaccagaatgaacacccaaagataccaaaatcaaaaaaaaaacctgtctatttttatgcttaggttctgtgaagcagggacagccatgtagaaatgtgattggaaaaaagtgtatgagctgatgggaatagactgagtggggaaatccagtcaggcctgactgctcagagtcttcttttttaaaaaatttatttataaagaaaataagtgtgtttcttacagttttggaggctgagaagtccaaggtcaaagggctgcagctggtgagggtcttgttgctatgctgtaatgtggccgaagccaggacatgggcagaaagaggaaaggtgtcagttcaggtctctcttcctcttcttataaagccagcagtcccattcccgtcatgaaagtcccacctttttttttttttttttctgattttattttaattcaataccttttggggaacaatttttttttgttttctttgttgcatggaaaagttctttagtggtgatttctgagattttgttgtacttgccatccaaacagtatacactgtatccaatgtgtagtccttttttttttttttttttttttttgagacagagtttttctctgttacctgaggctggaatgcaatggtgccatcttggctcactgcaacctctgcttccccgggttcaagcagttctcctgcctcagcctccttagtagctgggaatacaggcccacaccaccatgcccagcttattttgtatttttagtagagatgggttttcaccatgttgaccaggctggttttgtaatcctgacctccagtaacccaccctccttggccttccaaagtgctgggattatacgcgtgagccaccatgcctggccgtaaattcttcttttgttattttatttggaagtctaattcaacaaaccagagataaaatcttgcatatattcacttgtttataaatttgacaaaccgtgttactgtccagttaattcatgatgtctatttaagattaaatggatgaaatggtttactatataacgtgcaccaattattttacttaatgaacatgcgaaaatcttagaaaatgcttcattaccatcttgatatattgctttctctttttttgtttttgtttttgagacagagtcttgctctgtcacccaggctggagtacagtagtgcaatctcagctcgctgcaagctctgcctcctggattcaagcaattcttccgccccagactcccaagtagctgggattacaggtacccaccaccatgcttgaataatttttgtatttttggtagagacggggtttcaccatgttggccaggctggtcttgaactcctgacctcaggtgacccacccatctctgcctcccaaagtgctgggattacaggcatgagccactgataggttgcttttacaaagaactgcatctttctctgtatgggtagtgtagcttctgtaacttttttgtgtgtgggctttttctccttttttttttttttttgaccttctttctaacaaaacatttctcttctggcctggccccaaggaagttgtgttcatgggcagatagatggccctgcccctggttcaggattcaaacagtacatgtactttttgaataaaacttaaaagaaatttaccagtgtactgtggaccactacagaatagatggaagtaaacagggaggcttcatcatgaatgactttttttatttttgagatggagttttactctgttgcccagactggagtgcagtggtgcaatcttggctcactgcaacctctgcctccggggttcaagtgattctcctgcctcagcctcctgagcagctgggattacagacacgcgccaccacagccagctaatttttgtgtttttagtagatttggggtttcactatgttggtgaggctgatctcaaactcctcacctcatgatctgccccctcagcctcccaaagtggtgggattacaagtgtgagccaatgcgcctggcctttattttttatgttttattattattattattattattttatttttttttttttttgagacagggccttattctgtcaccaaggctgaagtacagtggtgggatctcagctcactgcaccctcagcgtcctgggcttcagcagtcctcccttctcagcctcccaagtagctgagattataggcatgtaccaccacagctggctaatttttgtatttttagtaaagacctggtttcatcacgttgcccacgctggtcttgaactccggatctcatgtaatctgcccacctcgaccttccaaagtgttgggattacaggtgtgagccaacgcaccaggtcttgaataacatttttgaacgtttcccagaaaggtaacgttttcatttttctcttatagcatggggtaaaaacacatttaagcatgttgtgattaagttttctactcactacatgaatctctgtctttcttttttgtttctttattgagacagggtcttgctctgtcacccaggctagagtgcagtggtgagaccatggctcaccgcagcctggaactcccaggttcaagcagttctcctgtgtcagccccccaagtagctgggactacaagcctgtaccaccgtgcctggctaattttttaattttttatggagatggggtttcactatgttgccagggctggtctctaactcctaagctgaagcagtcctcccgccttggcctcccaaagttttgcgatgacaggtgggaggcgcagtgcccctcccctcccctctcttccacccctcccctcccttccacccctcccctcccctccctgcccatctcctctactccccttccccctgttcctttttttttttatttcttttctctcttctcttttcctctactctccctcttcctctcttttctttctttatcctgttaactgaatgactcgtataatacttattttaaaccactgctcatggtgacttggtatttggctttcctaggttgtcaatatgttgagatggttttctttttcttttgtggcttgctttcgtcaggctcttgttttctaacagcagtatttcttatgtttgtattttaaatattttgtacacacactttattatatattatctggatagctcccctaaaagacttgatggcaaactagaattatttctggttttatgaaatggtcaaaataaaatactgatgcatttaatatgattttctaagtcaaatgcataacacaagcatcccttatttgaaatacttgagaccagaattgttttgggttttgggttttttcagattttggaatatttgaattacctttacctgtgagcatccctaattcgaaaatttgaaatccagtgctccagtgagcatttcctttgagctgtgagcatcatgtcagtgctggaaaagtattgacttttggagcatttcagatttcagatttggattaaagatgctcaacttgtatacacctgtctttaaactataacagatgatttctttctctccaacagttcttttttgtttgtttgtttttggtgttttttatttctctacaacaattttttgttttttttgtgtgtgtttttgtgtttcttttgagacagggtttcactgtattgaccaggatagtcttgaactcctggcctcaagtgatcctcccaccttggcttcccaaagtgccaggatggtatccgtgagccactgcattgggtgcaacagctctttcctagttcttctgttgtagcattttaagtccagatgttacattgattactgtcctctgggtttttatttctagcatctaggggtaatattgaacctaatctttcaaaatttctacttaatcctttcaaacacacacaggaatagagagtagttcatattgaaaccttgtggtcccatcacccagtttcgattgttatcaaagctttgccactttgttggtttctttctctttgcccatttgtttgttgagttattttaaagcagatgcactccatcctatctctaatagatatctccctttaaaaaagaaattcaatgcattatcacatctgaccaaactaatttttttaggaaaaaaatctagcctgggcaacatagcaagacctcatctctgcaaaacatcagaaacaaaaaaattagccttccataggttaaatccaccctgctgtatgtctgttaataaagttttattggaacacaggcacatcttgggggatatttctaacagagaccatgtgatctacaaagcctaaagtatttgccatctggctccttagagagaatatttgcccactcctgagccaggaactttaaattgaccaggaactttttgcagtggagtattatttgaccatgaaaaggaatatagttctgacacattctactccacattggtaaaccttcaaaacatgatgtgggatgaaataagctagacaaaaaaggggccctagattcttctaagtcatagggacagaaggtagatggtgggtgccaggggctggggaggtgcagggaagggggagatactgtttaatgaggagggagtttctgtttggaatgatgaagttccaccaatggatggtagagagggttgcacaacaaggttgataggcttcccgccactgaaccatacacttaaaaatgattaaaatggaaaattttatgatagatgtattttaccaaataactgtatacataattgtaatatttaattagacataaataatatatcctgtattaaatttatatatttaaatatatttatctctttaatatgttaaatatttaaatatattcatatgtaaatttaatatataaatatattaatgtaatgtgttaattaagataacataatgtattaatataatatattccgattatatttgaaacaaatacaatgtaatttttaaacataattatattttaaaaatatatatttaatataattatataataaactgatactttatatttaattaaatgttacatatgtaattaaactactaaatacttttatatgctcataaattgtgatataaatatatatttagaaagttatatgtagctataattatacagtatccatagttttctatatataattttataaatgtatatttataattttttaaatttaaatttatatattagtatgtgttacacatttattgtttagattatatgttcaaatttaaatgtatacatttataaatacataattattttatatatatttcataacatcagaaaagtctttctacttactttggacgttttcccttagcttcttacttttgagtatttaatggaagccaaggagggcctgagatgtcgagtctgtttgcagtcagtgttgttactttcccttcagccctgtttaattttgctataattcatactaggaggtgggtattactgtgccgaggttggtgacaggcacccttctccctgctggtcagtggtgtttcggaaccatagtcgcctaggaaacccctcccagggcctgggctggccatcggaagctgtcccatgcttgcggacatgtaccttctcccttgacagtcctgaaattctcaactgtttgttcccatcagacagttctaggaactgtgattgtgtccctgtagaaaaacaacgatgaaaaactttcctttttctgagaaacccccacaccctgcttcttgattgtaacccaagatcctataagaaaaggcgtgtagtattttcatcatgagtactgagctaacatctatttcctgcattaccaaatgtagagaaaacactctcatacttttctgataaaaaggaaaaaaatccattcgtttctgtaatcaagagtaaaagctgtcatcagctgtccatattcttcatgagccccactgtgcccctgttagctgagtgacatgcttaccatgtcgtaaagccatgaggagagacagaaagtgaggctggtgacgccacctgctaggacgtaagagggactggactgaaactgaactgggagatgtcatccatttctctctctttttctctttttattgtggtaaaatacccttaaaatgtaccatagtaaccatctttatttatttacatttttatattttttgaaacagggtcttgctctgtcagccaggctggaatgcagtggtgcaatcatggctcactgcagcctccaactcctgggctgaaacaatcctgttgcctcagcctcctgagtacctgggactagaggtgtgagccactatgcctggctaatttttaaatatttttgtacagacagggtcttgctatgttgcctaggctggtctggaactctgaggctcaagttatcctaccttggccttccaaagcattgagattataggcatgagccattgtacccagcccatttgaaccatcttaagttgcacaatctcatggcatttattgcatttaccatgttgtacaaccatcacctctgtctagttccagaacattttcatgatcccaaaagagaacttgtatctgttaagcaattattccccatcctaagccaggatgatctcatcttaacttgattgcagctacgaagatcctgtttgcacataaggtcccactcacaaatactggggtttaggactttggggagtgcacagttcagccagtgcaggtgtgacggaaggcatgggcattaagaacacaggagtcattggatatctatacttcatagataatcctatccttagctctgtttctccttcgttaacatggcctcctccttcccctcccgccggccatagtgaaactaagaacagtgagaaaactgagaacagcaggtgtcaccttccttctacccaaaagccaggtgagcaaaaggagataggagcagggaagtggataattcactgccccgaccagtggtctccacatagcactcaggctgtctcatctcatattcattcacgcagtcagcatctctccatagcagcgcatgtctctctgtactttcagctaggcattggggctttttgcaggaaggattgattctaacagggcaggagtcctcctgaggcaagttagaacctggatacttatacaaccttaggtgtgtgtccttaccctaacatggagccaaaaagagcctcatctttttaaaggtaagtggaagttgcaactaaatgcctatagggtgacttgcggccacttctactttgggttcatatcagctaagttctatgcttttagctactttcaggccattttggatgggctagcaaggtgaaaatacaaaattagtaggccaataagtcagtcgtcttgcagagtaacagaaatgttatgcattgaatcaactagggtgtacttggagttgattccgctgggaggggcaggggagaggatgtttctaaaataatgtgcattgtactttccttttgtagacttaagtctaatgaatgagaagcacttaataggaccacaaggggatccttgttccatgcttagatctagcatgcagataaagtaagccccttcccacattcctccatgggaaggtaacttaatttctctccttgtcttgtttctttctttcctgacttgtatctcccagagcctgcagtactttttttcttttccttttttttcccttgagacagggtcttgctctcttatccaggctgtagtgcagtagtactatcatgctccctgtagccttgaactcctgggctcaagtgatcctcccatctcaactagctgacactacaaacacctgttagcatgcctggcttttttttttgaaatggcatttcgctcttgtcacccaggctggagtgcagtggtgcaattttggctccctgcaacccccacctcctgggttcaagtgattctcctgcctcaccctcccaagtagttgagattacaggcgctcaccaccatgccttgctaatttttgtatttttagtagagacagcgtttcaccatgttggccaggctggtctcaaactcctgacctcaggtgatctacctgcctctgcccccccaagtgctgggatgacaggcatgacaccgttcttggtcttttttttggtaaagaagaggtcttgctatgttgtccaagctagtctgaggctcctagcctcaagcaatcctcttgccttagcctcccaaagtattgagattacaggtgtgaatcaccatgcttggccttgtggtacttttatttcatggatggccgacagaatttgaaatttggatggcagccagtttgttgttatcccaagggcttacagattaatgtggaaaagtctcttgtcggaaaagaggtgggtatggagatgtggtggagaagcgaaggaaagataacagtaacaacaatttgggtgggttcctgcaagcaggaaggtgaggagctgaagccaagatacgtgcccacaccaccgcaaacagggcagactcaggtaagatgtgctgggaataaaataggctttgcatatgcttgaaacattgtgcaaagaactcgagagtggataaacatgtacattaccaggctctatggaacttgctttttgttctctttacattcaaaaaaatatgtaagtatatattttttaaaatgtaaaaaaaaaaattacatatgtataaatatattataaaaaagaagggcctttgcaaagcatgtatatttttttcccctccaagggtgttgcttctttctgcctgtctacagacgggccccacacaccaggctaggaagcatgtgtcaggaagggtggatgtggcctgcaggtgtgctatgggtctgaattgctgaaagcccgaagcgacattctacccagcagtagagtgccaatggagtatggcctagacacagccccctctttgaggttactgatactcagctcctttccagcccatgagtcttccagcttctgctacagtcattgttacattgccctgactttgtttagcagttgcttctgtaaccaaaacacaggttcagccccttgccatttgcagagtgcaattagcaagagcaaggtctagtgtaaagaaagtgagtttttattccagagctttcttagggtaagaagtactggcttcctgcttgaggccacccctttgttttcggagcacaaagcaggcacttttaaaatggcatgcaggggaggaagtgtatttccgtctttacactggtttccgggggcaagaaatgtttttttttttgcagagggtagagagtgaaagaacacatacataagctctgctgaccatccagtctcaattacaagtaaggactctgctcttgcactttttttgggggtggggagagtctcactgtgtcgctcaggctggagtgcagtggtgtgatcttggcttactgcaacgtctgcctcccaggttcaactgattctcctgcctcagcctcccaagtaggtgggattacagacatgcatcaccacacccagctaattttgtatgtttagtagagatgaggtttcgctatattggccaggctggtgttgaacgcctggtgatccacctgccttggcctgccaaagtgctgggactacaggcatgagctactgagctggcctaactgagttcttgaattattcttttcagtgacacttttttgtttgtttgtttgaaggataaaggattttttaaaatttaattttatttacttattcatatatttactttaagaactttcgttttaggttcagaggtacatgtgcaggtttgttatatgggtaaactgcatgccacttggtttacgaattattttgccacccaggtaatacacatcatacctgacacgtagatttcccatcctcatcctcctcccaccctccatcttcaggcaggcccaggtatctgtttttccccctctccatgtcagcgtatagccagtgtttagctcccacatataagtgagaacatgtggtatttggtgcgtgatgtgagtccacttaggggaatggcctctccacctccatccatgctgctgcagaggacatgatctcgttgtttttcctttaattaattttattcattatgatttatactaagacaggtaaaaataactcaaaaaagtctgagtctttttgcttctgagtaacagtggtaacagtaccagcaacagtagcaaggatggtaaaaccaattcttagtttccaagcccgataagaaatgtttctatggaaaggaatcagtgaaaacaatgttactgtctttacacagtaaaatatgtgcacagacggtaaagggagcgtggttttactcaacgaagttattgtaacaatcagagcttctaaggtgactgcattagccaagcaccactgagtgttgtgggggcctgtctctgtcgcccatataggacttggaccctactgtggaacacccgagtacctagcccccgaagtcattcagagcaagggccacggaagggccgtggactggtgggccctcggcatcctgatattcgagatgctttcggggtaagtagagtctctgtagagaatcttcatcttacaggccagcacccccttcccccacccattcgtccactcggcatttctgtaaccttgaaaacagtacgtgagtgtcgcaaacacacagtgtggctgcacacacatctgctgccctgctgaggttggcaatgtgaattagcaattgagcttgtgtgaataagaggcaaaaaacccaaacttgtgaaggaaccacccatgcatgcccattgagatttttatattgaaatatccatatcttctttaaatatacaattaacattctgggctgctctgaaggtagtgagttatctcagttgatattcacagttagctaccagttgaactccttactctgctttttctccccttatcacttctgtgcttgattagtcttagaaagaatttaaaaattaaatacaaaaaataaccttctgcactgacgcttcctgaagcaatctgcagggctcaggagggcagaggttgggtcagtgtaaatcagccaaatacaattgagtggttcctggatgaacagctggcaaggaaggcaagaatgtattctttcctaaaacccctgacttatgttaccaggaaggagtcctgatccagaccccaacagagggttgtaggatctcttgcaagaaagaattcagggaaagtccatagatcaagtgaaagcaagtttattaagaacgtaatcctgtaatcccagcactttgggaggccgaagagggcggatcacaaagtcaagagattgagatcatcctggccaatgtggtgaaacctgtctctactaaaaacacttagctgggcctggttgggtgctcctgtagtgccagctacttagcaagctagggcaggagaatcgcttgaacctgggaggcggaggttgcagtgagccaagatggcaccactgcactccagcctggtgacagagtgagattccatctcaaaaaaaaaagaaagtaaaaagtaaaagaataaaagtatggttactcattaggcagagcagccccaagggctgctgtttggctattttggtggttatttcttgactatatgctaaacaaggggtggatttttcgtgagttttccgggaaagtggtgggcaattcctggagctgagggttcctcccctttttagagcatacagggtaacatcctgaccttgtcatggcatttgtaaactgtcatggccctggtgggagtgtcttttagtacctaatgcattataattaatgtataatgagccgtgaggatgatcagaggtcactgttgtcgccatcttggttttgatgacatttggctggctttactgcagcctgttttatcagcagggtctttgtgacctgtatattgtgccagcctcctgtctcatcctgtggcttagaatgccctaaccgtctgggagtgcagcccagtaggtctcagcctcattttacccagcccctgttcaggatggagttactctcgttccaacgcctgtgatacctgtgttgggtgagatttggaagtcaggagaggtgccatcccccctgcgaccacataacagagaggtcggtcatttgttgggacgtcagcatgattgagtgttcaagtctagcatatgcctgagacagctccactatgactagaccagaaacgcaaaggaagcacgcaacacttggaaacccaggacgtgggcgtcatcctcgttccgttgttagtgctaagttgactcagtagcgtggcacttttcccagataggaacctgtaggaaggagtgagctacgtgtcagaggaactgttgcaccgtgtggctctgcacgaaagactcttctctaggatgaagacgagaggaagcccagccagcgagggcccagaacactggttgggggatcctctgccgcgctttgccacagccgacactctgcctcctaggttctctattttcctgtttccttctttcttctgcttgcccccgagtctcaaagacagacaccagcatatcctctgactgccctctgttgttgcaaaagccagatctctctcacatctctctgattccctgcaggggttaaagaccagagatttttactgggaaaacttccctttcagttggaaacaaaggagggaaggaagagaggcattctcctgctgggaaggtgtgtctaagccagatcctggtggtggggagcacccagctcttgttcctgagggtgtggagcatgtgacattctaacatccacctcaggaaatccaggcagtcgctgactttgtttggggagcagacaggggtcattgcccccatgtgcttatctctgccgtgttttatgaaaaaagtgaatccgttaattcccacactagcttagtgatctgaatgatgttgaacaagcattatcaaagaattccacgatgagaagcaaagggaggagagtggaacttttgaaaacctgtatttcattgtctggctatccgtgtattgtttatcatccatccatccacccatatatctttttatctaagtctgtatacttatccatccatccacacacccacccattcatccatccatccatctatccatccttccacccacccactccttttccatctctatccacccaaccatctatccatccatttgtctgtccacccatccatccatccatctatccatccatccatccatccatctacccacccacccacccctgtctatctctatggtctacctcttatgtatgtatatacacatctgtttttccatttatccttatctatcatctgtccaagctctcatttagatatttgtatatccatctctctgtccatctttttatctctatgatatttttatctgtctacctacctatcatctatatatttacctgtcatccgtcattcatgtatcagtctatctacttcctattcatgtgtctttctgtttatccaactgttaatcattgatctttctatgtaactgtctacctacttacctatccatctgtgaatcatctctctacctattcatctgtctgcttttctatatatctatctacctattcatctatcaatcatctatccacctacctacctacctatccatctatctctacctgtctgtctggctatcaaacatctatctacctacctacccgctggtcttttgaattttcctttactctttgctgagacatgcctgcaaatcacatagaatcaaacttctccatgtgcacctgagcccatgacgtcctaggcaaacccaaaaggttaaaaataacttaggcaggctgggcgcagtggctcaagcctgcagttccagcactttgggaggccctgaggttgggagttcgagaccagcctgaccaacgtggagaaaccctgttcctactaaaaatacaaaattagctgggcatggtggcacatgtttttaatcccagctactcaggaggcagaggcaggagaattgcttgaacctgggaggtggaggctgcagtgagctgagatcccacctcgccattgcactgtagcctgggcaacgagcgaaattcccgtatcaaaaacaaaacaaaacaaaacaaaaaacgcatattgattggcatccacccagggaaaagcaccacattttccctctatgataacaccgaccacacgagggcagcattgcctaaggatcattcattgtatgctggggtctgaagagtgaggtgcatgtgcctcaaattttattggtgattggatagaatagcctgttattagaatgcaatatactattagaacataatattgttacaatataacaaaattattagaatataattaaaacaaaatgttagtctcagggtacgctgaagttaaaatacataaaaataaatttaaaaagaaaagaatattacagtcagaactatattggaattattatataaagttatcagaattgttaatgggctatagtatattagaatatttaaatatattagaatacaatagaatggaaaataacctaattataatatatcattaggctaattgaaaattaatattccaggtgtggtggctcacacatatagtcccagcactttgggaggccgaggctggcggatcacctgagttcaggggtttgagaccagcctggccaacatggtgaaaccccatgtgtactaaaaatcaaaaaatactagccaggcgtggtggtagaagcctgtaatcccagctatttgggaagctgcagcaggagaatcacttgaacctgggagtgggatgttgcagtgagctgagctcgcgccagtgcactccagcctgggcaacagaatgacacgtgtgtctcaataaaaaagaataattaaataaataaacatctcccaatctaaagcccagcctgctgtcctgtgcattttatgagacagggagctgttgattcagagtaagcctttttttattttccgttttcctaattagaatctatttctgggtgaattttttcccctatttctcagcaaccttgtgtctctttgcacaggtgggttttgtaagagtggcaagcctcgccaaccccaactctccccaggcatttctgggctctccctccactctcgctggcctgagctcttgccttgacggagatgcaggatacagctttctcacagtctcctgcatctcctgcctgcagtaccttttcgttgaagcagctgcaggtgtcttgtctatgtgtgtccctcttctcttgagagcccacatgtagcttcctggatgactgaagtagaattggaggctcgttatcgtgaggttctgagacagtctgtctgtgggttgtccacccgccttagacaacagcctcacccctccttgtcttcccactgctttttaaacatgccaggaagcctgacctgtccccctgcctatgggtgtccctggggctggccctttctcttccactgcacatgttgcgagctcacctgttacttgctcccagagccctctggggctcctcctgttctcctgggccatgccctgtccgatcagcccatctgttttctttatactgcttagcagctctgaaaccaacttgattttgtatgtgttgactgcctctgagagcaatgctcccaaactgctctcctcacctccttgaacccggaaacttttggtggctggagggagggcgctgctgcacacataagtggagctggcctgcagtcagagtcctcctgctcccttcgcagcccgtgtctgcacctttcctatcgcagctcgatttgctggattcccactcttagcaggatcaagtgaggctgtgccttctctgttttattgctttaactgattatctcaatcttccactaagcacagagaaaaccatctatgtggtaaaatctttcatgtgattaggaaggagatcatatcataatgcagattttattttcacataatgagacatgtttaggtcagatgaaaattgcgtggcacgttctggaacaaaatcactcgtgcactttccaaggcccgagctcagctctgatttctcccatcatgttctcttttctcatccatttccatgtttgtgttctcccagagtgtttaactcaaaagttaggtaaaggctggacatggtggctcaaatgcctgtcatcccagcacttgaggaagctgagacacaaggattgcttgaggccaagagttcaagaccagtctgggccacatactgaggccccattgctacaaaaaataaaaataaaactagcttggtgtggtagtatgtgcctgtagtcccagctctgcagtaggctgaggtgggaggattgtttcagcccaggaagtcgaggctgcagtgacctgagattccagcagtgcacgtcagcttgggagacagagcaagaccctgtgtcagaaaaaggaaaaataaaatcagcaaaagcatcaagaacaaaacacagggacacacaagacatacagcagagtgcagggtaagagaaagcccccagggtgtcttgtcttagttatgacagcagtgattctcaagtggcatcccagaggactatggggttcctgaagtgtgtttcagcagatgagtgagatcatttttccaacgacagatctgaatagtgatgaattttcttcataggaacaaactaagacaatacaacatagcacaaagggtgcagaagattttagagaaggtggactctgtctgcaatggagcctcttccacggggagcattaggcattgtgcagtgggttctcaaacatgttggccttgggaccccttcagcacacagctcaaagttattaacaacccgcagaactttcatttctgtgtgttatagttgtctacgctgactgcatttgaaattaaagtgggactgaaatataaataaatagaatacataaataatatatatgagaagttaaatgatagtcgcagaggtgaatataaatagcttttttaaatgaaaaaataaatacgtgtaaccacactttgtagaactaagaccattcaggttgggcatggaagctcacgcctctaatcccagcactttaggcggctgaggcaggaggatcacttgagccagcagttggaggccagtctgggcaacatagccagacctcatatctacaaacaataaaatgaaataaataaacaattagctgggcatggtgatgcatgcctatgaccccagtactttgggaggctgaggcgggaggatcactgaggctgggaggtcgaggctgcagtgagctgtggtctcgtcactgcactccagcctgggcgacagagagaccctgtctctaaaaagagagaaaacattcgtgaggaggttggttgtattttctgtgttttgtgaatctctttagtgtctagctttcacaagggctgctggcctctcctccctctgtctgcagcctgtctgctgtgctgcgtggtgtttagttgaggcataggagaaaagttcatcactattcaaaactggagtcagaaaaacgacctcagccatccctaaactgaggtcaggaagccaccctgggactccactttgagggccactgctgtgatgcccaagtcaacatgcccggggctatattttcaccctccactctgccccaaccctcacacgccccagtgcttgctccttccactttatctggccctcgagtttccctttctcatctgccacctcagccacactggtttatctgaggagcacagattttatatttatttattattattattattttttggagagagtctcactctgttgcccaggctggagtgcagtgctgtgatcttggctcactgcaacccccatctcccgggttcaagcgattctcctgcttcagcctcccaagtgggtaggattactggcatatgtcagcatgcttagctaatttttgtatttttagtagagactgggtttcaccatgttggccagatgtctcgaactcctgacctcaagtgatccacctgccttggccaatcttccaaagtgcggagattacagccatgagccactgtgcccagcctagattttagtttttagtctgaaggtatcgggacaggaatctttgaggaagaagtcaaggtgggatgaaattctagtgacggtttttttcttttctctaaaaatctctgccttccttttcttgcaggcatttccaaagcacgtgtcttccaatgccagccctggtcttcagaactggggcaggtagtgtgtcagctgatagtttaggagggtgtttttccagctgaggtctctgagtaggagacctcctctcaacaccacctctgccaggaccatctattttatgggaagatgtagataggtggatgattgcattaaaattttatgggcaaatgatagaggtagtatggtacaattggcaagaatttttttttttcttttttttttttttcagacagtcttgctctgtcgcccagggagaagtgcagtggtgcagtcacagcttgctgcagccaccacctcctggctcaagtgatcctcctgcttctgcctcctgagtagctgggatgacaggcacacaccaccatgcctgactgattttttaaaaatttttttgtagagatagggtcttgctatgttactcaggctagtttcgaattcctgggctcaaggaatccacccacctcagcctcccaaagtgctgggattacagacatgagccactgcacccagcaattttttcttttgagacagggtcttgttctgtgtccatacttgagttcagtggtgcaatcatagctcactgaagcctctacctcctgggctcaagtgatcctcctgcctcagtttcttgggaccacagaaggctgtaggtgggaacacaggcacacagcagcacatccagctaaattttaaattttttgtagagatgaggtctcattgtgttgtcaggctggtctcgaactcctgggctcaagcaattctcctgccttgggctctcaaagtgctgggattacaggcacgaaccactgtgcccagtgtttttttcttttgagacagggtctcactctgtcgcccagtctggagtacagtggcacaatcatagctcactgaagccttgacctcctgggctcaagggattctcctgcttcagcctcctgagtagctgggaccacaggtgcacaccactacatccagctagtttttaaattttttgtagagacaaggtcttctctattgtccaggctggtcttgaactcctgggctcaagcagtcctcccgcgttggcctccccaaatgctgggatgacaggtgtgagccactgtgcctagcctgggcatgaatttttcaggcaaaaatcttgagcttgcattcatgctgattagcagatagtccttgcaagtgtagctgtcaccacagatcagtttaacttgcttaataatgccaaatgccgtataatgagaatttattctccgcttggtaagaattggaagcagtctgtatgtttagagacagaaatttggagggtttcagagggcactgcccaggcgtccgggggagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagagataccctattgggaaactcaccttcatgctaaagtgcaagacgagcaactgaaatgttatttaagacggaagaaatgctatgttagggccacgtcacacatacctaatcatttacctttctctggtaactttcatttcctcatgtaaccctcccccacttctctgtcacctctcccattgatttccatttttgtacttcatatttctcctctttgtttttctttgaatttttcttcactgcagtgtattggacagttcacatgtgtagttcgacgtatgaatgtcctgacgctgcagttagaaactatcacagactggaaggtttaaacaagagaactttatcctctcttagtcctggagaccagaaatttgagatcaaagtatctcaggactgtgctccaaggaaggatcctttctgcctctgccagctcctggggctccaggcatccctggacttgtggccgcatcactacagtctctgcctctgtccccatgtggccttctcctctgtgtgtgtgcctcctcttcagtcccttatgacaatacttgtcattggatttggacctaccctattccaggatgatttcgtctgaagctcctcaagttaattctatctgcaaagaccctatttcccaataaggtcccattcataggttgttggggcaggatcacagatatatctttttggagacctctcattccacccactccattgaatttcattaaggtcaggaagtgatttggaagctacaagagaattaattttgctctctggcatttctgatcatcaatgagggtatcatttgaaagctccattttataaggtatttctattgcttgaatacctggattagagtatttaagtcaaaagaagctaaatagaaagcataactttgaatcagtatgagtctctgtcctgggcgatatcagaaaatctcagaagtataacttgtgcttcggacatgtagggatctagtatacacttactggttgatgatatggtttggcttcgtgtccctacccaaatctcatgtttaaaagtaatccccagtgttggaggcgggacctggtgagaggtggttggatcatgggagtggtttccgacattttagcaacattgccctagtattgtttcatgatagagttctcaggagatctgatggttttaaagtgtagtacttcctcctttgcttgctgttgctcatctgccgccatgtaaatatggccttgcttctcctttgccttcagccatgattgtaagtttcctgaggcctccccagccatgcgaaactgtgagtcagttaaatcttttttctttataaattacacagtctcaggtagttcgtcgtaggagactgaaaatggactaatacagttgacttctagattttcttggatttagcttggtctttgcagttttaagtattttttttagtttatttaacatatttttaaaatttcaaggtattactaagtctgctggtttcttcagcaggactacagtagttttactacagtcgacagagcgtagtatgacaatcttgtttttacacaggtaccactatcttccaggctgtcttttgtatttccatctttcttctggtctctggggatcagtaaatggttttctttgggtaatgagatttggtcagctttgcagaccacccagtctcagttacaagtatagactctgctcctgcacattaaaagtggtcatatagtgagaccacatcccaacagaaagtaaaaaattagccaggcatggtggcacacacctgtggtctctgctacatgggagtttgaggtgggaggatggcctcctgggggaggtcaaggctacagtgagctatgattgcaccaccgcactccagcctgggtgacagagtcaaaccctgtcgcaaaaaaaagaaatttttgataaagtataactggaggctctttcattcggcctgtacacattgtgtgccacctactgttctgtgaatgaggaatataaagaaattcactgatgggtgtggtggctcacatcttgtagtcctagtatttgggaaggttgaagtgggaagactgcacaagcccaagagtttgagaccagcctgggcaacatagtgagatctcatctttaccaaaaattaaaaacaaacaaacaaacaaaaaacagcctggcatggtggtgtgaacctgtaaacccagctgctcaggaggctgaggtaggagcatagcttgagccctgtaggtcaaggttcagtgcagtgagccaggatcacgctgcagtactccagcctgggggcaacagagcaagaccttgtctcaaaaaaaaaggacttcactgacgttcagttgcagtttattgtgggtgccttatagtgctgtgcaagcagggtcagtactgggctctccaaggcaggacatatcggctattgcttgtgctgtagactgaaggaagcctcgagaaaggtgtcctgttcttggccatagtggcgtattcaccactataaactttactttaacaattactttatatttgatttcatttctatttatttatttatttactccgtctcactctgtcacccaggctggagtgcagtggtgcaatttcatctcactgcaacctctgcaagtgtcctgttcttggccatagtggcgtattcaccactataaactttactttaacaattactttatatttgatttcatttctatttatttatttatttactccgtctcactctgtcacccaggctggagtgcagtggtacaatctcagctcgctgaaacctctgcctcccaggtacaagtgattttcctgcctcagcctcccaagtagctgagattacaagcacccacaaccatgcccagctgatttttgtatttttagtagagacagctttcactgtgttggccaagatggtcttgaactccttacctcaagtgacctgcttgccttggtctctcagagtgctgggattataggcatgagcgacagtgcctggcctgtattgtattgtactgtactgtactctactgtactgtactgcactgcactgcactgcattgcactgcattgtattatttgacttgtttaaaatactttattttattttgttttgtattgtattgtagacaaggtctcactcttatcacccaggctggagtgtggtggtgtgatcacagctcactgcagccttgacctcctgtgctcaggtgatcctcccacctaagccttccaagtggctgggaccacacatgtataccaccacacccagctaattttttttttttttaagactgggttgtgccctatttcccaagcttattttattttttaaattgatacataataattgtacatattcatggggtacacagtgatgctttgatacgaagaatggagtaatcagatcagagtaattagcatatccatcatctcaatcatttaccatttatttgtgttaggaacattcagtatcctctttctgtctgtttgaaactatacgacatgttattgctaattatagtcaccctacagggctatagaacactggaacatattcatcctatctggttgtaattttatatcctttaacaaagcactccctgtctctcatgtcttcccttcccagcctctagtatcctctgttcttctttatccttttaggagatgagctttttttaagcttccacgtatgagtaaacagaagtgctgtttaatgttcttttcctggcttatttcacctaacataacatcctccagtttcatgcatgttgctgccaatcagaggattgtattccttttcatggccgaatagtattctgtgtgtagataccaccttttctttacctgtctgctcatctgttgatgggcacctacgttgattccctatgttggctgttgtgaatagtgctgtggtaaacatgggcatgccgatgtctctccagtatcatgacttcctttcttttgaacaaatacctagtaatgtgatggctgggtcatacgccagccatctattatactccataatagatgggagttctatttctagtttttcgaggaacctccatactcttctttatggtggctctactagtatacattcccatcaacattgcataagagttcccttttctgccaggcacagtggctcatgttggtaatcctagctatttgggagaccaagctgggtggatcacttgagcccaggactttgagaccagcctaggcaacatggtgaaatcccacctctacaaaaaaaatacagaaattacctggtatggtggtgggtgccacctactgtggtcccagctacttggaaggctgaggcagatggatcgcttgagcctgggaggtggaggttgcagcaagctgagattgcaccgctgcactcccacctggttgatagagcaagaccctgtctcaaaaaaaaaaaaaaaaaaaaaagagttcccttttcttcacatcgtcaccagcattgttatttttgtgtgtatacgtttttttttttttgttttttgtttttgtttttgtttttttttagacagagtttcactcttgtcacccaggctggagtgcagtggcacaatcttggctcactacaatgtccatctccagggattcaagtgattctcttgcctcaaccttccaagtagctgggactacaggcgctgaccaccacacttggctaatttttgtatttttagtagagacggggtttcactgttggccaggctgatctcaaatcctgacctcaggtgatccacccctttcagcctcccaaagtgctgggattacagtgtctttttgataatagccatcttaactgggttgagatgattgacacctcattgagtttttgatttgcatttccctgatgattagtgacgttgagcatttttttcatatacatgttggccttttccatgtattcttttgagaaatgcctgtgaagaccacctgtccattttttaattggagtgcttatctttttgctgttgaaacgtttgagttccatgcttggtcatggtgatggattcaccctggtaaccttgagagagcatttctatccattgtttagtgctcagttaaggaatgggctggtggcccctctgaataagatgcccaaaggagttaccttctgctcagcagatgtctctcaaatggtctttatattctctccaagggagcttcccctgcatcggactgtggcacccagtgccttgcctcttagaaccatctgactattacgtgctttcagatcgtgacaacttcaatgtgtggggaagaacatgtgaaataaattatcttctgcctgtgtgaagcagaaatagctatcgttacaaagcagggatttttttccatgcttactccccactaaaaatacatgtttgtttttctaacaggtttcctccattttttgatgacaacccgtttggcatttatcagaaaattcttgcaggcaaactatatttccccagacatttggatttccatgtaaagtaagtaaaccgtttgcctcatcatgaggtgtgtttatttttaaagtgtctaaaatcaccatgaaagcacgcactcagcaggataccatattgtgttattaaatgtgctgcgcataaactattttggacagttgtcttttccacaagaaaagaaaaagattttcagtattctactttaatgatagcttcacattttaatgagtcttggctgtattgtgttcttttggtggtatgttatatttaaaatgagccaattaatgagtttgtcatcgtattttataagagagcagttttgcaatttgacaagaaggatcctcctaattctgtggcttgcagagctgttgatgggtttaccagagttttatcctttctctcctgcttaaattatgctcagcctctaagtcctttttaacatcagcattttcagttctgagcatgttgctttaagaacatttacagttgctagatattggcaactttggatgcacattttattaaggttgtggcagtagggagaaaagacattttgttaaatataagaatgcttttggttttctggctaccttacccaatctggtcaactggtagccatttttactgtaataagcactgatttctgtttgtttcactgtatttttcagatgagttgatgggcgcaccagccccctgggcacaaactagagctaaatgcatctagttgagaattaaacttttcttttccatggcctattttcttatgagctggtggtagttcagttcagagaagacttatttcagggtgatggaccaggttgttttgaatatgccccttgtggggctactggctacgttgagttgagtttcttggtggcgaatgcaccccatcctaaccagaggtcctttgtctgaacagaagataaggtcgtgttttattggcttgagcatgtgttgtgtttgacacaataagaggcaggctttaaaagactttagcaagaaaatgaggctctgcttaacaatgagtcacctagaagggacaccctgtccagtgaatggtaagacagggaggtgtcaggggaaacagcacctcagaagccaactgctctggaaggaaatagaaaggattatatagaacctctctctcaggctccaaatcccatctgagttgagtgacattatatcaagtggatggcaaagcacttttatgatcgagtttggccaggtgaggtgcttatgcctgtaatcccagcacttcaggagcctgaggtaggaggatttgttggggccaatagtttgaggtcagcctggacaatgtagcaacaccccatgtctacaaaaaattaaaaaattagccggacatggtagcaggtgcctgtggtccagctactagagaggctgaggtgggaggactgcttgagcccaggaagtcgaggctgcagtgacctgtgattgcaccactacactccagactggataaaacagtgaaaccctgtctcaaaaaaaaaaattaaaattaaaaaaaatgtgtgtgtgtgtgtgtgtgtgtatatacatgtatgtatatatatacacacacacacacacacacaaacacacagagaggtttccaatgttctgtggaaacaacaacaaaaaagggaattacagaagtagaacaaaccagaagcgtaatcaaagtccagtttcttgccacttttccttctttctctcctagagagtagggaaccatcagtgaccatcttggtattgtctaatctaacgtgcctgtctttatgcagctcccagccccttccagtgttccccacgatgcccctgtctctttacatacccagtgcgggtccaccaagagcagaaacagtggtagttgagtaaaacttcacttctttccattatttgttaaatcttatcaaattggctgagaagcaaggcctcaatgactcatatctttcctttttttggtagagatgggtatgggggagtcttgttgcattacccaggctgatcttgaactccttggctcaagtgatcctcctgccttttcctccccaagtgtgagccactgcacctggccttagtgacacatttcttatgcaaattgctgtccctggttgtctgtgatgctagaattttgattctcagcttttaaagtcatgctgattcctgcagcttttaacatttgactgggtaaacatattgcctgggcatatggcacgtcagaattgacattccttatagaaataaatgtcatttaaaagaaagaaaaacaccaaaacaaagctttaggacttgttgccaattcagcagaagttttatctgccagtgtttttttcatgcctgaaagtatctggatctgagaggagccagctgttgccaggatcataaataaagtttagaattttggctgtggtgaatcaaaagagtgccagcagatatattgctatcctgaggtcaagggacccatctacagctgtggacacttctattgttcctttatagggctttgcctttttggggggccccttctcatccacagtgtttgctttctaaacttctttacaagaatttgctttggtattttactttttcttttaaagagacgggtgtcttgctctgtcacccaggctggagtgcagtggcacaatcatagctcacttctgccccaatgtcctgggctcaaatgatgctcccacctcagcctcctgagtagctggtgctacaggcacacaccaccatgcctcactaatgttttgattttttgtagagatggggggtcttactatgttacccacactagtctcaaactcttggtctcaactgatcttgccactttagcctcctgcatagctgggattacaagccactgtgccctgtattttaaataaatcttcattttcttagatgccaaacaccaaaagaaaaacaaaaaacaaaaaacaaggtcatcttcttacatgccagacaccaaaaacaaaacaaaacaaacaacaacaacaacagcaacaacaaaatgaagtttattaaggtgatccccaaaacatcctgaaataaacatggggcttttcttcccctataatttacacatcactgcctgccccattagcacacatacttaaaagctgattggattggaattataaggaaacaagtttatttaaaatataaaagcataaagaaatctgtcttataatcccactccagtcagctttaagtttagtgtgtgcactaacggggcagacagtggtgtaaattttatgggggaaaaaaagccccatatttatttgggactgttttgggggtatagtgtttgatgaccttgatattttttggcaaggggcagcatgtcaaaataatgaaggagaaactcggtaagtactgtaaaggtttctaacttttcagtgatgtttatattccccaccctgctcaaagcttttcagccttacaatggttacaaaatcccagccatagcgggagggagacagatggtctctgagttttactttgagacagagaagcagtgaagtgtgacaagcatctcatcgtaattcagaaagcacggcagcaggaaactctggttaaatttccaatcagatgggactggtgagattcacagtctagatggtggagtctgaccctgggacatcacctggcttgcagagactccacagtctgtcacagaacccaggagtggcccagtccaagttcatgctacttaccctggggcatagtttatgccgggagagcctagatgctaacaccgcagtcataggtattggattgttttgggggacttcaatatattacattattatatcatattatgtacattattatacataatatactctgtgtattatatgtgtacacacagacacacatgatcatttctaattccataaatatgcatcttagaactcacctaatctcctggaagtcttcaacatcatctccaactacccatcctaattgaagcagcttgctgtttttcttttgttttgttttgagacaaagtctcactctattgcccaggctggagtgtagtggtgccgtctcagctccttgcaaccttcacctcctgggtccaagcagttcttgtgtctcagcctgccaagtagctgggaccacaggcaagcatcagcatgcccagctaaatttttttgttttttgtttttttaaatagaggtggggtttcaccgtgttggccatgctggtctcaaactcctgacgtcaagtgatccatgcccgtcgatctcccaaaatgttgggagatctcccctcccctcaagcaaggttaatagagcaataacaatgtataagttattactcattattttgtttacttatttattttattttttaaacagttttacggagagtgaattcacacgccatgccatttacccatctaaaatgtgcaatttggtggcttttagtatacacacaatttgtacagccacccccgtggttaatcttagaacgtcttcatcagctcaaaaaaagaaaccctgcacccttcagctatcactgttctaatctttcctcctctcttgccctaagccagtggtccccaacctttttggcaccagggactagtttcgtggaagacagtttttccacggagcatgcagcctagatcccttacatgtgcagttgacagtagggtgtgtgcacctatgtgaatctaatatggctgatctgacaggaagtgcaactcaggtggtaatgcaaatgatggggtgtggctgtaaatacagatgatgcttcactcatttacctgctgctcacctcctgctgtgcggcccattttggttcctaacaggccatggactgctactggtccatggccctggggttggggacccctaccctaagcaaccactaatctactgacttctctgtacagttctatattctgggctctgctaaaaatggaattgtacaaaatataatgttttgtgtctggcctgtttcactgagcatgatgttttcaagtttcatccatgctgtagcctgtgtcagagcttccttccttttcatggctgtatagtattctatttgtgtaggtggacctcattttatttatccattcatccatggatggacgcctgggctgtttccacctttggcttttgtcagtagttctgccatggacatgggtgtatatatttttatgtatgtaagcaatgattttagaagttatacatcaggtatgatttctacaaactttttatatggaggcaaatacataattgacaaacagactgttccataaatagtatcatactttatatgcatgttttggcattcctggatttgatagaattcatggacgttttgtaggctgtttctagctctggacaacattggagggacttatacatggagggtcttccatattcatcttgaccctgtaaattccattttggagagacacagtacaccagggtgtgagggttgaaccacttggctctcttgggttcatgttgcatcctctgtgtggtttgggagtctccagtgactgccataacaactgaccacaaacaaggggcttaaacaacaggaattgatgctctcccagtcccagtcgtggaagccaggactctgagatcagatgtctcaggcctccagaggctctaggggaggatcttttctgcctctcccagctcctaggggctccaagcatccctgggcttgtggacacatcgctctagtctctgcctccgcctccatgtagtcttctcctctgggtctgtgtcttctgttctctctttcagaagtacacctgtcattgggtttagggccaccctaatgcaggattatctcatcttaagagccttcccttaattacatttacaaagaccctatttgcatgtagggttccattgccgggtattgggagtcaggacatcggcatatattttgggggccactgcccagtgtgtaataattgtttccacttcctgctagaggctctagggggggatccttcctgcctctcccagctcctgggggctccaggcatccctgggcttgtggccacaccactgcagtctccacctccattttcacatggccttctcctctatgtttgtgtctcctcctctgtctcttatgaggacacctgtcactggatttagggcccacccttctccaggatgatgtcatctcaagaaccttaatttagttacatctgcaaagaccctatttccaaataaagtgatattcacaggcactgggggataggatgtgcacatatctttttgagggacattgtttaccgtataacagtagtcaagcctctgtcctttacattatttgcagacagcaaccgataccttcaggtctccaaggagcctgtccagccaggttgcacgttgtggactcatctgtgccacggctctacataagattggacgggtcctgttttaatgccatagccatttagaaaagagctgggtctcttgctgggactgcagggaatcacagatgacccatatctagaatatgctgggagtggtgtagtgaccatcataggtaccctccaaggggaaagaacaagtttcctcatcaaaggaattggggaaaagctcacaaactctcaagctaggtcttaaagtctagttaaatcttcctgatagggagataaactgaaaaagacttaagaaaacactgactttattttattttatttttgtaaaattaacaaataaaaatggttttatttatcatgtacaacatgaagttttgaaatatgtacccattgaacaatgggtccattgagttcattaacatatgcattacctcacataattaccatttatttgtggtgagaaaacttaagatctaatctaccctttgaaaaaatttgtttttaagagatggggtctcaatgtgttgcccaggctggtctcaacttctgggctcaagtgatctgcccgcctcagcctcacaaagtgctaggattacaggcaagagccactgcacccagcaagatctactcttccagagattcttgagaatacatcattagttatagtcaccgagctgtgcaagccactgactgaacttgttcctcctgtctctctcactttgtctcttttgaccaatgacttcccatctcagccccttcccagcccctggtatccaccattctactctctgcttctatgagttcaacttttttagatttcccatgtaagtgaggtcagactgtgtttgtctatctgtgcctggcttatttctctctctctttttttgtgtgtgtgagacaatcgtgctctattgcccaggctggagtacagtggtgccatctccgctcactgcaacctcaaaagtttctccttcatcaacctcccgagtagctgggattgcaccacacctggctaatttttgtatttttgggtacggatggggtttcaccatgatggccaggctggtcatgaactcgtgacctcaagtgatctatctgtgtcagcctcccaaagtgttgggattacaggtttgagttaccatgcctggaccttatttctcttaatatactatcctccaggttgatgcatgttttgaaaatgacatttccctccttttacttgctgaatagtactccatggtatatatatcacacattttctttatccactgccctcttgatgggcatgtagcttgattctacatcttggctgttttgacctgctgcaatgagcagagggtgcaaattatatactcatttgttttttctttgggtgtatgcccagtagtgggattgctggagcctacattctatttttaggttctcagggaagaaactgtctgattaaaatggagttatgttcgtgggtagcccctggtctatgggtgccctggagaggaacacttactctttttcctgctgtgaccacctctccactctcagctgcaccaccatcctcagcctgagtgtatcactgcgttctcaggcagttctcatagctgcctgtggcactgccccccatgcccctgactttccccatcaatccctcctcttcaccaggaagaagggtttgtcattcatagcctggagccccagggccttaccttggtgctcagaaccttccagtttcctctcatcccgtgcttctcgtctgatgattccctggtcttccccgtgaaccctcatgcagccaggatggatgagccacctgctcctgcacctgtcaccatcgcactttgctgttcttctctctttgcttggcacctcttcattcgggggtctttccttcttctggaaccacatccattctgttgaactccttcatcctctgtggacactgctgtgcccttcacgcttggaaaatccccagcacatgggttcctttttttcttattagctggccttatacacacacatgcattggcacacacatgcattggcacacacagtttatataatataaaatatataaagatttatgtacaaatttatataatataaagggtatctatatacacacattgcatttttatacacttcatatacaaaccagcatacaaaaaggtcaaaggaatatagatttatctgtacattatataaatagataattgtgcattatgtagatttatctataatttatatatttatatattgatatttatatatctgtaaatatatagtgtacatacttagaaatatgtaaatatatttatatttagaaatataaataatatataatataatacatatataagtataaatatatagatatataatataggtatatagatatagagtgtgatgctgggtgtggtggctcacacctgtaatcccaggacttcaggagaccaaggcagaaggattgtttgatcctgggagttccagaccagtgcgggcaacaacagtgaggccccatctctacacagtatacaaaaattagctaggcatggtggtgcatgcctgtaacccagctacttggaaggctgaggcacgagaattgcttgaactcagtaggggtaggttgcagtgagacaagatggcaccattgcactccagcctggatgacagagtgaaactgcatcttaaaaaaaaaaaaaaaaagtagaatatagtaaatagataaatcagggaaacagtcatttattatcattaccaactattaggtgctgcagataacgtatgtgttagactgttacatggctggcagtgcaacaggagggatgctctgtcctgtggttacaatggccatgatgtcactaggggataggagtttttaagatcattataatcttatgggagcaccactgtatatgacattcattgttgactgaagtgtcattttgaggcccatgactgtagacacacacatacacacaatttttttttttttaagacaaggttttgctctgtcacccaggctggagtgcagttgtgtaatcacagcttattgcagccttgacctcctagactcaagtgatcctcccacctcagcctcccaaatagctgggactacatgcatgcaccaccatgcctggctaatttttaatatttttttgtaaagaccaagtttgactttgttgcccaggttagtctcaaagccctgggctcaagcattcctcctgccttggcctcccaagatgctggaatataaatgtaagccactgctcccaccccccacacactttatatcatacacacacagacacacacacactaatctggatacttatgtgtatttaaaagtatgtgtacatataaatatatgtgtgtataaatgtgtgtatgtgtatacgtacgtgtatatatatgtatgtgtatatattgtgtgtatgtatataagtatgtgtgtatataaatatatattaacgtatatgcatataagtatgtgtatatataaatgtatgtgtgtatattaacgtgtgtatgcatataagtatttgtatatataaatatgtgtatatattaacgtgtgtatgcgtataagtatgtgtatatatacatatatatgtatatattaatgtgtgtatgtatataagtatgtgtatatataaatatatatgtgtgtatataaatatatgtgtttatttattactatgtatgcatgtgagtatacccagacacacacatcctttagtatccaaattagaattttatctgatggataaaatttgttttattttattctcttattttattcacagcactcttatttattcttattcacaacattgctgaaggtaaaactcaacagctattgtttgttgcctgacttagctatagatcaaaaatacctgttttgcaataagaaaagaaaaaattgtcaaaacaactggatgggaaaacaatagaaaaaattcacattttttccttttgaagatatggtcgtggacgtagtcctctttaaggataagaaatttaaaactacagaaatgctaactgatagacgtgttaaattcagacgtactggcttctgtttcatggaacctatgtttatttcttctgctgtcccacatttaattgataacaacatcactacaagtataagaaaaggaagcagagtgaggtttacggatgagcacttgggagggatttcagaggtcgtgatggccacagtgtgagccagcgatgcctggtgctacccttgagcatgaagcaggccgacttgaacacaccttgttaattgccaggccgtgcaatgtcgttcctaaggtctcttaaactggacatccttggtttgagttcccagtcttgttatttacttgctgggtcctacggagcaaattaacatcattccttgaaccctagtttctatgtctgtaaaatactgagtaagtttgccaagacgaaaacaggagacaaactgagaaattactggctgttcaattttatgtcgagagatggaatcgtatttacctttttcgtctttggtccggaatgcaaatgcattgcacaggagcagaatgactggatttgtttctgcgacaaaaaagggcaaacaaaacactaacagctttgcttgcaggttttcctggcagctcaccctccaggcacagttctccaaaatgcagcaaacttggtctgtttgtttcaatactaaaataatgtagagattatttggggtatttttctttcctgccctgtcaaaattctgtacactgacgacacgtgttgtttcttttgaagaacggggcgaatgatgtgaaacaccatcggtggttccgctccgtggactggaaagctgttccgcagagaaaactgaaggtacaacatgtatcagtgggtgactcagtatgcccgagctctcttatgaacagggactgcctctgaatcctgggacttctttattgatgactgagacgtaattaatttatgtaacacaactctttgtctaaaaccattcataagccaagttacccactctatgagtgtcttagtgctaattagctcccacaaaggggtgaggacatgtaatgtttgtctttccgtgtctggcttattttacttaacagatggatctcagttccatccatgttgctgcaaataacaagatttcattattttttttttatagcctagtagtattctaccatgtctgtataccacattttttctttcttgtttttttttttttttttttttttttttttaagaattgggttctcactatgttgcccaggctgatcagaactcctggtctcaggtgattctcccacctcggcctcccaaagtgcagggatgacaggcaggagccaccacacccagtcatatatcatatgttctttgtccattcatccatggatggacactcgtcccagattttgaagcagattttagaagacctggcccgattcctgactagctctgtgactagtgaatcccactccgtcctctagtggaaagtggtaagcaggattacagagataagcaagtgtctagcaccatggtcattgttcagtgatggtggtgttacatggagaatattctttggaacatttctggccaaactgcacatctggctttttgtctgggtgcagtggctcactcctataattgcagcacttttagaggccagtttgggcagatcgctcgaactcaggcgtttaagactggcctgagcaatacggtgaaatcccatctctacaaaaaatacaaaaattagccaggcgtggtggcatatgcttgtcttcccaacttcttgggaggctgaggcatgagaattgcttgattccaggaggtggaggttgcagtgagctgagattgtgccactgccctgcagcctgggtgacagagctggatcccatttcaaaaaaaaaaaaaccctgcaatccgagcactttgggaggcctcagtgggcagatcacgaggtcaagagatcgagaccatcctggccaacatggtgaaaccctgtctttactaaaaatacaaaaattaactgggcatggtggtgcatgctggtagtcccagctacttcagaggctgaggaaggagaattgcttgaacctggcatgcggagattgcagtgagctgaaatcatgccactgcactccagcctggtgacagagcgaaactccatctcaaaaaaaaaaaaatctggcatttttatcaatatgtaatacttgtccattttataaatgagtagactgcctcagagaagttaagcagtgtgttgaaggttacataggtgctaagcggtgtaactatcacatgtacatatttatgggtgtacatgttatatttcaacacacgcatagaatgtattggccaggcatactggtttatgcctgtaatcccagcactttcggaggctaaggctggtggatcatgaggtcaggagttcaagaccagctgggccacgatggtgaaacaccgtgtctactaaaaatacaaaagttagctgagcatggtggcacttgccggtaatcccagctactctggaggctgaggcagagaattccttgaatgcaggcattagaaattgcagtgagccgagatcgcaccactgcactccagcctgggcgacagagcgagactccatctaaaaaaaaggaggaaaaaaaaaaagaaaaaaaaatgtgtaatgatcaactaagggtaatcagggtatccatcagctcaaacattatcatttttatgggttgggaatattgcaaatcttctagctattctgaaatatacaatatattgttgttaactctggccacccaactatgctgtcaaacaatagaacttactccttttatctatcggaatgtttgtaccctttagccaagagttcttcatttccccttcatcccccacccacacacccttcccactctctggtaatcatcatgctactgtcaagcttcatgagatcaacatttttagtttccacatgtgagtgggaatgtgcttgtatttctcattctgcatctggcttagtttatttattatttatttttgttttctggaacagcatcttgctctgttgcccaggctggagtgcagtggcacgatcttgctcacagaagcctccacctcctggcttcaagcaattctcatgccttagcctcttgagtagctgggattacagatgcccagctaatttttgtatttttactagagatggggtttcaccatgttggccaggctggtctcaatctcctaacctcaagtgatccatgagccttggtctcccaaagtgatgggattacaggcatgagctgccacacccagcctggcttagtttacttaacataatgatctcccattccattcatggtgctgtaaatgacaggatttcattccattttacggctgaatagtttttcattgtgtgtatggaccacactttctttatccattcatccattggtggacacttaggttgattccatatcttggcttttgtgaacactctgaattgcatatgttactgatgggagtgttcaatggtagtgttttcacctttgcacttcagagtcaaaagaatggagaatgcttagaagtgctaattacctgtcctcagctcagaccagagtctggggctggagcctgggatgatacacttcttttttttttttttgaaatggagtctcactttgttgctcaggctggagtgcagtggagcaatctcaactcactgcaacccccatctcctgggttcaagcgattcttctgccttagcctcccaagtagctgggattacaggtgtgcatcaccacacccagctgattttttttgtagttgtagaagagacggggtttcactatgttggccaggctggtctctaactcatgacctcaaataatccactctccttggcctcccaaagtattgagattacaagcgtgaaccaccgggactgggctgatgcacatcattttgttcacaaagttttaccttttcagatactttattgtattaaattgcattaaaaaaacagtttgaatacattttatctatccacattggtcaaaaaccaagtcaatattaaaacagatatattgccaagtctcccttttaccccctccaagccacctgtaggtaatcatcttttattaaatttttctgtgtatccttctagagtttctttgtgctaataaaaacccacatggatacatgcattcttatttttgccactcatttatacaaatctagagtagcatagtatgtacatgattatagtcttgctttttgcacttgactgtataatttggacctgtctacatacctggctagcttcctttttttttttttaagacaaagtctcactccgttgcccaggctggagttcagtggtgcgatctcggctcactgcaacctccacctcccaggttgaagcgattctcctgcctcagcctcccgagtagccaggattacaggcacccaccactatgcctggctaatttttgtattctcggtagagacagggtttcgagatgttggccgggctggacttgaactcctgacctcaggcgatccgcccaccttggcctcccatagtgctgggattacaggcatgagcccctgcacccagccagcttcctcattttaaaaatactgcattgtattccatcacatgactgtaccatagcttacttaatactatatatgtatatattttgagacaggatctcactctgtctttcaggctggaatgcagtggtgcaatcatggctcacttggagtatcgacctcctgagctcaagcagtcttcccacctcagcctactgagtagttgagactgcaggcacacagcaccacacccagctaattgtttgtattttttgtagagacaggggactccctgtgttccccaggctggtctcaaacttctgaggctcaagcgaccctcctgcctcagcttcttaaagtgttgggattacaggtgtgagtccccacacgcagcctcattcacaatattttaattccaagattgcttcattcataaatgaagggaagacagctttagtgttttgcaaatcattttcatttttaggtacagtgacagaagtaaaggggtatatgcagcgtccaagcgtcctgttcctttctaaccatgccttcatgcttcggccatgtcttatagcctcccatcgtgcccacgatagctggcaacggcgacacttccaacttcgaaacttaccctgagcatgactgggacacagccgcgcccgtgccgcagaaggatttagaaatcttcaagaatttctgaggacgagctcacatctggaaggtatatctttatatttagtaattaccagaaaatgagactggctggaccccacatccaggtgaggctgtgtttactgagtggggcttaacctcatgcacacagaggtcagcagtgaagcagagcaaaggggattgattgcaagggtcagcgaaataaacacagccatgcctgtgactccaggtcagcatgtgaccgtcagaggcatcagcatgacagtccagaatccatgttctgcatgcatcagaacctgcatgtctaaataagaccgctaggtggtttgtgtgtgcctgaatatttgagaagcccagctcctctggtccctgttccagaaaccctgagtgacaggcgagcttccttagaataattaacaagtattttcaaaagtctctttaggtctcctttggttaaaaaataagaagaagaaatgtactctcataggaaatttgctaagcttaattgaagatgactggaaaaggattttgaatctattacttctttgaggctttgaaggtctattatttttttaaataataataatattttttaagaatccctcatgaaatttgctaagctttaatttaagatgactgaaaaagggttttgactgtgttatttccttgggcctttgaaaatctattattagtttttaagtatggattaaaaagagcttccagttactcctcaattctaaactgcttgtatgtctttaactagatctttcttcctgtaacatacaagcaagaaaaataccagtgaagcaaaatattgtcagtgatgtgtctattcattgacatagcttgtttttcccattttgatttccattcccgtaattttcctgtagtcttcccagttatgtgaagtggaaagccaattggctaaccaacaccatttgaaacagacaccaaatgtcacaattgctgactggggagaggaaccaacctgctgaaagatgtggtgaatgagagccctccgtcctgggcaggtgtttacatggatgtaccaagaggaaagctggatacaaattgaaataatagacaaaaaaatgatagaggaataggtggctatgaccttgagaagataacctgtctccatggcatggcttcacctctcagtgtgtgatgaacgcttttacagtggtgactggtttgtattaacatgagagcgtgtaactttaccaacttcataaatgctcatgaaatccatttatgggttttaaaaatcataagatgttcctgaattattttcttctttttgtttctctgctctactctggggcttacattttagctgactcgcccataacatcttacaaattgtgtctctccaggaaatctttaaaatgatgtaaagactggtttgctttagtatgaaggacccctagttgataaaccatatatttcctctaatagagaccccttcaagtataaaatttacttaaagaacaaaaaagcttccacttgatggatttttgtctcataatcagtgaatagtttcatcacatactgtccacagctgcgcctactgtccctgaaaaagatttcacacataggtctagcctttctcagtctggtatgtattcttgagaaagcatgtgtaagtattatttttgctaagtggaattatttttatttatttgtttatttttttgagacagagtctcactctgttgctaggctggagtgcagtggcatgatcccggcttactgcaacttccgcctcctgggtttaagtgattctcctgcttcagcctccctagtagctgggactacaggtgcatgcgacaacatccagccaatttttgtacttttaatagagatgtggttttaccatgttggtcaggctggtctcgatccctttacctcatgatgtgcccaccttggcctcccaaagtgctgggattacaggcgcgagccactgtgcccggctggaatcatttttaatatagtttggctagtggtcagggctctgtttaatgaattttattttatttatttatttatttatttattttgagacaaagtcatgctctgttgcccaggctggagtgcggtggcactatcttggctcactgcaacctctgcctcctgggttcaagtaattctcctgcctcagcctcctgagtagctgggtttacaggtgcatgccaccacactaggctaagtttttgtatttttagtagaggtttcaccatgttggccaggctggtgtcaaactactgagctcaggtaatccacccgccttggcctccaaaagtgctgggattacaggtgtgatccactgctcccagcccatatgcaatattttaatctatctcagtaattttatcgaaagtaatttgtacaccaaacacatctctggcattttcagtgaagagagattaggttcaggaattttatgcaggaagatatttcttcatgaaaccaaatcttctcctgtgaataagacaccagttcagatgaatcactgcacttgaaggcagcttagaaactgtgctttaggccgggcgtggtggctcacacctgtaattccagcactttgggaagccgaggtgggcagatcacgaggtcaggagattgagacctccctggccaacgtggtgaaaccccatctctactaaaatacaaaaaattagctgggcatggtggcacacgcctgtagtctcagttactcaggaggctgaggcaggacaatcactggaacccaggaggcagaggttgcagtgagctgagatcacgtcactgcactccagactggcgacagagtgagactcctcaaaaaacaaaacaaaaaaaaccacactatgctttagctgttcatctttgtttgaatcaccctgcatgactttctgaatgtggaggaggaatttaggagaactgactcattatgtcttttattttactttgtaataaaatattttctgtcttgctgtaaggttctctgaggaagcatattgaattagggatcccatttttcttgtgtagttcatctatcggtggataaatttatctatttatagataagcatgtgataggacattctctagactgggtgtggtggctcctacctgtaatactggcagtttgggaggccaaggtgggaggctcatttgaggtcaggagtttgagatcaagcctgggcaacatagtgagaccccatctctacaaaaaataaaaaagccaggcgtggtgatacatacctgttgtcccagctattctagaggctgaggtgggaggctcgcttgggccaggaaagttgaagctgcagtgagctgtgattgtgcctgtactctggcctgggtagcagagttagacttatctcaaaaatgaaaacagggctgggcacagtggctcacacctgtaatcccagcaccttgggaggcggaggtgggcacattatctgaggtcaggagttggagctgagcctggccaatatggtgaaaccctgtctctacaaaaaatacaaaaattagccaggcgtggtggcgggcacctgtaaccccagctactcaggaggctgaggtagcagaatcacttgaagttggaggcggaggttgcagtgagctgagatcgcaccattgtactccgtctcaaacaaaccaaccaaaaaaaccccttacctttaaaacattcttcatttcctttttattggcctctccttttagaattcacgcttatggatccttgcaaaaagaattacaaagggaagttttctttgttatcacttaggaaaaggaaacctttgtattatcattgagatgatgattacaaaattcatccagttactgagcaactcataaaatctttcatcctatttcatgctagaaacaggaagattggaatctgcctggaacaaagaactgcacctaagcagaccagaagcaaaatgtcttcttcacggcctgaggacatttccagttttctctgtacctgtgtgtatagaaatagatcagagcacagttgaaattcatggaactggcattatttaagcaaccagaattccacactgtaggaaggttttgaaaattgtttcgttatagattttatcttatcttttggtgttgtcttggtttttctcatagactttataagtttgaactggacttatttgattataaccacaaattgtgtgtgtgtgtgtgtgtatatatatagaagtcattatggcagatgcacaaattgtgcagtgatgtaaatatacatacttcacagagcctattatttttatttttcaattcagtttctcaaattatcttcccttctcttggggacaacatctgaagggtatgttgcatgcatttttaaaaaaatcatctcatatgcattgtatagtttgggggaataagatatccgggggccgggggtgtctacattcagtatctttagttcttcctacctagtaacttgagactttaaaagaagaaacatggagaagatgtgggagcgaatttattgcaggaatccacaatgactttgaagttgttggagcaatgcattgtattcagaaaacctgtgtcacattaaaaaatttcatctaggctaggtgcagtggcttgttcctgtagtcccagcactctgggaacctgggttgggaggattgcttaaggccaggagtttgagaccagcttgggcaacatagtgaaaccctgtctgtatggaatttacacaaattataaaaattagtcgggtgtcattgtgcatacctgtagtcccagctattcaggagctgtggtaggaggatggcttgagctcaagaggttgaggctgcagtgagccctgattgtgccagtgcactccaggctggacgacagagcaagaccctgtattaaaaaaaaaattcatcctgcacagggaaatggctacctattaaagtcccagttgaaattttttgaaaaaatacacctcccacagttcacaaataacttttaagatcagctcatctataaggctgaccttcatgcagagattttatttcacctttagttttgggaaaagcgagaaacagatgatctataggatgtgagtgggtggcagagtcaaaaggaacctcacctgttcctaatttctccttttaaatattcatgttgagtgtgcctaatactctcctcgacaagtcatgctgttttatgcagaataatccaggcgtgagagtgttctcttgggaaatgactggggagacacctgaaaggagcaacctccagatgttcttccctgggtgttgatgtcatgacagccatacagtgagtttgttctgaaacatctcttgctaaatgtgggtcatgctagacacagcataaactgagggtgtgggttctggctttgtacataactcattttctcccttgctttttctctggaccatcctggctggaaacttggctgtagacatctgaagagggtgcaccttttctctttactgtgactcacctcaaatatggcattgctcaaatctgctgtgtatgaggtcacagggcccagctgtggcaggggtgagtgcattgaagaagtaggttttggagccttccaggaattccttgttgacaacaggggtacactcacacagacctccaagactttcttctccacctcttctttttctcatgccctgccttcatctgtctccttctgcacccagagtaggggtggagtatacccttgccatgtgttagtgaaaatgtgtgcagtgagaagccagttgggtcccctcggctcctaatctcttctcaaaactcagtagctcaggttctctggagccatccggtgcattccttgctattggagctgtttttccaagcaatatctgggaagagatttctccctctagcacttgctacctctcttctgcacacatatcacacatcagtactgtggagagtttctgttaggaaaagccatacatttttaaaaatgtagcaaaatgtcaagggaaatgtaatcagatttggccagagttcgcctacagataagaaggcactgggccaggctcacacctgtaatcctaagtaacactttgggaggctggggcgagaggattgcttgagcccaggagttcaatacctgtctgggaaacacctcatctctacaaaatacaaaaaagttaactgggcatggtggagcatgcctgtagtctcagctactcaggaggctgagatgagaggatcacttgagcctgaggaggtccaggccacagtgatctgagatcacaccattgccctccagcctgggtgacagagtgagaccctgttccaaaaaaaaaaaaaaacccaaaaaacctcaatggctttttgcttttgaaggtggtatgaagagaacgtccactttaaggctttaaaagacagtgaagctggttgtagggctcacttttataatcctaggatttggggaagctgaagcagaaagattgcttgagcctgggagtttgagactggcctgggcagcatagcgagaccccatctctatataaaaaaaaagatgttaaaacagtgaaattacagaaacagaacatagccaccctgtttcatcagtgaccttttcttcacgtgacggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttactgtgaatgtgaaaaggtgaaactgttgctgacttcggtagcaggtatactaaaattggaatgacacagaggagattagcatggccccctgcgcgaggaagatccgcagattcatgcagcattccatatttttttaaaaaaaggttacactgtgcaccgacgtggagctagaaggaaaagcatgaagtctcatgtttgctgactataaaaataaatcatagtaataatattattgaacattctactttaaaaattattaataaaaccataaatgaaacacttgagcacactttaaaaagtacataaacccatgagtccatatgtgtaattttatgttgtctgttttattatccaggatttcatactcagatgagcattagcatcaggaaagcctgaaatgccttaattgtgaactgatacgcaggaaaatgaaatatgtaagcacattggtgaccttgttctttacagacatcatgatcagcctccagccatacagaacaaatgagaaattagaagcaattccaagaacgtgtgatggtgtgaacccacttttgaccgtcacacacatttcagcatttgaagagacacaggctacctggaaactgcccatggcggggtcataatttaaatgtcccaatgtcatatagaggttaatttaatcaaaatgagctaaaacatggaacaatcactgaataatttaaaaagagtttacctggcagagtgtgtcatgcctgcaatcccagcactttgggaggccaaggcaggcagatcacctgaggtcaggagtttgagaccagcctggccaacatgatgaaacccttgtctctattaaaaacacaaaaattagccagatgtggtggcacatgcctgtaatcccagttagtcgggaggctgaggcaggagaatatggaactcaggaggcggaggctgcagtcaaccaagattgcgccactgcactccagccagggcgaaggagtgagactcccatctcaaaaaataaaaaaaaaaataaataaaaatagttgacccgggtgggcattccaaaatgttcccatagatgatcgtgaaacaatcactgtgcaaaatgtagaggaaaattcttacgataatcacaaaatttgtatcagaaaaacattacaaatttactttgctccatgtaattttatgaattggcagtattttcttaaattgggatacagtaagagaatatctttaggaaatggaaatgttaaaacaagaagtaacaagaggttgtttttctgaagggaaatgccaccggcctgctttcataggcattgataaagccaggaaggaaataaagtcacaaccgaatagtatacactgtatctactgaattcttctaattccttcacaacagaagtctaaatcctgcttagcctaaacatatctatagccagcgatgggcaaattatatttgctgtcagcatgatggaataagaaacagaaaccccccagcagtggggtaagattgcacgcttcatcccctcaaaatgcagttcagccccacttccctctccatgcccatcaaacaactgcaaaatcacttgttactgaatttctcattcagcgttttgtttcttttctgtccatattcaagacctttttatttgtttgctttgaagaaaaagcaaaagcaacaaaacaccaaatcatttgaaattccaaccttaaccccccaattttaaaaaaaaattccaccagtggaactaaacagttgagtggtttgggatgtgttgttcgccatttctgtgtttgacctacatggtctctagttctttggacaattgtaactgtgaaactatggcttaacactgttaaagactccaaggctccactctgtagccaggtgcaactcaggctgcacaaataccccaccagaatgtcacaatcattcattgctccagctgctgagtgaacagagtgcaagacagcactggcttgggttttatttttgcagccagttaactttgcatcaggtctacacagtccttgcagcctttgatttctccagttgtacagatttgaaatggggtgcccgggttcctctcgtttttccttcaatctacctagcatgcattttacacacattggaggagtcgtatgcactgtttttctcttgctgatggaggcaagaacgccttctaattagtataacttaaatggacgggattcacttaaaagcaagaagaaaagcacatgaacaggtgtcttaatgcatttggatactttggggtgtgtgcctgtctgtgtgtgtgtcttggtgaaggtgggctgtattttcaccaagccttttcataatcaagtttgctttgcaaaccatctggccttgcccccagcagtacagtccttcctaataacggggatgctctgtcatgtttctctgtaaattgttgtgtgttgggaagttctgttgaggcttagtttgatcttccatggtggacatgtctgttctgtatataaaaagcattacatctgtgttttagcaggtgggatttgaagcttttccacagtccttgtgctctgagatggctgttgagctctgctcagctgtcacagctgaattctttttttgtgctgaacactgggcagcctcaccttgttgccaacgtgcttctggggcccctgtgactgctgccggatgctgtgcacacaggcagagtgccttggcaggtttgtgcaccccttggcgagccagaactgggaaccccgcggagtgaccccaccttctcatggggggtcagggaggggagtgcctatttttaatcttgtttgttgcgcaatggaaatcactgtgatttgtacatatgccctaggaaaattttaccgctgtctaatttatgtaataatactgatgattctaggtttgtttaataaaactttatatcttttcagaagtctgagttttgtcgcttctgtttccaaacaagctgtgacttttctcctttggtctaatccagggatgggcaattatctgtagggaccacatggcagatattccgcattgcaggatacacagtctctgctgcacagggtgcaaaaaagctgctataattaggcacggaggtgcatgcctataagtgcagtgctttcgggggccaaggcaggaggattgcttaagcccaggcgtttgagaccagcctggacaatgtagtcccattgagtgacttgggacccaccttcagcgatgactccttcagggttcacagaacattttaaccatttgcctatatcttgatcctatacctttattttcttactcttcacctgatttggctattccctaacattttctgtccctttatcttcaccgaagtttagcttagctttctgcctttaaatgtgttctttaagtaatgacagatcatccttattctaggctgcaaagattgtagtaaatatactctttctagacaggcagaataaattttgatggctcatttttaaaaaatttatatctttttgaggggtttggttagcttttcaaatttgaattagtcaatattttaaatggcttaattatttttaaaattttttaatattgtaatatgtaaatattgtcatgtttcgtattgtaaatgttacagcatttgtgacaatgaaaataagtcttaaaacatatcccagaaataaaaccacttcatcatgtatagagttctctatcagtatctactttggtaattgttatatgggcttcacagttctattacaatttataaaacttgagctaggcaacctagtgagagcctgtctctacaaaaaaaatgaaaaaattagctggatgttgtggtgcatgcctgtagtcctaactactcaggaggctgaggtaagaaaattgcttgagcccaggaggggtgtgtgtgtgtgtgtgtgtgtgtgtgtgtgtgtgtgtagataggtagatgacaggtagatagatatagatgaatagatagacgttagataataggttgacagggatagatgatagacaataggtttatagggatggatgatagatggttagataggttgaacgatagaatttgtcatgcaaaagccaagggtttctctaactgagcactgctgacatctgaggttgggtgattcttggtcgttggtgccattctatgcattataggatgctgatagacatctttggcctctactccctagataccagtatcccccttggcccccactcctgtgatgacaactaaaaatgtctccagacattgccaaaagcccctgggaggtaaaatctcccctggttgaaaaccactacttagaaaaataagattggggaccatttgggagccatcaactgagagcaaaacaaagaaccagaacttgaatggtgatcttcctttaagctttcacaacaagaaatagaaaagaggtataaagatctcttgcagtgggcatttgaaggatatttttttctgatgtgttgcctttcctttctctgaattcatctcaggattttagtcaatgtcgccaagtcaacatttgatcttttgccaaacaggaaatatttctatgaacagcgtagtgaattgtaagtaagagcctcgggtgcctgaaagtgccttgagtcatgagtcagagacgtgggtcaggctctgcttctcactggggccatcgtgttgggcatgtttcttaagctgttctccgtattaatggatccatcttcaaataggggcagtaattattgctgtgggctccctttctgatcagaaacctccaatagctctctgttgcactcagaagacaaaataacattataacaacagtgtaggagcatctccattatccgctgtcaataatgtcccagagtctctctccagggcatccactgccaatgcctggactctgctgatttagaacacatcccaaaagctcctgccatggggcctttgc

SEQ ID NO: 15329 - DNA, 23907 bp, Human
caatgccgcaatgccgccctggatttactgcaagtcattcccagagatatctgtgcaaggagcagggaacaactcaaggtaaaagtggctgggaatttttcccctggattcattcacaactcctgccgtgggcaggcttttagtcataagtattccccggtatgttctagtgtgtgggccatgagggctgtgagcaagaccagggctctgccccaaggttgtcaccatccttgcggagccagaagagtcaggcatggcagctggcacgactgctcccacttccggccctgccgatggccgggtggggcattgacttgctgtgtcggatggaatgtgagcagacaagagtgagttagttcccagtgtggcctcgtgtgtgcttttggccgcatcgtttccagtttcgccatccccaaagaggatcatctcccaggaagcttactggtccaaggaggatgagacacccatggagcagacttggaccccatctgccgctcagagccaggcctaaccctgccaagtttaggttaaccaacttccatcttgcccacagacttgtgagcaagagtgaacgaccgttgtttcacaccattcagttctggggtcgttggtttgttaagcagcatcgttgtggccgtggttagcagacacagggaacacttgtgatagtgtgagaaggtcatcagggagacgaggagggcatctgacactccagtctttggggggcatgggggaggactgcttcataaacttgtacaagctatttctgttttggatttcttgttgcttttctccctgggatgctgtagaccagagtgttagcaggacaccaaatctcttggcgcatgtcagagttgtatgtaaaacaggagttaatccgtaggggatatagggaaaactctctgacaagtgaaatatgaggactcttgggctttgagtgatccattaactcactcattcattcattcaaaaaatgagagttagggacagaactgtgaataagataaagcagggttctgtcaaccaaaaagtatctgacagtcttaataatttagaagcttattttgccaagattaaggacaatgcccaggagaaaaaacatggaatcacagaaaaagcagtctgtggtctgtgcctttctccaaagatgattttgagggcttcaatatgtaaagtttttcccctattgaaaagcaggctggagggcagagagggagggtgcagtcattactgaatccatgtgttgcaaaggaaaagaaataggtagggaatagtcaattatattcctcttatactcagtaaatctgctcttcacatatgataaggtaaacatagagtggctacctgtggagaatttttaaaatcttttatctgtacgctctctgcttaggaacaaaaggaaaggcagcttcttgcaggactcagacttcagcttatttttttccttttggcagagtgaattgggggtcccaagtttttattttcctttcacagtccttccatcagtggagcctgaattctggagaggggagacaaggctgatgatgaatgccacagagaatgacagggaagggaaggaaaacatggagtattgggattaaaggtggtgcaattttagatagggaggtgagggagacctcacgaagaaagtgaagtccgagcagaaagggcactggcagtggccttagctgaggaagcagcatctctggccaaggcgcaggaatggctaagggaggtctctgcagagacagcagcttatggggcagagcccctctgccaagcacgcctctaggtgctacaaggattcgactttagatatgttcagtgaatatagctgcagagaaacaaatccaaaaattttgagttttgttcttaaacagagtaggccaaaaggttcccattatccagtgaagcttccagaccctgcccctaccccgtcttcaagggattctctctgcagggttcttggttcctggtgacacctctgtttcctcccctaggccacgtgctgctgggtctcagtcctccacttcccgtgtcctctggaagttgtcaggagcaatgttgcgcttgtacgtgttggtaatgggagtttctgccttcacccttcagcctgcggcacacacaggttagaagtaaacctttcagatgcaaaaaggcttgcctgtagcttcgctggggaaagatgttatctagagaagtttccttgtcagaaagcaaagtgtgggccgagctcggtggctgccggctgtaatgttagtacttgagagccctaggcgggtggattgcttgagcccaggagtttgagaccagtttgggcaacatagagagacccacgtctctacaaaaaaaaaaaaaaaaaaagtagttgggcgtggtggtgcgtgcctgtagacctggctacttgggaggctgaggtgagaggagtgcttgaacccagggaggttgaggctgcagtgagtggagattgcatcactccactccagcagggcaacagagtgagaccctgtctcaaaaaaataaaaaaggaaaaattaaaaaaaagaaaaaagaaaagaaaaggaaagaatggtgcgaatgtgcttgtcaaagagcaaactgaagaagtgacgtgtttgcccttaacaaagttgcctttggagtttaaccatacgacgtgccagaactaaacttttaccatctaaactcagctcagatttacttttaatgatgagaaatcagccagtgaaaactatggccatagtttttaatctttaattttttgtcaccgtagaaacctgatttaactttcttcacaaaacataagttggaatggatagtagcactgaacttgttatttggaaattttgaaagtataataacggggtagggagggagtttaatagtaccccagggtgtaggtctttttgttagggacaaatgacatctttctcaaatgtgctccaggtttccctgccagaatcaggatcagtcccaggtgcagggaggttttatgatctgagcaagttttggacccaaagcctgaccatgggctctctgtccttcaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactaggtaagtctccctgtgcggggctggggaggggatcctggcaggatggaggcttgtgagggtcttcagtcatgatccggatctcagaatccagtgtacaaaatacaaatccagtgaatccacattgcatcccgtttgctgttcctgacaccccccccaaccctacagtctcattctgtctccatttagtctttgctcaaatgccacctctttggagacaacgtccctagccattttagctgacaccgccctctgtcactctctccttaccctgctgtagtttccttgcgataagattttcccatctgacacatttgtgtgcgctactgtatttaatgtttgtctacccattagaatgtaaactctgcaagggcagggacttggtctatgttgttcactgttgaagccacatggtaaggaaccaagaaatagacatagaataggattttactctgaataggattttagagctgggtgagaccttaggattaaattagtccaacactttgggcggccgaagagggtggatcacgaggtcaggagatcacgaccatcctggctaacacagtgaaaccccgtctctactaaaaaaatacaaaaaaattagctgggcatggtggcgggcgcctgtagtcccagctactcaggaggctgaggcaggagaatggcgtgaacccaggagatggagcttgcagtgagcggagatcgagccactgcgctccaggctgggcgactgagcgagactctgtctaaaaaaaaaaaaaaaaaaaattagtccaactgctcgttgtaaggatgagggaaccaagctggcttggaaagttccccaggtggtgcgtggtagagctgactctggagcccgagtctcctgaccctgggtccagtcctcctccctctttgtcctgttgctttcttcccctttaactgtagaaaaaatacacataacaaaaaatttatcatcttaaacagtttttagtgtacagatcagtggcaccatcaccattatccatctttaggagtttttcatcctcacaaactgaaactctgaacccattaaacaataactcccctctcttcttccctccagcctcaggcaaccaccactgtactttccgactctatgattttgacgactctaggtacctcgtttaaatcgtttaagtgaaatcagtctttctgtgactgaattatttcacttagcatagtgttttcaaggttcgttcatgttgtagcatgagtcagagtttccttcctttatgaggtggaatattattattccgttttatgtatgtaccacattttgtttatctatttatccatccagggacacttgacttgcttcctcctttcagctattgtgaatccaatatgaacatggatgtgaagatatctgttcaaatctctgctttcagttcttctgggtatagaccccaaagaggaactgctggatcatctgttaattctatatttaattttgaggaactatcatactgttttccatagtggctgtaccatttttcattcccaacaacagtgccgacactcaatttctctacatactcaccaacacatgttattttctattatttttgataataatcatcctaatgggtgtgaaggggtctctcattgtggctttgatttccacgttcctaatgattagcgatgctgagcatctttttgtgtgcttattaaccatctgtgcatcttcgctggagacacagacatatctcctttatggactctaagtcctttgcccattttaaaaactgcattttgctgttgttgttgagttgtaggagttctttacatttcctggttattaaccccttgccttatcagatatatagttagaaatattttctcctgttctctaagttgcatattcattctgttcatagtgtcatttgttacacaaaaggttttaattttgatcaagtccagtttatctatttttttcttttgttgcctgtgcttttagtgttaagaaatcattgcccaatccaatgtcatgaaggttttcccctttgttttcttctaagaattttatagttttagctcttttgctttttgatccattttgagttaatttttgtatatggtgttaggtaagggtcctgcttcattcttttgcatgtggatatccattttctccagtactatttgctgaaaagactgtcctttccccattgaatggtcttgacatgtcctactccttcttgatggatgaagttttaggcctagtgttggtgatcttaaaaagtttcttggcttcgttcttctgaactaggacaaccctcagcttgattgggaactagtgttttggcctctctcttcagctgcttcatctgttcctccaataaaaacttccttggctttgttcttctgaactaagacaacctttggcttgattgggaactagtgttttggcctctctcttcagctgcttcttctgttcctccaaaggcactgcttgctccttccaccagctggcttcagagtctccagatttcataaactcatttgacttaagaaggactgtacccaggaatatgtacatttagaaaaagaaccggagaagtgagattcttagcacagtggaagtactggtgaatggaaaaatttcagaccacgtcatccccagtcctaggctgggtgtgtgtgtggcagggtatgtggggggtgggaggagatatgaggtagagggtgccctctgtgtgtgtgtgtgtgtgtgcatgtgcgtgcatgtgtgaaattaagaatcttttcaaattaaacccagcttgacactaccatccatatgtctagccccaactataagcaatttagggacaggtttaatcctgtcaatgaaccttgcctaagaagcaggcaaaccatcttctattcttatgctaggaaaatgtggatgcctggttttacaatagctataaatgcatatttcttctttcttttccacagtaaaaattctaattttctctaaggagtactactaggaaaacttcatagcatagtaagaaaacatgaaacctgaagtcagaaagaaagatgggaatcttagctctctcatttcctatctggtgggaccttgggcttatcacttgacttttatgggtgttagttttcctgtaaagaagtttgttgagagggttatgtgagatcacagaatgtgaaggaactagcgtggggtctgccatggtaggtggtcaatatatacataaaaattccctctccttcccaaaaggcaatcctcatgactactgaaagtgagactgtgcaaaaatcagggagatgtgagctgagttctgtttgtcttaaagtttgcttttatgatcaatttttgtaggaaaaaaagagctgagattgagggggcagtggaaatcccagtgtatgtcaaactttctttgcatgatgggaaggtttacctggctgacctttaatactctttgtcaactgtaagattgggattctaattgagtgagaatcaccagcagttgccataatactctttagcgttgatagtcatgaggcaagagactgccctgttctcatgattgtttaagaccttgtgatctagaaccacgtggtgagtcagagtaggcaaggatgcaagccatcagagaggccaagatttgagcagtagctgcctgggcctccttgcttggtgctctgcaaataaatgccttactttctatcactgcaaaaaaaaaaaaaaaaaaaaaaaaaaaaggaaagaaagaaaagaaaagaaggaaaagaaaaagaaaaaaaaaaaaaaagagaaagagtaggcagtcaaggttatgctgctgtaacaaatagctcctaaatctcagtggcttaaaataacaagggcttatttcttacacatgcaacaggtccattgtgggtttgcagacagttagggacttaggctgaaggagcagtcacagtcactatttcaaatgttattggttggttgctagagcaggaagcctgctttggagggtctctcatggctgttacaactttcatgtagaagggccacacatataactcatgagctaggaagagtccccacagtggggacgaggacatgtgatacaccatgtgctcagaatagggagaactgggcctatttggtgagcagcactacgaatgactatcacgcctttgccatgggggtgccacactacatggggagtgcaagtggtgatcaaattgcccctcacccttctctttcttttgagttatttttatgaagtttcttgctcaaggggaattaccagatcaataatgtgaacagccttgtaactttcaatatgtctactaagcttggtttctgaagatagtacttatgggtactgaagatagatttatgggttttcccagagccttgctgggcttcccattttggtttgacctctttgtagctgtacagcccacttaatttctgtacacctacctttttcatataaaaatgatataatagtaattcctacttcatgggggctggactataagtgaaataacgtgtgcaaagtacacagcacagggtctggcctgcatctactcgctgctggctacctgctgtgtgactgttactcaagtaggcccaggtctttagatttgtcctcagttgcctttattcaacatgtagtgacattacgcatttttcaaggtgagagttaacattctgtatttctttatgcacaaaatataatatttgttcatctattttccctttttaagctaaatataaacagatattggcttcatatatttaaattaattcttcttactttcaagtggtaagcttttatcacatttctttcaccttttttttacattttgttacttgtttggatatggatggtttagattttgctgtgcaagtaatttttacccctatatgtaaaactcgtccttattgtctctgtcaaagtctcatgtgttttaggtagccagaaatttagctgagataattatatttttatatttttctacttaaaagagtagttttaattactgttttctgtcctccatccatttcccacaagtttccagcaaggttttcctcttccctttttccagctctaaggtcttgatagaattatggcagtgaaataatgattaggctagtaaaataataataataataataataataataatcatataataataaagcaaacttaccaagttaatttccccatgcagtattacaaaaatcttttatgggtcttacactaagtttccagcagttttctaaaactagacttcagttggtaaatcattccccaaaggagcaaagggaatattcctttttacggaaacaatggctcttgggaaacaatctctgcatgtggatatggtttcctggatcatgaagttggagtatgcgggggctgggctcaaggagctccagaacctggaaggcataagcccttttgaagaggacttggggatttcttaatgaaccttggtggcattagaatcgggcttgtagacagtcctttgtgaaaaacacagaatatgctttttctgtacaattatgttacgacacttgttgccccccaagtgttcgaaaagatcagggacagaagtattgcaatatagatgttcctcgacttacaatggggtaaataccaataaacccattgtaagttggaaatagcgttgtcacttaacttaccacttaacacttaacttacccaacatcacaacttagcctagtcttccttaaatgggctgagaatgcttacattagcctacagctgggcaaagtcatctaacacaaaacgtattttgtaataaagcgttgaatatctcatgtgatttattgaatactatactgaagtagggtttctattgaatgcttgttgtgtttgcagcattgtaaagtcaaaaaatcctaagttgaaccatcttatgtcgggaaaccatctgtactaatccagaaaatgcagatgcagattttaatagagttggggaaatgatgcttaatttcatttagctttacttttattttgccttgccatttatcttttttttcccttttaaatcagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggtacggctttaaaaaatgccattttactaaaatgtgttttctttttttactagccataaaagaaagacataaaatatcgattttctgaagacagtgcacacacacacacgcacaaacacacacatggtttgcctttcatatctgtgagttccacatcctgggattcaaccaacctgggattgaaaatataaacaaataaacaaataaaataacagtacaatacaaataatacaaataagaaaccaacacagtgcatcatctactgtcacatgctgcatgacaaagtttcagtcaacagtaggctgcatgtacaatggtggtcttgtaagattataatggagctgagaaatttctattgcctagtgacatcatagctgtctcaacatcatagtgcaaaatattaccttttctatgtttagatatgtttatatgtacaaaaactgaccactgtgctccaattgcctacagtattcaggacagtaacatgctgtacaggtttgtcgcctaggagcagcaggctgtatcatgtcacttaggtgtgtaggaggctctaccatctaggcctgtgcgagtactctctatgacgttcacacaacaaagaaatcacttaaactgtttctcagaattatcccattgttaagtgacacatgactgtatttacacagggcatttacattgtattagtaatctacaagtaatctagagatgatttaaagtatatgggaggatatccgtaggttatatgcaaagatgacacccctttatataaaccacttacgcatctgtgttttggcacctgtggggaatgtttgctgaaaccaatcccccaaagaaactgagggatgactgtattttaaagaatttaaaagggccgtaattaatatgttctattagtccttatgtgggttgagtaaaggtacttgaaatagtgatttgtgaagacagagtacataacagctgaaggaaataactttttactgtaatttgtctacaaaaatgtagaaaaaagcttacataacaattttatagacatattaaaggagtttttttaaaaagtacatgacagctgggcgtggtggctcacacctataatcccagcactctggcaggccaaggcaggtagatcacctgaggtcaggagtttgagaccagcctggccaacatgtcaaaaccccatctctactaaaaataaaaaattagctgggcgtggtagtgggtgccagtaatcctggtgactcgggaggctgaagcaggagaatcacttgagccctggaggtggaggttgcagtgagccaagatcacgccattgcactccagcctgggaaacacagtgagactccatctcagaaaaaaaaaaaaaaaagcacatgatagcaaacttttgggttaagggagcaaatatgaacacaatttattcccttgtctggttgaatagatgttatttgatgtgctcattgctcctagtgagaacatcagatattgtcattagatattgcttatgtagaccggggttggaaaaccatggttgggccctggaatcaagttgtctcctggatttgaatggctcacaagccaacgatagttgtcacttttttaaatgttggaaaaaaagtaaaagaaggatattttatgatgtgaaaatcacataaaattaaaatttcagggtcggtaaattaagtttcactggacacagccacatcctcttgttgtagtactgtctgtagccgctttcacatggcctagttgtgatggagaccctgcagactccaagatccaaaatacttcctatttggccctttcctgaaaacattggtcaactcctgatagagaccctagattgatactgaaaagtacagttattggcttaatcattaatgagaattaaccctttaattgataataggttaagtagttggctggtttgtaactacagcatctctatataggatattgatttaatattagaaactttgaaatgattttctgaaagtagaggaaagtagccagctcctatgaataagctggctgagctctagaatgcattctctctctctctctctttttaatagagatagggtctcaccatgttggccaggctggcctcgaactcctgggttcaagtgatccttccacctcagcttcccacagtgctgagattataggtgcaagcccccaagcccagcctagaatgcattctcttttggtttgggaaaagcataaagaggacaaatgaaagtttttacctggagaggaaagagcacaggctctggcgtcaatgggtctgggtttgaaactctgttccttctctgatctgttgtgcagccgtggccgagtgactccacctctcgaacctgtttcctctgtaaagtggcaattaataactttcaccacctgggattgtttcaaagattaaatggaatcatgtgtatgaagcacccggtgcagtgcttgacatataaatggtgctcaataaatgtgcatggacaaagatgtcatggtgatgcttagtaatatttattcccttcataataatgatacctattactgcgcatgtactatatccaagcctgttctaaactccctgacatgcaacccgatgaagtaggaactgtaaatatcccccctttttacagttaaggacccataaggatgttcccaagatcacacagccagtagatggtgaagtcaaaactcaaacccaggaggccagttcccatacaccactggaatgactgtggtgctgggctctatttggcatttttcatatttgactactcatgcttagaacaatgaaatatctcctttcaattaaatatgttctaaagtggtacttcatgagccatgtggcaatttcaattttatctgtgttctcgttcggagtaagattctgaagtgactcaaggttatatttgactgttgcaaacgttgaataatcatgattttgaaagtgatgtccctgagaacattgtgtgctcattagggtgtttttagaaatcccattccgctctttctatttcctggaggccttgatcttgaggattctattctgcagagaccccagagaaccttgtgtccatataaaaagtgtggactcgtttcccctatttagtttttcttataacagagatttttctgttactgactcacaaaattgaaatgctttttaaagtaattactgcaacgtcatctcttctgagcattgttgtccaggtcatcatgacgatttatagtgctcttcccagatacttcctaaggcctgaaggtagcagtcaggacataaacatatttgtattttagatggcttactttgtcaaagaagagttcgtctcttttttttccccttggacaaatatgctctaactattgtagttaaccaaatctagcaattttatttgtttatatgttaacaaattccttcccctaataatacagtcaaacgtatgcccaaagtacaaaattggcaaagtaaataccaggacaattcttggattgcaaatcccacattggttgataatgatgatgtaattcatagcctttgagatgtatattggtataatgtcaacttaaaaaaacattttcccttaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagagtaagtacttgccattgaggcacctatctatcctggttcaataacaagcatgcagagaacaaatgacggtgcacgtagaattccttgcaggtctttggaatgaaggataacggaaaacagatccatcagctctcctgaagcatcaggttaataagacgtgtgtgatactttgaaaggtataaatcagggtgttgttctgagaacaggtgaacgaattgggaaggttatagggttgcaagatgaaggctaaaacacaccactcaagagagtcaaacagtggcttctgtagaaggtacccttggaaagtgtcctgtgaagctttgcacctatagggctagaggtcaccacatgctgtaactttatgttcaattttaggatacttcaattttattgggtattctaaccagagagctagccttgcacatccagtggaaattgccttttatttgtcttccctaaggtgggtctagctgcccttaatagcaatatttcaaatagtcagagctgccattgattaaaaggagtttcgtttgaaaatgctgttttgagcagtattggctattgtttcacatttgttcaacatttactccgtaccaactgtgtgccggacatggagacaggtgtaaccatgtgtaaatcctggactttgccttggagagtgggccacacttctttgttttttatactgaataatgatcacaactggggtcttttgaggggatttcagagagcttcagagacacgctaagtttaaataattggtctataaggggaaaatatatttttctcacagagcatccagagattcagttgcaccgcattttcccacggactgaggtgtcctgattgtgtttgttttacagtcctgtgaggattcgttcatatcagctccttgcttctggacaggccactgactcaggtctcctgaggctttccgtggaccggcacggtcctgtctctgcgatactgtgcatgaacactagggggcagccgccctacatgcctgtctgtgttgtgatcctcccaggatctcagtggctctcaaggggtggtcctgggccagcagcgcctcatcacctgggtactcaacagacatgcaaatctcgggtcccgtggagacctactgattgaaactggagtctgggggctgtcatctgtgtctcacaagcccccgggtgatgctggggaccctcaagtctaagaagcactgagatcctggaggcttctttctctccctggatgccccagctccatagggcagcgcgtgacttggaggaggggaggaaaaggcgtctggccgtggtcgaaaagccgtctgcccctcaggctgtcctgccatgctgtctaatgtgtactcatgtcaggatttcaaaatgctgtttcgtggaagtgaggatgatgaggcccgtcgtggagacaactcacagccctcaccccccaggtgtcctttttgctcatttcaggggcctcgtttctttctttcttttcttttctttttttttttttttttggtttttttttgaggcggagtctcgctctgccacccaggctggagtgcaatggcgcgatctcggctcactgcgacctctacctcccgggttcaagcgattatcctgtctcagcctcctgagtagctgggattacaggcttacgccaccaagcccagctaatttttgtatttttagtagagacaggggttcaccatgttggtcaggctggtctcgaactcctgacctgttgatccacctgcctcggcctcccaaagtgccgggattacaggcgtgagccactgcacccggccacctcctttctttacgttggctctaatcccttggagatccacttctgcctctccagagagtttatctcttcaattaacaaggcctctgtggccgaggccaggttacacactagccttccaaataggtgtttcttgagccctgtgccttttctagaagaactgagtcttgagtattttgtggcaggcactttggagaggtggagaaggtattttaggtcaggtcaagtttcggggaaaatctatctcgtggacctcataaacatgattgttttcaggaagtctgggagggaaatggttaattgtttatcatagagcaaggactgaagacctcctgtcagcggaatgtgtgtttggctgtggcctcttccagtaattgctctgctgggaaagtcattggccaaggatgctcgattttgtagagagcctgtttcctttgccagacaaagcctgactctcataatgactggccatactggaaaggataacttagttgattagccaaacaatgacttgaaccacagcgtcaaatgaaggctttcctaacggaatctcttttccttacatctttctcagaaaaaaaagaagagaccattcctgtgatcatttcccccctcaagaccatatcagcttctctgggtaaggcccacaaggaccatgcattccacgcacctgtgggggtgcctggtatcccaatgcagggggcttgggacccttgcgtctgctgatcatacctgctccttgggtgcaatgtgcctgggtggagaccttagaactccagtgtgtgaggctggaataacaagtgtgaggaaatatttccctttggccagtttggttagaaatggcataatctgaaaacaggtatactttgcttcatgcaaagcctacctataaaaatctgaatgtgaaaatctgaacgttctggcagcagttatcaactgcatgagaagatgaacagcatgaaccccaggcagagccagcaccctcagtgtatttaaaataattcacatcaccaaaacttggctggcgctctgcctctctctaagactccatttgtaaagtgggctcagctgtggtcagtttcttgttgccagaagagctggtaagctggttgaatggtgccatgaaaatgaccaatggggctttctgcttttcactccatgtggtacagtccatcctggccagcacaggtccacactagtggccagtgagggtacgtaagtgtactgtactaacaaccaactgatgctagtggtggggcggaattgatgtttattgaggatccactatgtccaatgggatcccattcaatctcaacatagaccctgtaggttttattctctcaattttccaaaaggaaaaagccacccagggcatcacgttggctcagtggaggccaaaaggccatgctcagagtcaggctggagttcagattcaggtctgtgtgcctataaaacctgcatccttttatgtgtttgtttctgggtagtgtttttgtaggtctgttactcatttatgaaaccctggctgcacagtcttttaaaaaacaatttatttgctttttccttttgtttagtgctggtttaaattttaaatttgaattggaggccatagaggaggagggcttttgtgcagttgctgggactgctggctggcacttgggttgccactgccacagtgcagtccccatggctgcagctctaggaacaaccacctggaaatctggggcaatgggcacatgggtgatacctactggagccccagtgttctggctccctggggcttcccagccaagttccaggcccagttcccaatcagttgctttggatgcactggaatgggtggtggggccacgtgacactgattagtaggttgttacggctgaggaagatctttaaggtcataggagtggcataggatggagaacggctggcattctcaacccgtggtggggccaggtgcattaaaagacacaccacagggagccatatcacccacgaggaaaaaacaagtgagaaggttttcttcttcttttccttctactcttctttgtgaatgaaaaaaaaaataatttcctatgattgaggcagggggacccagtacatcacactgcacaactgcagagggcaccatctatagaaaacacagagtttttggctgggcgtggtggctcatggctgtaatcccagcactttgggaggccgaggcaggtggatcacgaggttaggagatcgagaccatcctggctaacacggtgaaaccccatctctactaaaaaatacaaaaaaaattagccgggcgtggtggcgggtgcccgggtcccagctcctcggggcgccgaggcaggagaatggcgtgaaccggggaggcggagcttgcagtgagccgagatcgccccaccgcactccagcctgggcgacagagcgagactccatctcaaaaacaaaacaaaacaaaacaaaaaaaacacgagtttttaaagaagggttgatccccagtcagagtcatctgggaatggagagttcccaggagaaacattagagccaagaccagcctcaggcaaagagaaagaatccacacattgatctggattttctgaggtaactgaagtgaggggcagaggaagtcggcttgaatttagcatgtcccgtgggagcgcaggggccctggtgaagccatttaacttcaggtgcctcttggtttttgcctgccatgaagaccagttgtaggaaccagaggtacttcgtaaacagtaaagctctgtgtgaacagaatcatttgagaaaactaaattttctaccaaggaaagaattgggtggtgaggggtgtttgagaagccgaggagggactcagggctcaggtttgctggtgggtgggaggtgctggttctgcagttgacgtgctgtgccttgccatccacagggtcaagactgacaatcccgtgtaaggtgtttctgggaaccggcacacccttaaccaccatgctgtggtggacggccaatgacacccacatagagagcgcctacccgggaggccgcgtgaccgaggggccacgccagtaagtgggccagggtcttctgttgagaactctgtgggtttcgctcttccttttggagacagttatcactatgacccacataccacattaaaagttactttttttgattccaaactgttggatgtttagaatttaaaaaattgtattttgctaaaaattatcttgagaatcaaactttctctgtaaatacttaaaagttgagttgcagttgacatgttggtattgatgttgcattttgtagctgtttcattaaacattgatccttttattttcgcaagttaaaaaatattttggagttcatatctttccattttccactctgcaacctgactatcaaacattttcataaacccttaaaaagaccctgagacctagccacagtatctatagtacctcttctgtttctcagggagctgtgggctgccacaatctctaagggaggttaataattaaaaaaaagaaagaattcagttctcataagcagtcatctctagaaaatgttttcttactctgagactcgaacaatcagaccttttgtaagtgggaacttgttgcctgtgagggagaccattcaacattccaaattgtaactctttttaaaattacagttttgatactttgaattagcctgagcttttgcttgccaaatggttgtgttttttgaaagacttatcacaaaagatctttctggatgtaatttagtggataaaaactatgtgtgggtagcacaatcatgtgcttgcaagttctcattgcaaaagacctggccacaactaaatgcccatctcagcttactcatatgatccacttacttaaaggaacctatattccccctacaaatagaacaaaaatattcctagtggatccactcatctgtgtttttattcacactaacagttagtagtgaggtgtctacagattcctctaacactataaatggcagctatcctggccacagccattcccctgggctgtctgcaggtttccagagtgagagtcagcagtagagatgagaagagacggcaccactgagggctggagtcctggaaactccctgcccttcaatatacaagtgatttaatggtgagggactcaagtttcctcaaactagacgtttctgttcccatgactgtttttttttgttgttgttgttcattaagagacttaaaagatgaacttccccattatctaaccctgtagtgtaacaactgtttgatgccagtgaccgccaacttcagtgacactaaggccttcagggacaggcttagaaactgtcccaaatgaatcacaagtatggtggcaagagctcctaactttatgaaacttgaaaacaataaaagcgcaatgggtacttctaaaggagagtgtttagatgtctacattgtgaaagacaagcttgcattcgatacaatcataattaagtgaatgtttttttaactcagggaatattcagaaaataatgagaactacattgaagtgccattgatttttgatcctgtcacaagagaggatttgcacatggattttaaatgtgttgtccataataccctgagttttcagacactacgcaccacagtcaaggaaggtatgtatgtattttggggagcactataggagaatataacatgttgaatgttccatggatactagacaaatctacttgttctccaaatgattccatagaaattcccttgcattgtctgctagtggagagctgaaaagaaacctcccatttttaaagagttttggtagggtggaggctggactttgggagattatactcaaatgaaaaatttaaatagcaagctgatttttggaaaatggatgaaatggttctacagtaaacttcgaaatactctgtctgcatgtggctctgccttgggtcactaatcagctgtcttcgcatggcctctagaagagggtggattgttctttatcctgaagatgagaaacttcatcctctaagagctggggattgggagctacccagggttcagggcagctttagggtcaaagtcattatatgaccggaaataggtacaaggctacagccaaatcaacccagtgttcatttaaggacatttaaaaagaagaagaggaaaacccacattatcatttttgattaaattgatttcatatcaatgtttaattgttgagcaggagggagagctgccttgaatgtagtctctgttgacagcctgtagctaatggcaggcaagccaaagtgattcccagcatctcagtgatggctcgtggacaatcttacagcaataacataaatacaaattgctccaggtctccatgttttgctggggaggcagccacaaacacagtgtaaactggaaagccaatgatgtgttccagcctcaggacagggaatggcacccaactttcctccaactgtgcgctgtgcaccaccagcctcacactcacctgagccactggtcacaaacacagatctcaggacttactccagatccaccctgtcaaatattcctagggagaggctgcagcctgtgacacaaaaagctcctttcacagtgaagtttgagaatgagggcacacatgtgaagggtggcgtttcagatcatttccagatgagcaggctgggagagatggtggttgtacacatttacccacaaaaatcagaatgttccctctcggggtcagattagtgagcccaaggaacctgtggtttgtctggccctgatgctgggaacctttaaaattttccataacatgagccttgtccctgcatgtggctggccgtgactgatccagggaacacaggctgtaagtctttcaccaggactgagaggtgtattcaaacagctgcccagaatattacagctgaacttatttctaatctttgtggggttttaaaatgtgagaatcctctggagcaacaggctgaggtcatgtcgattcctggatgactaaacagactgtgatagataatagcttaaaaatgcaggattctagtctcatcaacaatgtgtctgataacactctgttctcacatttgctttttaactttttattcagagtctcttcctgtatttccataacacagagacgccaaggagcagaacataaaatagctggacccaagcaatcgtgttggcccctgcagctccattattcaaaatttattttcctttgctacttcctttgatcctcatgacacccatgctcattagaaaagggcagattgttcctggctctgtcacagttggccaactgtgacataaacagacagcatcttaaacgcacagtgtcccactgttggaacaaagttaaaccctcagcacttgcccacttaccctacgatgtttctaacagattttgccctatcacgctcgtttctctaatgccacagacatcactctcaaatatcctccatgttggtgtgagggatgtgctttctgaaaatcaatgcacatttatcaagaaaaacaaactccaatttctttcttatcttgtacacctgcattgccctgtcctcttgtacagtgagagactgttcagctcctgatgtgactctgttcttcccacagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaactccgtacgtcttctcttatggaagtggctgtgtctttttgagggactctgttctttgcctcagttgtctaccaaaggtgccacatttatagtggctttgtagtaaaggactaaagtcttacattctgttttttttttccctaaaaatcagtgacaacagtagatgtgcctgtgagtgggtgtgagtagctgtctgctacttgtgacctatttaacagaatgaggtgctcttaggcctgcatgagagtggaaaacatctacatgagttttgacattcattcaacaaaaacatattatgagtctattttgactagactctatgggagatgttgtacatacagtgatggttaagacatagtttgcctttcaggaagctggttgttcattttgagactgaaaagaataatttagtgctaaagcagaagaatcagcaagaattggtgaacttttttggaaagggctatccaaaaaatagcaattaaaaatacacacattggaatgtattagtgaactgagaattagacccaacttcataacaacatgtctgaaaatagaaggaagggcattaaaagaattgtagacaaactgaataaaatgtacccagagcctctttcatatcatataccaaaaataaaatccagatagataaatgagttcaattaaaaaaaaaaaaactccaatggcaggaaaatcagcacggctggtgactccacctttcaggtctctgttcaaatgtgaccttcccagagggaaggtccccagagaggaccttccttcctctctgtcccctcaccctgctttgtaccattgtagcttttatcaccaccagaccttccagtatagatttgcttgttgattttcaatttatgtttcccacccaaatggaagacccatgaggtcagagagattattttggtcccagctgtatttccagtacctcaaagcaggcatttaatgaatatttgcagaataaatgaagatgggatgaactctctcttgttcattaccaaaagacttgcaagagtaaaggtgagtaggcttaattacattataatttctgcacaacaaaataacaaaagcaaggtttagacaaaattgtgtcagacaagttcaaggaatgagtaactatcatgtgtagagttattcaaagtcatagaaaaggcatgtgtcttagtctttttgggctgctacaacaaaataccataactagggtggcttgtaaacaacagaaatttatttctcacagttttggaggttgagaagtccaagatcaaggtgcgagcagatttggtgtctggtgagggcccacttcctggctaatagacggcagccctcctgacttaatcacctcccaagggccacaactcctaataccattgtattggaggttagggtttcaacatatgaattttgggaggacacaaacattcagtttatagtagcatcatcaccctacagatgaaaaaatgtgagtaggggattgcagaagagacacacataaaggaactcatggaaaaatgacactttcagtaagaaccaggggatgtaaattagagcaaatttgagataccagtgcactcacacactatcaagtgtttaaaagtttttatgaaacactctcacactttaattcaatttataatttggtgctgggaagaagaaaggcaacatgagccaagtcagttgggtgctggaccagcttgcatcttcttgcaagagcccaggatgtgcctctcttcttggctctgttcagtgatgtcatgttggtagcttaaaatctgtggccattgtggagtctttacaccacagaaattggcagttgccacaaatcagcactctcttccccagtacataacaacaaggtttgagagatgcccagtgatactactcctgggaatttagcttaggaaataatttaataaaataaaatcattagagatataaaataatttaataaaacttattaccccaatgatgaaaaattatgcagcaattatc

SEQ ID NO: 15330 - DNA, 35007 bp, Human
gtgcagcactatggagacagttcactatgtcgggtacaacacattcccttagtctcatttgaaagccatgatgaacagagaggtgtggaaaatctaagatcacaaatatgccatgagaaagtatctttgtctctactgctactttacaaaaccacgtctctaactgctaacacttcaaattccctcaaaataagcttcttttcccaattgtccctcaccaccaactatagtcatgctctgaaattattatggaaatttagcatctgaaaggaacaggaagttataattaattcctaattagaattgggcacaagcttttttttcttattttttttttaatttttttattgtgacagagtctcgctctgtcgcccaggctggagtgcagtggcgcgatctccactcactgaaagctccaccgtctcccgggttcatgccattctcctgcctcagcctcccgagcagctgggactacaggcgcccaccaccatgcccggctaattgttttgtatttttagtagagatggggtttcaccgtgttagccaggatggtctcgatctcctgacttcgtgatccgcccgcctcggcctcccaaagcgttgggattacaggcgtgagccaccgcgcccggccgggcacaagcttattgtttttcttctaccttttctaaatgtacccaatgctcttcatgttttctgccagatgttctagtcactgcatgatgggattgttacttttgctgcttctctggactcctcactcttagtcattttaaatatggtcaaaatgacaatctttcttaccatatttgatatataactttcaaaaagaataaaacttagcaccctcctattagtccttatctaaatggaaacttattagcagagcatcaagggcccaataaagtgccccctcttttgaaacttatctctactccctttcatatatttcaatcatgtcaatttcttattgttcttctaaataggtgctgattactaaactctattcgtgggttttattttttatgttcctctccattaattaatattcttcactgactttaagacttcacgattcattcttttaaaagaacgtgtttgatttcctccactgttaactgctaaatatctctctgatatattgttttcaggctatctttctcatctggagtaattatgtttcaagtgtcagggggaaaataccttttctatcctgtgcaaaaactcatgctgggcactaagagcatggagcatgtcccagttatctattgctgcataacaaaccaacccaaacttagcagtataaaacaaccactgctttagtatgcacatcaactttcagggtcagaaattcttttctccttcatgtatagagtctcagctgggagtgacataaataggtggagacagacctctccagcccagtccagccaacagcctccgctcctgcgcacccgcagcctggggccccaggttcctgtggtctcaccgaccctaatcctctcatctctcctccccattccctctccaaattgtttcagaattccaaattcttatctggatccggcaaattaattcagctactcttcagagtctctcagttattcccaaattctctcggaagcttgaatttacctatctaaatccattctcaaaaacacattggccttttctagccgggacatctccaacagtagttgctgttagaaactgcaatttccccttctctgcatacacatttttataaattgatttattggtaggcaaattacatttttaaaaaaaggcatgtgtgggttttcagggaagcctggacaggacgtgggcgtgccgggagctcgccggagcagctggtccggctctgggcgcccagcggaaccagggctgtactcacctggatgccggacccgccccctagagaccccgccccctggcgttcggctactaaagggaaggggattcccagggggtcctcaatcctggactctcccgacccctagctgtcggtccccctccctgcgcgcgcgccggcgggtttcctaccctccgaggcgtccgctggcctgcgccctggcggggacgtgggcggggcgggcggcatttaaggctggtgccacctccccggtgcagcggctggcgatcggccgcggaggtgcgtgcagggcccgcgccgccgccggtatctccaccgccaacacctcagccactgccactgccacagccacacgaggccccccaccgtgcgctccgccgctgcggtcccggatccgcgctccacgcccgcagcccgcggcgccaccagcccagcatgcaccaggtgcgtgcagcccccgcgccggccgaggatgcgagacgctgggccaaggccccggggaccggagcaggctgacgggaagcgaggaaaaggcgaagaggagaaacgccccgtcccggggcaaggggaggccgcctttcctctgagcgccccccggcctgggcaccgcttctctgactccccgccacggctccgtgcggccgccggggctggctggggaaagaagccagtccagaggagcgagaaggggccaaggggtcctaggccagctccatggcacctgcgggctccgactcggaggatggggtgacatggattcgttgcggtctgaaaagacttccggttagggccccctgatcaggactgagggtcgtaagcttagtgggtgcctcctccccaagaaacaggacgcacagctgttgtgtcccctgggaaggacacctcagaggaaacctcgaggtgcctaaggaacctcgaggttctaaggaaacctcacagctccttggaggcatcagtcaggagttgggggggtaacttcccacctgctccacccagagaagggtcaccctgaggagctgctggctggcctgtgcccaccccgcctcccctctacacggacggagaggaagccaaggtcggcgggaggtgggggagagactccactgtccgactccctccggcctccccagaggagggaaggaaagggagaaggggctcctgactcctgcaggtcctgaccccgcagaggggcgctcagcacctcttcggaaaccccatttggggccaatattgcacctgggcttctctttcagaaaaccccagaaatttactccgtggagctcagcggaactaaggacatcgtgaaaacagacaagggggatggcaaggagaagtataggggtctgaagaacaactgcctggaactcaaaaagaaaaatcacaaagaggagtttcagaaagaactccatctggtcagtagccttaagccacggggtcctgccggctatggcccttccccgcaagagcttgcccctagaacccacctcttaccacagacattcagtctgagggatttgaaatccccttgagattgtgtgtggtgtgtggtgtctgcgtggtgtgtctgtgtggtgtgtgtgtgtggtgtatgtgtggtgtgtgtgtatgtgtggtgtgtctgtgtagtgtgtggtgtgtgtgtgtatgtgtggtgtgtggtgtatggtgtgtggtgtgtgtgtatggtgtgtggtgtgtgtatatggtgtgtgtagtgtgtggtgtgtgtatgtgtgtggtgtgtgtgtatggtgtgtgtgtatggtgtgtgtatgtgtggtgtgtgtgatgtgtgtgtgatgtgtgtgtggtgtgtgtgtgtggtgtgtatatgtgtgtggtgtgtgtgtggtgtgtgtatgtgtgtggtgtgtgtatgtgtgtggtatatatgtgtgtggtgtgtgtggtgtgtgtatgtgcatggtatgtgtggtgtgtgtgtagcgtgtggtgtgtgtgtagtgtgtggtgtgtatgtgtggtgtgtgtatgtgcatggtatgtgtggtgtgtgtgtagcgtgtggtgtgtgtgtagtgtgtggtgtatatgtgtggtgtgtggtgtgtgtgtggtgtgtggtgtgtgtatgtgtgtgtgtgtgttttgaatggtgtgatagtatccacccagaggtcagggcctctgcaggattcctgcattctggttggaggcagtccctgtagaactcagaaggaagagcctctgattccaggccccacaggcatggccagacctctctccccgcagctgcttcagtgagagttaagtaaccacttgccagttttcaattgattagtaaaactatttgagctggaacttctgaggaggaaaaccaaagcccctaggccatgctagattgcaggtgtgaaacctcatggaaaagcagtttcagtggtaaaaatgtggagcttggattgggaggacctcgggccccatcagagtcccacttctccactgagctgaaactggcaacaaatgactgaccctcactgaaggtccatttcctttatgtaaaatgggaaataaataatttgctggggtctatgaggggaaaaaatgagatgaggattttgtaattcacgtgctttaggggagtacaatattattattattaaggaagagctctggagttattaaaactagccttttttttttttttgagacagagtttcgctcttgttgcccaggctggagtgcaatggcgctatctaggctcactgcaacctccacctcctgggttcaagcgattctcttgcctcggcctcccgagtcactgggattacaggcgcccgccatcacacccagctaatttttgttgtttttagtagagacggggtttccccatgttggccaggctgctctcgaactcctgacctcagatgatccacccgcctcagcttcccaaagtgctgggattacaggcgtgagccactgtgtccagcccaaactggccactttaataataaaactgccttgggtctgaaatgtgacagattttatcttgggaacaccgaaggggaaacttctacacggagcttgagatgggctggattgtccccaccgtccttggcagatcttaaagctctgtgactcctgaggggagtctcttttgtgctagagagccatttgttaagtattcagaaacttggcaggctgactgacatcctgttagcagcttcaaacttggttctagtgagaaatcagcaaactctacaaatccgagctttgtattgatcgttcctggagagtttgttaaacatttaacagtataccactgggcatttgtccgtatctatcatgagagacatttaagaacgcttccctgaaactggactgacctcaattcaaatcccagtgtaactgaagttcagtttcctattttgaaaaacataagatttttttttctacctcttaagggttactaggaagattaaatgagataaaacagggaaaagacagcacagcaccagacgatagatcgttcttattatttcccattatctctagcatttaagattgaagacatatctgtttttcccttgacattacaagggtcctgtaattttcagcagcatattgaatgcttttgcctcccaacctttcttggcaaattagtgcctaatgacaactgaagtatcccggcctttgaatgaaagggccaggcagtgacccgaggggtgggtggggtgctgccctgtgctagtccagtgctggccagcagagggcaccccagataaccaccaccacctcgtcccacccctcccccatgctctcatcccccagcccaggaagtctgaggtccatgcatgcaaacaatggctcggatcatccactacttgtatctgcccaaaacttagtgggttgtgctgtgctctgtgcagaacacagccttaatcttctgaatccccagcaatatcacactcaatcagtattagtagaagggatgaaggagcaaaacagaatctggctgagaagagggctagaagcaagataataatgataataatgaattctgctttattggaaggcctagtctcttactgcaacatggaactattttttgcatatacttaagaaaagagatgatgtgagcaccagtcaacagtatcaatctttgtttcagacaatcagggtttaaaaaatcctgagtgctggactttctagggggagtgaggaagacttaccctaggttttctgctacaggaagagacttcttgtcctttagcccagtggttctcaaagggagaggagaagaggattcccccacccctctcccaggggaaaaatggaaacatttttggttaccacaactgaggggaggatgttagtgggtggagcccacaacaaagaattattcgcccaaaatggcagcagggccacgggtgagaaaccctgctgtagtctaatgattctgtagcagaattcacaagtggcagccacaatgctgtgggtttattcagcagaacttttccctgcagggtttctctgcccagtgagctccctgagcgtcacagcttgagtgagggaagctgcttttccctgccagagcccacacagcgaaggaggaggagttgtgccagcccaggaagcggttctagtgtggttttgccatcagccccagccaatcccagggttcaggcctgagggaagcctccagctcactggcacctggaagatgagggtgccagaacctgtatgccctggagttcagattgaagcgaggtgcatggctttgttcagaaaagctgcaggcagcttctgggtagtaacagcaagtgcaggattgtgccgactcagggacagtcactcctgaggcagtgccatccttcgctgggcagctgcctggcacaggggttctttctctcctgtcccccacactcctcgatcccctcccatcctcagggctgctactcccagcttccatggctggtcaaagcttggggcttgagtcttttggaattatctaattcactctgttcttcctttcatggacttcaggatgaccacaaactcagcaatagggaattggaagagaaatatggcacagacatcattatggtgagtcgtgggaaccagggatttggaagagaagcctcccaactctacagagggaaggctgtgtgtggcggggggctgtgtggaagagtagcggcacctttaggaggaggggcccctgcagcgcctttgagactgcagttatttgcatctggacacagttcaagtcaacagaaaaacctactgtggggctcacactggcctggcagtgagagggaccaagagggacagatgacccctggcctcaaggagaaagtggccgggtaggggaggcaaatgtgtatggaagtgtcctgagattcactctatccccctgggatggctacaagaagtagaaacgctatgctgggacaaaggtggattctgatggaaggggccagagccagctctcgggctgctgccatgtttgcgctgggactcaaaatgcttcggatttaagctggtgggggaccccagggccagtaagcacagagcctgcttggagagaatctgggcttgccggaagctagtatgtgtggagaggggacaggtgcagcaggaatgaagccaggaaggtcatctgggtgaagctgtcaaagtattcacattaaactaatgagtaggagctgtcttagaggcagaagggacatggtttccacacatggaggtgctttcattggttttcaaaaggcagttctcatagaagattctttttttaaagtgagaaatggaagggtctagaagaatggaacaacagcccaggactgtgaaatgaggatctgaaataatgtcgaaagacattacaggggccagacgtggtggctcaggcctgtaatcccagcactttgggagactgaggtgggcagatcacctgaggtcgggagtttgagaccagcctgaccaacatagtgaaaccccgtttctactaaaaatacaaacaattggcagggcgtggtggcacatgcctgtaatctcagctactcaggaggctgaggcaggagaatctctgaaacccaggaggcagaggttgcggtgagccaagatcatgccattgcactccagcctgggcaacaagagcaaaactccatctcaaaaaaaaaaaaaaaaagggccgggcgtggtggctcacgcctgtaatcccagcactttaggaggccaagacgggcggatcacgaggtcaggagatcgagaccatcctggctaacacggtgaaaccccgtctctactaaaaatacaaaaattagtcgggcacggtggcgggcgcctgtagtcccagctactcgggaggctgaggcaggagaatggcgtgaacctgggaggcggagcttgcagtgagcggagatcgcgccactgccctccagcctgggcgacagagcgagactctgtcgaaagaaaagaaggaaagaaagaaagaaggaaggaaggaaggaaagaaagaaagaaattgcagagagacacaaccagcaggacttgaggggatttttattgagcccctcatctcgctagtcatgtcacagcagcaggaggaggagagccggtcgggtgatgggctggggtgggggcagggaggtgagagcagggaaggcaggagggtggaggcgatgatgaacttattgtgagttataccaggagaagtctctccggaacacccctgaggaaatgttccacagttattcagaaagatgagtctggggttctggaaaaggaattggagtggagggagatgggatcgaggtggtgagcctgaatctagccattcaacagatatttgaatcactaccacagaaaaagcatgagacccgggagagaacacaaaaatgaccaagactggcctgtcatggtggcttaggtctgtaatcatagcactttgggaggccaaggtgggcagatcacttgaggtcaggagttcgaaaccagcctggccaacgtggtgaaaccctgtctctactaaaaatattttaaaaattagccaagtgtggtggccgctgcctgtaatcccagctatttgggaggctgaggcaggagaatcgcttgaacccaggaggaggaggttgcagtgagacgagatcgcaccagtgcactccagcttgggcaacagagcgagactctgtctcaaaaaaaaaagaccaagacagagtcctgccctttaagtagcttacaacataattagggagaagaggtatctacagacttgtccaccaaagatcgtctgtgggggaaattcctgtgaacatgtagggtttcaaaggtgagggtgcctcacggatggcaggccccccagggcaggggctgctcacatgggctcagggcttgggtaggatttatgcctgtcaagatgaatgagaacttaggctggatgtgtagaaaggtggaaaaggagcaggcgtaaggatggaaactaaagccacatgctctctgtgcaggattccagaagcttccctatttcctggggagttactgcattgcccttagccctggtgagcagcttcttcattccaagtcctccttcatcaaattagtcctctcgccggataaacctctaagaaactaaaaccccttagcagagcagagtgcagtggctctggacccagtcaccacgttgaacctggtcgctaccattgacaggccaggtcccttcgacaggttacgtaatttctctgtgcctcaaattccacctctgcgaatgacgagagggaggaataatggcccctgcctcaagggttattttaaagactaaatgagtgaatatacagagcacagtgcctggctggtattaagcattacatagtctttcaaaaaagctgggcagctggagaagtgaggcacggtctgcttttctcgggaccttctttggccacgttaatgcctcaccccaagctgcaaaaatatgcagcccaacccctgagggaggaggaatgtctaattcgtatttgttttggttgtgcatgtgctttgtttggctttcccagggtctctccagcaccagagctgccgagctcctggcccgggatgggcccaactccctcacccctcccaagcagacgcctgagatcgtcaagttcctcaagcagatggtgggggggttctctatcctcctgtgggtgggcgcctttctctgttggattgcatatgggattcagtactccagcgacaagtctgcatccctgaacaacgtaaggctctggggtgtcccctcctggttttgctggcagagccatccagtgaggccttgggggcacagctgggggctgaatgccactgcctaggtgtgggaaagtcaggcattttcccagctgtaaaacagaaattctatctggctttctgatcttctagaggcagtgtgggcatgaagagggatacacaaaacaccttgaatttttaagggggagaaaatctgcatccatgtgaagtagtttggggttctgtctcccccaagctaacctcttcctttaacacggagagcagctgtgcctgccgagacatgagtaccaaatccacaaaactgaattggccaacgtgatgccaagagacagaagccagaggcaacaagctacatgtcataggattggattgacatgaaatgtgcagaacaggcacatccttggaagcaggaaccagatcggtgatgccagggcatgggacaggagcagggagtgacggcagaggggccggagggatctccaggcaggatggagatgctctgaggctgcggtggagggtggtgtcatggctctgtaaacttaaaaaaaaaaatcaataagttgcgcacttaacatgggcgaattccatggcctgtaaattataccagggcgtaactgccagcattgcatcctcccgtggagagctctagccccagggcccggctgcttcccactgctggtttctctgactgacgccctccttctcacccaggtgtacttgggctgtgtgcttggtctggtggtcattttaacggggatctttgcttattaccaagaggcaaaaagcaccaacatcatgtccagcttcaataagatgatccctcaggtgagtggcagccacctatcctctggcctctggtgactcccaggtgaggaagcctcagctgggaggggcacagggccctgagggctacgggtttccacttccttccctgtcggagcaatcgtgggcgaattaacccatctgtcagaaccccagttcctcacaggattttgatggtcaaatgaggcaccacccagggcagtgctggttagcccaaggcatcttctgttcctgctcctcagtgtttgtggatagtccttctgggttctggaagggacctgtggaaggtcagggagtgttctttcactggcagccaaggagaccagcctgcaattgtttatctgtgaccatttttgctcctgagccccagaatgcatttggtggggaagcccagtgctcccttcttccccaaaaacccctgtcaggtgtccacactgtctctggcccagagaactgtgggctggagagattctgggtggaaaagacgcctcctgccaagcttgaagcaggagatcacctcgttaaaatttccctgacactcgcaagattatcagcctccccagccccaccttcagtgttctgcccagacgcccagccaggattgctcacccttagtggtctccttttctaggaggcccagggctctggcttggccagatctggccaacagcgactcttctgttccaagaactctccataagctcaagaaaaagtagttcttagagtcttcaggcctcgggtgaagcagtcttctgtttcattcttgctgttctgacagcctcatgctccagcagcaatgctgtgtccacagggccaggtgcaggctgcataacagcatggactcaacagtgagagtgatcaggaagttccaaggcctctgtcctggggttcggtgcggcacagacttgggggagggccggtgtccttccagggtctgaggcatctgtcatggtttttttctgcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtaagcggcaaggggtatccaccccaaggaccatgttccaaacctgctggctctggggtctttcccagcatcagtataagaggcagggaatgaggtacccagctgtgaaccaccttcaacatttcttctaggtggataactcatctctcacgggggagtctgagccccagccccgctcctctgagtttacccatgaaaaccccctggaaacaaagaacatctgcttctattccacaacgtgtctggaaggtaaaaggcctctggctctcagcccacatgtccacctgtgtcctttctccctcctgggctctcaggtctgtcctttgccacaccccgttacaaagctcatcccagaggaagcatggaactgaagggcctagaggacgatgcttggccttgggaatgtggtgtgcctatcgattgtgccagcccccagagagggctgcaagctggctgcacacccctcctggctgaggacccctggaataaagcatctacttcccctgtaggcactgtcaccggcatggttatcaacacgggtgaccgcaccatcattggccatattgcctcattggcctcaggagttggaaatgagaagacgcccattgccattgagatcgagcactttgttcacattgtggcaggagtggctgtctccatcggcatccttttcttcatcatcgctgtgtccctgaagtatcaagtcctggactccatcatcttcctcattggcatcattgtggccaatgtgcccgagggcctcctggccactgtcactgtgagtccatgctgttagacagcctgcacctggccctgtggacacagcactggtgctggggaggcgcccacacaaactgcaatctcccccaagtccagagcaccacaccctccccgccagcgacaaccctggaacattctgcatagactgttccttacagagacaaaaaatttgtcatattttcaatatttgactgcgttttccttgaaaacgttatgctttcaatctgcaattcacacagcttactctgccccataagatctagataagacagactccaccattcacaggttttctagaagcttgatgccttccgcacatttctttggcagtttctacaacttaggcatttaggcacattgccacactccacttacctctcttacgaaaaaaaaaaaattcctcccatttttcctgccgaggactccagccctttcctggccaaccccagacccagctgtttgtatgggcccatgtcattcagtccctagagaagagccccctcctcctcagtctctcctgtgggggtctcaaggggtaggagaggagggggtttatgtttccagttttgtgactacatgatcattggcctgctattgtcctgaccaaagaaaagagaagaagtttttgaagtccaggtctcctctgactccaggagatagtaatttggggaaattggagccaaaagaaccctttgagatctaggggtttaaaagaatctttaaaatatggagcttttaaaatgaaacaacataaaggctgctgaattccccaaagcaacaagtgtgtcctttgggacaactctttggcatgcactggtcagtctctcttacacactcctgcttagggatcacaggaggcgtcgtgattgtacgtgaacacgagccacagcagcgtgtccgtgtttgctgcccgtgggtcccttgttttcttcaagtcatgaaggaacaagaaaagcatctcatatttaatctttaaaaaaggattgtggcatagagggctcttggcggcgtataagccaccaggtcagcttagctgcgctgacaaccacacctctcccctaaaactagtccagctctctcctaaaattcaatcacagctcacattggctatttctgtattattggacctgagttcaaatgaggatttttcccaaagcgtccttccctctcctgctaggtgaccctgtcgctgacagcaaaacggatggccaagaagaactgcctggtgaagaacctggaggctgtggagaccctcggctccacctccatcatctgctcggacaagactgggacactgacccagaacaggatgacagtggcccatctgtggttcgacaatcagatctttgtggctgacaccagtgaggaccattcaagtaagtcttatggagagctcggtctggccaaagctgtggactccatcctggggctgagctgagcacacagcagggtctgcagccagaggattgctggacagtgactcatggacggccagcccaacccacagcagccactgttctttctctgtcttccagaccaagtctttgaccaaagctctaggacttgggcctccttatccaagataataacattgtgtaaccgagcagagttcaagccaggacaggaaaatgtccccatcatgaaggtaatgcttctgcagcacttggtcttaaatcacagccagtttgtagtcacttgctgaggtctgattgggtgcttgatttcatctctccagttgcttaaagtttgttcagtgcttgcaagagcaagtcagactcacaagacatccagaaatttttctttatgcacactagctttgagaatacaaagatgcttaaaaggtttcagaatattgctttagcgtcttcagaaaattctggaaatgaatgcacttctaagttactttcctgacttttctgccagctaagtggatataatcaaagttccttttaatatacacaccattcatggaaatttaaagtgtgattgaataaaaataaaaggactcctgttaactagaatatggctgcagacaaagctctaaggggtcctggaatatcggaacatacaataaactctccccctccctccctctcctccttcccttcctcccttttcctctccatctcaatgagtcactgaatccctgttctcctggcttttctatttgccatctgtttccttccctgactctttttctttcttatttttttgtttgtttgtttgcttttctctccgtcagacagctcatgaatgctctttttggccaattgcttctttgtcgatatcttccaaatctttatgtccagctctaatttcttacctcaactccaacccgaatctctggctggctgtgtgcttccgctaggaagttgcacaaatcatgcttgttaacttccacccgtacccagcctggctgcacatcagtgccttgccgcaattttctaattgtctatgatataaccattctatttgtcattggaacagaatatttggaagtcatctttgactttatcctttccttatatccagtaagccaccaagttctatcattcttgcttcaaaatatacataactttagtatttgtcagcagtaccttgcatctaaatagccgattaccggctgattggaattaaacctctttgattccggtttatccctcctggggtctttctcgaatgccactaatttcccttaatggtgcttttatagtcacttaactttgctcaaaatctctccgtacttccctgttttctgcttctcaagtctagacctcaggctacctttcagggccctccaggtcttgccacaccctccacatccgcttgtaccttgaacactcacggacgagcctgcccctcatgcccctgcacccgcatcctggtttctggaaggctttcttctctgtgtatcggtaacccacctatctatcaagatctagttcgtagctgcttttttccacgaaatcttcagtcctcgcagaggtccagcttctccaaacatccctaatgccagtaggtggcactgttgtttacacgcttaccacggtcttgcggccctccctgatcacgtgataatgtctctccagctaggtggtaatgggatcaggagggtgtgttttgggtcctatgctgagggcatgttggttcattaaatatgtgctgcaaatatttttcttctttgattcccagaaagctgtgattggagatgcctcagaaactgctcttttaaaattctcagaggtcattttgggtgatgtgatggaaattagaaaaagaaaccgcaaagtagctgaaatcccttttaactctactaataaatttcaggtgagtttttcctcacaaccggtaatctctgtcatcggcagcatgacctttctacttgcatgcatcctttgcttacctcatattttgaaggatacctggcttcaaagacagtcgtcagggatacagcacccgggcatctggtcccctaggtcaagctcccttgctggcctccttcctaaccctgaagcagggcagagaaagaaagaaaggcaaggacttcatcagggcctggctgctcctatgaatgagccatctctgtcacaggcacacactctctctctcacacacacacacacacacactcacaccaccactatcaggtaccttctgccgtgaggagcagcagccatactccaaagcataaatgccaggtgggcagcagggaggccgaacacctgctcctctcacctctagtgcatcaggccctcgacctacgtggcctcgttccatgttcgcatcccgcctgtgaggtaggactgacgaatcctgactcagaggaggaagcaggcccttagaaagtgttgagagaccagagtcacacagcacccagtgttcccaagcctgacaccaggtccacgattcttccaccatcacacagagggagtacggcacagttcaggccatgggagcaagccctgccctttggggagaccggtgagcagcccctggggtgacagccccgtcgttttctggggccagcccctgtgctgtgggtgggggtctcctttccatcccctgctcaggtagaagacggccttccttgcctggttatctcagcaagcagggctggccgacagtcagccatcacagcctccccatgttaagacaaatgacagttgggagccccaggtccccatgcagatgggattttccacagagcccacactggatctggacttgggctttgcacaacagtaaagtatagaaatggaataaccacaactgtacgtgtggagatttctggtgattatccacctgtcttagttcggatggaatttagggttagggaagaactctttttttttttttttttttttttttgagaaggagtttcactcttgtcacccaggctggaatgcagtggcacgatctcggctcactgcaacctccgcctcccaggtataagcaattctattgcctcagcctcctgagtagctgggactacaggaatgcaccccctgcccagctaatttttttgtatttttagtagagacagggtttcaccttgttggctgggctggcctcgaactcctgacctccggtgatctatccgccttggcctcccaaagtgctgggattacaggcgtgagccaccaagcccagcctagagaagaactcttgtgttgcaaatgtcttctttgtggatagtgagccaacagagaatcacagttagctaaatagacaactaaccagaaacatatgatgtaaaatactcaagccaagaaaccacatctcttacgtaaaaccaaagtgaaaatagagtgcgcaacagtcctaaaagactattttaggatgagtattattatactaataatactagtgataataggagctattctgtgctaatttccacaagtattaaattattcattcgcacgacaacactgtggggtggctagaggatgaggaggttgaggtgctgcgcatcagtgcacagtgtgaagatggggttagatgatgcctccatcagcagcaggacttggagccctgctgaagctccatctcccatggtaaaggcatgcccagttgcaaaagggagaaaaagcaggttccatgaggcctcatgtacaagttggaggagaaagtggctacacagagtgggactagaaaggggagaggggcctgtgtgagttcctgctgaagaggtcggaggtgctgtctggatgctgttagggtcattttatatctacacatgagcggtgctcagcctcaccagggctttagatgtcatggccttggaaggagacgtctctgcgggaaggaaataaaatggaaagcctgtgtcttattgattagaatggtgatgccccaaacacactggtctgttaagacatttgaaacagtttacggcaaattggaaaatgttttataaagttttatataaagatgaatgtatttaatttaaaagattatcctttgtagccaccatgattaagggcagggactctggagcctgctagcctgggctcaaatcccagctcagccaccagatagccacctattgctcagtgaccctgagtgaagcattgaacctctgtgcctcagtttcctcctttgtaaaagggaataataatagtacccatggccttaaagttgttttgagaataaataagtcgatgtggacagcacttagaacagtgcctggcacgtggtacataccataaaagtgtttcatattatccctatgttttaaatgtaaaaagccttatcttggccaggtacagtggctcacacctgtaatcacagcactttgggagatcgaagaaggcagattgcttgagcccaggagttcaagaccagcctgggcaatataccaagaccttatctctacaaaaaaaacaaaaaacgaaattagctgggcatggtggcacatacctgtagtcccagctacttgggaggctgaggtgggaggattgcttgagcctgggaggtcgaggctgcagtgagctgtgatcgtgccactgcactccagcctggggcacagagtgggaccccgtctcaaaaaaaaaaaaaaaaaaatttaagagagaaagagagaaagaaaaagaaaaggcctatattttagaaagtgatagagctgggaggttttctgtttggtttggtttttgttggttggttggttttctcaatgtctttacttgatcattaaaaaaagcagcagcagcagctggtaaccctatttgccctatacttctttttgtactcatctttgatacccagaagtctaagaaatactgatttgtaaagaactgttttacccaaaattgtagcacttttctttgcaacttattttctcccaaacactccagcttcctgagattcctcttgagtgcttagaagagtacctggcttatcagaagggctagataagagttagtccttttattcttgtatatcgattttttttgcatatcttattaggatggatctagaagtagaattgctgggtcaagagcattcctattaaaatggagactcctgtgactcggctgtcttcctgaaacattatacgtggaagtgtccacttcctcacaccccgccattttctatgacatccaagcaggaaaactgggtggacaatgaggtgaggaggtgcagaaattcctgtcgcctcctcccctcctgagctcagaatagtttgggtctgaaagatggctgctccccacagggaggtagaggaggtgagatgcagaggctcgcagccccctaactctcacgggcaccctgggagatcttgttcaaggcacaagatttcacacgctgacggccacaactagcctgcctaaagcagccagttttgcttgaaagatgagctccacttatccagagtgggtgccccactctgggctggggccaagtctagagctcttcgtcttacttggccacagaaagaaaaagggcggaacatgctgaggatgccattgtgcctcttcctcctttacatttaatggaccagtagagaagaaggaatgcgtttcacctttctgtaagtaacacgctcagttcattccttcccagctctccatccacgagatggatgacccccacggcaagcgcttcctcatggtgatgaagggggcccctgagcgcatcctagagaaatgcagcaccatcatgatcaacggcgaggagcacccactggacaagagcactgccaagaccttccacacagcctacatggagctgggcgggttgggcgagcgtgtgctgggtgagtgcggcggcagggccctgcccatcacctggtgggcacagagatgaggcaggcgccttgaggacctgtgacctagcccagtggccatggcatccacgtgaagcatgtaaaggagaacatgataagcaggatgggaacaaggagaggatgctgtgtgacagcaccaagcagggtgggatggcctccagagaggcaagctcagggaagactttatggaaggagttaaatttcaaactgggccttaagtgactgcatttgaggggagataggggaaagtatccagggcccagggaacagcacaggccaatcacagaggcagaacggcgtggggcacattgggtgctgccagcaggtgagatggcactgtcacagaaacagggttcaagggctggactggaggtcatgagatggaggtcttgaacatctgggtgaggagccaggtttcatcctgcagtcagtagagagcactgagggctgtgccactagagtgagctgggcagtcgcagggctggggaagactttatggaaggagttaaatttctttaacttctttaaatgtctttggcggcagcagggagaggagagatgcacatctccataggaagcagctgcccttgctcaggcaaaagggatgggaattttttcagggtgatgggaatgggaaggagagatcagggcaagagacttcatagaggtagagtttggtaagatttagaacctatcagagaaggataatgtttaaaaatgattaagcttcccatttaacgactaggaagagagtgatgccagtgatgcagacaaagtgtcaggaaggaaggaaccttagaaatgcaacaggaggaggacccaatgggggtgcctgcggtgttgtcaaaggggacagtgtgtcctgttgtcagcaccagggctggcggaatggtgccccatcaggaccacagaatgacaaattcaaggaaacagaagtgtatggttgacgatccggctcattaaacaccatggaagtcctcaccaatacagatgcagtctatggaatgtgtgtttctaaaggctattggagttggcaaatcagataaagcatataaatgagatggtgatgctttaggcatccaataacccacagtaccgggtattctacacgggatcgatgcccacttgcgtttgatttctcaaagcctgctccattgacatttgcaaagcagtgggccaggctgaaaataaattggatgtgaaagctgatcacacaatcttggaggtcccaccagacacaagagtcccttccacctcagcctatgagaggctgatgccttctgagaaaaggatggctcggccccattcctgctggcctttctcttgggcttatcttgatctagcactgaactttgtgcccctccgctgaacccccttgttccttcacatgctgttttctctgctgaaaatggccttcccacctccaccctcccttttttccctagaaatcatctttgcccctctcaagcttcacctcacatgtgacctccttggggaagtctctcctaatcctccaggcagctgaaatgtgtctctgccctgagatgtaccctatgcttgatccctttaactctgtgccccgctaaacttcagaagtcgagactgtgtattgccctagaacttggcaatatagcaagatatatttctagaacacagagcctaatgagctcacagtgaattatatttggatgaaatatgtctttcctaaaaaaatgcattatggagttgaagaaattaaacaattctggcttattctaatgtattggtaaaacagcagaggaccaaggtgtatgagcatgttctcctcttattttttttcgtttcctattctagtttcactgactcactaattcatctgtattacaggtttctgtcatctctacctgccagcagacgagtttccagaaacctactcatttgacatagacgctatgaactttccgacctccaacctctgttttgtgggactcttgtcaatgatcgatccccctcggtccaccgtgccagatgcagtcaccaaatgccggagtgcagggatcaaggtgggagttattttcctgactcaagaagttctttctttatgtcgtgttcctttctaataatggttttcatagcagatggtcagtatttaggtgtcttcaagtaaatatcataattcctattttatttctagtttcactgtgctaaggttactgaaactgtcccacaaaaagaaaatgattgtgtctatgtggaatgaaccacataaacagtaaatgcaatgagaagaatctcctagtgccttgaagtgaccatatctcgccctagtccatggtagatactaaaaggctttattggctgggcgcagtggctcatgcctgaaatcccagcactttgggaagctgaggcaggcggatcatctgaggtcaggagttccagaccagccatggccaacatggtgaaaccccgtttctactaaaaatacaaaaaaattagccagatgtggtggcacacacctgtaatcccagctactcgggaggctgaggcaggagaatctcttgaatccaggaggcagaggttgcagtgagccgagatcacaccattgcactccagcttgggcaacaagactgaaactctgtctcaaaaaaaaaaaaaagaaagaaagaaagaaaagaaaagaaaaaaagaaagaaaaaaggctttattactcagtcttgaggctcagcccccataatccatgttcatcattactaggttaatattaagactgttgaagtaacatggggctacccccaagtagacactcaccagccctttcacaaataaagtggcatcaaaggggaagggcttcctttcatgtcagaggaggaagcgtatgaagcttaggagcaagggtagacccaatgggattagtgtttcctccaaagacagttgtctcgtagatccagagctgccactgtaatcaccaaccacgttctcccagggcactacagagtaggtattactgaaccatccccactttggccaaccgagttcttcattacccgtgggccttctcgttgtctttgctctaggttattatggttactggtgatcatcccatcacagccaaagctattgccaagagtgtggggatcatttcagccaacagtgaaacagtggaagacattgcacatcgcctcaacattgctgtggagcaagttaacaaacggtaagcacaggagcagcatagtaaaaattccagtttatacccatggggccccactggctctaaagagctgcactacttggaacaaatcagctttttgctctcagagttatgctaggcttgtttgagctattatttgcatatccatgtattcactctaatttcactgagcagctaatatgtgccaggcacagtattgataccatgaaatgaccctttatgtgttccttgtttgaaatttcaaaatccagtgtgccctgggcacaaaacctatgtgcccaatttagaataagaaaaactgaaacaaagggtttatgtgaaattacttgccatagatgcagttgcataatttggaatcgtaagaaccctgtgggttgtttcatgcaccctccttggtaagcatcttgggtatttatccacccggtttcataacgtgtagctatgtaaacacacccttcttttttatttggtaatagatagaatggaagcttcctaaggaaagtttttttccttgtttctcctaattcttttaatcatgtttatccttattcttttaatcatgttcatccaactgtacattcactcatgtatttgttctttcaacaagtatttactgcgtgccaactatataccaggcaagacctggaactacagtagcaaactgaacaatactatccacaccgttggggaatctttccatcgagccaaggagacacaaacaaagctaacaatgatgtggccagtgtaatgagggagccacacaaggctagggagctgggcatgcaggagagtggcctggactgtgcctggtctccatgagtcaaagactccgaattctcaggttgagaagtaatgttcattagctgggttatgttttcacgcatgcgggagatgagggaaagaccaatgcacctcttcagtttccccaagcacttaggtcttttagggacacacagctgtcaggtcataacaaattaccacgttagacaaccaaccagggttcccgcctctgggcacagcagcagtacctgaagtctaagagtcttgcagtgccctttagtatacataacatccctctatgaaaacaactttggggcttgtttatttgtttggttttgtaagataatcggattatactttttttcactttagaattttaaacaaattttgtttgtttgtttgtttgtttatttagacagagtctctctctgtcacccacgctggaatgcagtggtgtgatctcagctcactgcaatctccacctcctgggttcaagcgattctcctgcctcagcctcctgaatagctgggattacaggcgcccgccaccatgcctggctaattttgtatttttagtagagacggggctttgccatgttggccaggctggtctcaaactcctgacctcaagtgatccacccaccttagcctcccaaagtgctgggcttacaggcgtgagccaccacacctggactaaaagaaatttttttaagagtagtcaagtgcagtagtgagaagaggggaaagagtagaagtttgatctgtaactgactgtgaacaatcagttgagctaattcactactaccttcagaccagccgagtcttctttttttagatacaaggtgtcctgtcagatcacccaggctggagtgcaatggtgtgatcatagctcactgcagcctcgacctcctgggttcaagggatcctcccctctcagcctcccaagtagctgggactacaggcttgtgtcactgcacccagcttcattttagcagatttttttttttttgagatggagtctttctctgttgcctaggctggagtgtggagtgcagtggtgaaatctcattgcagcctccacctcctgggttcaagggatcctcccctctcagcctcccaagtagctgggactttaatttaaaattttagcagatttttttttttttgagatggagtctttctctgttgcctaggctggagtgtggagtgcagtggtgaaatctcattgcagcctccacctcctgggttcaagcaattctcctgcctcagcctcctgagtagctggggttacaggcatgtgccaccacacccggctagtttttgtacttttagtagagatggggtttcacgatgttggccaggctggtctttaactcctgactgcaagggttctgctcgccttggcttcccagagtgtagagattacaggcgtaagccactgcgcctggcccattttagcaatttttaatgaaagttgtatataagataccttattcctgcatcttctcaattgcttcttttttatatttgcccttccttccctacttaggaagatttgtttggccttccattcaaggatcttttgtggtctttgtctagttttagcctggtgatggccatgtgctggtgacgtgcacacgacggtcctgcccttagcctcctcctgtgctcctgttcagtataggtggcacatttcttcctataaacctggactgctttgccaatttgctggcccgtatagtgtctttgtgcaacctcaacttcctcatcctttcagatgggcatggatggaactgtgcttgtagcagactccagaatgtgcttctgtctcagctctttggaacgagagaaagacataatcttcctacgaatgtgggaaggtgcattgaaatgacttttatgattcttgcctcagtcaaaagtcacaaagggactgcacttcctcttggtcactgccactctgctcatggccacaaaagggaagagtggattacacatttgtatacaaatcaccacactgagtgaagtggatgcttttgtgaatgttttcagttattcacttcatcagctctagtttcatgaccatataaaaattgcatcttagcaggtgtaaggggaaaggaaacaccccttctttcttctcttactttcttttgttttgttttgttttgtttttttgccagcggttaaggagacctgtagtttgagtcaagtgctagaattccagtatttagcaccaagaggtaaaacagacctagaaagctcaaaacttgcaaattgtaaagaaaaagacctgcagcagtttgtacctacattgtttaagctgagatttgaaggctgaaatgtagtgttagccacgagaagctgaggtgagagatgcccattcctggtcagggagcgagacccgtgaaggccttagggtacaggggatggaggatgtcagaactgagagcatccagcgggcaggagggagagcccaaggtgaggcgaagcttgacaacgcaggccccacctgggctcgctggctaaagttagggattccggggtctgctccaagcacggtggaaagcccctgaagagttttagcaggggactggctcaggcagctctgcataatcaataggccctagaaccttacttttatagtcagcaggcaatagcgctgctcaaagacttcagtaaacttctgcctacgtagcacattgcacaaagatgacactctgtaaatctgaaatacccaacggcaagtaattattaccccttgtttggccataaaagaattctaggacccaaaacatatgaacaggcagtttgggggttttatttttatttttgtttttgagacagggtctcactttgtcacccaggcttgagtgtagtggcatgatcatggctcactgcagcctcaaccccccaggctcaagcaatcctcctgcctcagcctgctgagtagctgggaccacaggcacatgccaccatacctggctaattttttaaaattttttgtagagacaggggctctcactatgttgcccaggctggtcttgaactcttggcctcaagtgatcctcctactcagcctcccacagtgctgggattacaggcatgagccactgcgtttggccatgaatgggcagttttttaacttccttttacttctgaagtaaagcgttgctctaggaagtaccactctcacctgttctagtagggataaggctacctggttttttattcctattgttatatggtaccaagaaatggtgttatattttagcctcagtttgccctcttgaaatggagactaaagtgttcccaggactcctgttacctcactagagcattaggtatcaaggacactgggttccaggtcaagtcagagaggcttcagccagcatcctgcctggaacagtgtttcaacctaagatctgcccttgggcctcacccagtttcttctggcccttctagggatgccaaggccgctgtggtgactggcatggagctgaaggacatgagctcagaacagctggatgagatcttagccaactaccaggagattgtctttgcccggacatccccccagcagaagctgatcattgtggagggctgtcagaggcaggtgggtggacagcagtgtccagaggactgacaggcccatcactgtccatgggcaagtgcagaggtctggatctcacatcaggctgtggtgcctttgaaacttcaagagagagttcttggctcatccccatcacctgacctctccaacctctcaggtgggctggcccctgtcctcctttgagacccccaccacatgttccccgaaaggctcaccccagctctctgcattttgtcatgagagcccggtgaagcatttgccactgtggtagttgtgagtaaagagagatttaaaatgcaaagatttaaaacaaaaaatgtgaagacataagatacaagacacctgcgcattaggttttcctcatttgcacgtatcttgtttggagacccttgttcctgcttctaagatttctcatctttatcttttcccctaaatgggcctttccgttcagctataatcatcctcgcaacctcaagagaaagggaagtcttgttgctcttgccaggcctgcaacccactgggcctgctcactcccactttctccctgggtcccccgccataggatgctgttgttgctgtgaccggggatggagttaatgactctccggctctaaagaaggcagacattgggattgccatggggatagcaggttctgatgcagccaaaaatgcagccgacatggtcttgctggacgacaacttcgcatccatcgtcacaggggtggaggaaggtgagtgagtctcagggggtcttcccaagggccagggtggtctgggggactagaagtaagttctgaaggagaaacctctctgcctaggtcgcctgatctttgacaacctcaagaagactattgcttattccctgaccaagaacattgccgagctgtgcccctttctgatctacatcattgtcgggctccccctgcccattggcaccatcaccattctgttcattgacttggggacagacattgtaagtgacactgaagggaacaggctgtgatgcctgccccaggggaggtcaagttcagggtcgctaccttcaagggccggggatggactaactcaaggcttctcagcttccatgtgatggggcctgtagctctgcatttctcacaggttctcaggtggtgcccattctaccagtccacatgccacacctcaaagcaagggaccagaggcatctgccaaatgtttggaaattaaaaacactctatagtgagcttttttttcttgagacagagtttcactcccatcacctaggctagagtgcagtggtgctatcttgcctcactgcaacctccgcctcccaggctcaagtgattcttccacctcagcctcccaagtagttgggactacaggcttgtgccaccacacctggctaatttttgtatttttagtagagatggggtttcctggcctcaagtgatccacctgcctcggcctcccaaagtgctgggattacaggcatgagtcactgcacctgagctatagcaagcttttcaagacatgagtcttcatcctcaaaaaaaaaaaagaaatgccattggtcagtttcagcctatgggcttcccttttcttttgggaagatgaagctgtcactcagattaatcacccaaataaccactgggggcccagtgactaaagtgataatctcacagccacctcttgttaagtaagagagtctgacatggaagacctttacctaaacacagtaagaagtagcagttatgaagactttataaagccttgccctacagtaatgtcacctaaaccttccccttttccagtatccatttaaagaaagccccgtctaagctgcccatgtggctgtggcttacgtgggcaagcagggaaagcaacagacagcaagctgaattcttagcaggaaactggcccttcgaagtgcccccttccccttcaaattgcccccttcccctctcttgttttctacaacacccaggtaatccctaattcctagagagactggagatgtctttccctttgaggggtattgaggtccccaaagttgatggatcattttccaagcccttcacatttgcctgctttgctctgctgcagtgcttctccaggcctggtgcgggcatcacctgggaacttgttagacatgcacactctgggcactggtggacacctgtagcctagctactcaggaggccaatgcaggaggattacttcagctcaggagtttgagtccagcctggtcaacacagagagacctagtctcttaaaaaataaaaattaagaacaaataaaataaaaatcttattccagataactgggctaggaatggaaataggttgtacacccattgtcttttaaaaaagagaaagaaagaaagagaaagagagaaagaaagagagaaagagagagagggaaagagagaaagagaaagagagagaaagagaaagaaagaaaggaaagaaagaaagaaagaaagaaagaaagaaagaaagaaagaaagaaagaaagaaagaaagaaagaaggaaagagaaagagaaatgaatgcaaattctctggccccagcccagtcctcctgaattgggaagtctggaggtggggcgcaatgatctgtctcttagcaggtcctcccacctggagggagaggacggcacaagaaattctccctgtaggggaagagtgttttataaccagcatccttcagaactgccagcacagggtgataaaaagcagctgatttctaaaggcactattcttaaatttccatacagacaacacgccctctactgcctatagcctggatgggccagctccatgccccccaccccatccagccagtgccccacccaccccagcccccctcccctactgtgggtagagcagaacatcctggggttagacctcaccagcctcttcccctctagatcccctccattgccttggcgtacgagaaagctgaaagtgacatcatgaacaggaagcctcgccacaagaataaggacaggctggtgaaccagccgctcgctgtgtactcatacctgcacattggtacgatgagggcgcgtcttccccatcacacgagggcctgccccgagaattcactggagtggggggcacagccagaaagtgtggttttcctgtggggcctgggttggggagggagggggaaccgagagtagacaggatgaggcagtttcctgaggccatcatagaacctgtgtcctatctctcttgttctttcaggcctcatgcaagccctgggagctttccttgtgtatttcaccgtctatgcacaagagggctttctgccccgcactctcattaacctgcgggtagaatgggagaaggactacgtgaatgacttgaaagacagctatgggcaggaatgggtgagtggcgggagccctgctgcagagtccacctgattctctccatgctcattgccctgcgcagaattacatagaacctccatgtccctgaacagcctgggaaagcttcaattaatagggctcagggcccccttgctgacacgtgtttggcctttgccaggtctcatggcacagcctcctgtcttgggctagatgacaagaggtccctttttttaccttagctttgccattggtatagaagagtgaccagcccagccacacccacagtgcggccaaataaatttacatctttcaggccgggtgcagtggctaatgcctataatcccagcactttgggaggctgaggagggagaatcacttgagcccaggagtttgagaccagcctggccaacacagtgagaccctgcctgtgttagaaataatagtaatgataattttttaaaaaattaacatttttctctactcagctggttcaagaaagaaaaatgtttctttccaaacactagaaggtggtccattctcagtccgggtgaggtgtggaaagaacatgaagctttagagaactgcattggaatttcctagaagttttcctttaggcctcaaggtctcttccttctctgcccattaacagacaaggtaccagagggaatacctagaatggacgggctacacggctttctttgttggcatcctagtccagcaaatagcagatctgatcatcaggaaaacccggaggaattccatcttccagcagggtctcttcaggtactgcctgtgcccggcctcctggggcagccctgggcctgccgtgcaaggatgatgatgatttgtttttcacaagacagagttctggccacacttgtaaccccagaggcattgatttttctggtggcatggtctgctgggtgtatgatcatgaagccacaagaatcccaagtctgtctgcttttgtgtgtcttgcagaaataaagtcatctgggtggggatcacctcacagatcatcattggtctgatcctctcctatggcctcggaagtgtcacagccttgagtttcaccatgcttaggtgagttcaccctcaacagcatggaggaaagagccagcctctgctttgagctgtcgcagcctaaataaacctgaggattcccagggttcttccccaagtctttcaaaagacgtcaaactgatcccatgctctgtgagcccaaagctttgatctgcattttccagaagtggaaatgggttttctagacctcaccaaccggccttcatcctcatccaacaggttgcttcaaaggcagacattgcttctagcagtcacagtgcaggttaaacaaggagctttccacctttattttgtgggacctcgtggatttgtcgttctttgcagtaaagcaagacaaatgaacgagaagccccattcccattgggcagggttgggctatccctgtggatgagtcagggttcactttccatccctttgcttccagggctcagtactggtttgtggctgtgccgcacgccatcctgatctgggtgtatgatgaggtgcggaagctcttcatcaggctctaccctggaagtgagtagcctatgattttagaggctctgtttacccacttcaacagactctccatttctgatgtacttttttctacctctacaggctggtgggataagaacatgtattattaagaccacctcccttcctatgtctctcagcagcacgttggggcacacttgttcatcttctgaccgtttgctgggctattcccctgcagtgcagacatcgtcaaaattcagacaagaggaaattttcatgcagaaagctgtatgcaggatgctcactgatgttttgcactttaaaactgaaattcaactctttatataggattttcttttctatctccatctcctcattaaaaaatacgtacatttcgaggtaatggtatagggaagaatgtgtttatgtgtatttgaaactccttgatgttaatagtcttgtgtaacccaggcatctactggggcctgccttaagctctagctaggattgctcagaactcctttccacaccctattaaaggccccatgacctccctaagatttctgcagatcccctgagaaggtatgttttcatggtctccttgctcgaaaaaggccaactcacccgagggtctgcaggagatggaagtggcggcaggtttacatcacagcagcacgcatgacctcagctttgactcgtttaactctgagacgtccttcttgaaggcccttgccacagtttccctggccacgccaccccatcccacctctggtcatctccccagccctttatgccccgtcgccctccacccctacatcagctcctccaaaactgagctcccagttcattttgcatatcctaactcaaaatgctcagctaatccaaggggactttctttaccaggattcaaccctagtagagagctgttatggtttcaatagtcatatttatttcttgtaaaacagttgccaggtgctctccagcaataacgttttgtcagtcatgtttcatgttttaacttaggtgtattcatgtgtgacacttccatgttgacaggcccggaaaggcctcatttttaactaaaagatgttttataaacccaggtttaattgtggtgttctaattggttcacatttttctagaatgaagagcatgggacaaaaaaataagatatgatttcctattttcttttcgttgctccttctggtcattttacttatctgtggaagatctggaaatgtaggatttttctttcaaactcttcctcatgaccccagggctccagccagggcctctgatgtgccctcgattcttggtcggacgcctgtgggagggcccgtctttctgcagcagcactcgagagaagggttctacagcctttccatcaactgcacacctcgcactaactcatttgacagaacgtgagaattatgtttggttaagctttcctcatctagtggcctgccccgtcacctctctccattacagtctcactcgggggcatctggggctgatggctctaggttggcatctcctggacaggaaaaggcagccttagagtcaccatgctcttggggtcacatgtaggagcaggaaagagggaaggagactatccttgtaactttatgtatatagattccagtgcatattgtgtgcagccatgtaagctaaaataatgttgctgtcctcaggagatttgtaatctgtgttcagccacaattatcattggactaatctatcagtagttccagtgaactgcaaacacttcccagagtggtttgggcagtgtggtcatggctttctcgttccagtctcgacaaggcagctaatgctttctagacttcagctaagaataacttgaccttacttaatctttcttgacaggctgcctgagtgctcatggctgcaatgcttggcagctcttggtcctgccaatgccagcaggacaaggccatcaatttagcacaaagctgcaaggtttaacttggggttggattagggttgaaaggagttaacttggaattagaagcctcttcatagcaggaactatgtatgaaataacgttcctatttgtgcttatttactcttgcaaaaagttgacactcaaatatttataaaattaacaaataactaacttaagaaatcccagaaaagacactagcattattgagtagctttattaagttgtagacagaaaaaggcaataaaatccatttcagagggtgtttttggagggactatttaattgaccctctgaagcctagatgtcttttattataggaaaaaaaaatgtcaatttaaatctaattgatgtggtagagtatctcagagacataaacatgaggctgaattcctagagtctttgctttttaaaacaatctaatttattctgattataaaattgcagctc

SEQ ID NO: 15331 - DNA, 17599 bp, Human
atcagaggttaacacatagcaaagaggtgacagagccagaactatctggccttgttcagaggcctccagattggactggaatgcctgtgctctgaaccctttcattgtgttcttcctgctttcttagcaggccacttctttctaaggtacttcaaagaacagctccccatcaggggccctgtgtgttgtggcagtgtgatttatgtcaaggaccattccaagggaagtgtcctgaaccggcagctcctgccagcctgacacctttccagtgcctaacccgagtcaggagattccttccttcctccttccgtggggatgcctgacattgtagctacattgggtttttgtttgtttgtttggagagaggaccttgctgtgtcacccaggctggagtgcagtggcacagtcacagctcactgtagcctttacctcctgggctcaagcgatcctcccacctcagcctcccaagtagctgggactacagttatgtgccaccacaccagtctaatttttttttaatgtttttatttttgtagagacagggtctcactataatacccaggctccgatcatgctatgcttaacttttaggaagtgtctggagctctctgttcggggacctcagaccaataccttcctctccctgctcacttgtagcagttccttgtatactggagccctgtctaacctgagtctataaatcacccttcctactcagaaacccctgaaaatggggaaccaagcaagccgctggcatgtgctggagcccaggtctcctgggaaggtccacatgggggatggtgtcccgtagcaggctgtaggtttcagagcccagcgggtggtggggagccctcaatttgtaaggaaaggccagatgacaattgtctttcttcctggttcctcacatatcataaaaccacctctttctcatctccaccacccccatctccaggcttgactcactgattgttttcttttttggacaatgtcagaccctgcccttttcctggaacttctcagtcctccactggcctgcgtcagcaaattcctaagtagcagatgaccttcaagatgtgtgagaaggaagggacaggaatgattgtcaggattgtcagttccccagggaactctgcatttctgacttagggagggtagatgactcacccttccaagaacccatctgtctgtccgggcctgtggggctctggagaatagaatatggagtaccctggtttacaggcactgccacctccttatttcaggatgggttcagggatgtaggattggagttgggagatttcttagttctgctatggatgctttgtacttaggcaagttcaaaacctccctaagctttggcttctttactgggtaaagtagggttggaggcatttcaggctttccttcttctcacctgatgctatcactacacatctaggcattcacgtaatggaaacttacaaagttgctcaatacctctcttcatgtccccaaagagagcaagcaagtgtccccattatacttcttacagtgaggagccagagcttccaggtatgctaagccattgctccctgttccactgctgaatgcatgctggtgccttccagagtcacccctttggtctgattcacttagtgctgtggctccgagaagtggccctctctttcagccagcagcttggggtggggccagtagagtgggaaccacagtggctatatgagtcaatttgctcatattgtcatttgactcactgaccctgatggggaagatagtgttattcccacagtgtggtagtacacactggggcttatagggactgagcctactcaagggtatatggtgctgtgggtcagagctggggcatggcccagggattcagtgtgccttgactccccctgtaaatgttcctctcagaagccttcttggccttccagcccttggtttttgagacaaccagcagtcatttgttcgttcctgacattccttcctgtcccttccttccaggttctgtggacaatcacaatgggaatccaaggagggtctgtcctgttcgggctgctgctcgtcctggctgtcttctgccattcaggtgagtgctccagtctcaggacatggatctaggctgccttggccatgaactcccttcttaagcctcagtttcagccccagctgctcctccaggcctggctttggttcttttgccttccagtgttacaggtctggggttgtatgacagctccttcctatgttatgaccttgtcctcagtggggcatcgtcctgagttacagcccgtcctgagttacagcgtggcttttggcaggggtgggtcaacaatcggcggctgaagtttcactcctgtcaccataagctgcttggggacaccaatggataccattcttagagtgctgtgcaagtccctttggggtccactctgcttagagccatctgagctcagtccttctgctctgaggctcctcctgtgttttaatgatgatgatggtcatagtgacagcagcagcagctaactaaccctgaagcatttatgtgccagtcactactctaagcattttacgtgtatttgcttatttaatcctcatgccaacctgatggagttggtggtatttttatccttgttttacaagcaacaagattgaggcctccccaaaattaataacttgtcaaataacacacagaagtggtacacgggaatgtgaacacacagtctggcaacagagtccctgctcttccctcctgctccaggccatctgtcactgggccaccccctctcctcagccacccctcccctggttgctggaggaaattgtgtgcttctgagtcaacttctataacagtggaaacacacatgcttcattgtaaagatcaagtgtggttgtctgcctgtgtcatgttggtataatatcttggccactgctggttttttgttttttataaatatggttggtggggggagcagaaaagaaagtggcaatacagtgagcaatttaaaaaaagatttccacaccactgtagcatgtcttagaatattaacagcaaccatatattcactgtttattgtttactggggactgtgccagagcctgtctcatttaaatccgtccagccattccgggaggtcggtactgttacctcccatattacagctgaggaaatgaaggcaaagtagtaacttggcgccaggacacactttaatatgttctccctttctgagcagaaagagaagtcatggcaccccttcttccccaccttccgtgattctagccagggtgcactgtaatgtggttcacctgtgttaaaacactatattttttctataattattttttatttattcatttttcttggttccttctttttttctgtctctgctgcttaagttggaatattttctagaattttaatagcccagtgacatcctacttccagcagtctgcatttgtttatggagcaagcttgggaccatcagcttctctgtgacaagtcttggggtgcacttcagccctttctcagagaattgagatgtgaagctcacatgcccacagatgagaggccttctttgctgctgcccaaaagggtctcaggaccctgcaggggaactttcctctgagctctgcctcttatggcccaggggaaacctcgtctaccctggcttagtggctaaaatatcaaaccattgtccactgacctattgcttgtttttttttgtttgtttttttcagggggatggagtctcactctgtcgcccaggctggagcgcagtggcgcgatctcggctcactgcaacctccgtgtcccaggttccagcgattctcctgcctcagtcttctgagtagctgggattacaggagcatgccactatgcctggctaatttttgtatttttttttatttactttttaatttttgtatttttagtagaggcgggctttcaccatgttggccaggctggtctggaattcctgacctcaaatgatccacctacctcagcctgccaaagtgttgggattacaggcgtgagccattgcacctggccctgttgcttgtttttgacctcagtttccaccataatctagagtttccttctcttcccactcaggtcaattagaagaacatcatggttaaccaagcttggattttagaactgacagcctgagtttgagctcagctcggtcacttagtagctgtgtggctttgaacaatttagttaacatcttagtcttagttttctcttgcaaggtggggatgaagataattgagcctagttctcttaacaatcctatgaagagcttagcacatagatgcacatatatttgaacactgaatgaacatgtttgccatgaatatttttgcccacagacgttccaaccatgggttttagcctttccttctaaagctttcttaagaggccaaatgagcccgggatctagccaccacaaaaatccatgtctacaggtaaccttttaaaatggccctcaaacatggccagtctcaagaacaacacccttcatcttagactcttttcatttcatgcgtgtgaatacatgtctggcacaaggaagggaccaaagaaaaattgcatctttgcgccttctccttgtggcttccctctcacacgggcatgacagccacaggctgacagtgggggagaacaaacaaagcctggtggatggggccctgcccacaggccccagggctgccgccagctctgctgctttgtagccaggtgtccttgtgtgagtcacatcacctctccagacatctgtcttgtcatctgcaaaaaagttggggaggaggttggtttttattttattttattttatttattttttagacatggtctcgctctgtctcccaggctggagtgcagtggtgcaagcttggctcactgcaccctccacctcccaagctcaaatgattctcatgccttagcctcctgaatagctgggattacaggcatgtaccaccatgcccggctaatctttgtatattttgtagaggcgaggtttcaccatgttggccagggtggtctcaaactcctggctacaagtgatccacccacctcggcctcccaaagtgctgggattgtaggtgtgagccgccacacctggcctagtttgttgttgttttttaaaactaatatttcaaggcattaatctgtaaccttcacaagtcagaggatcctctattgggtaggatttcacacctgtgagggcaggcatggccatttcagatgctctagagaactgggttcctgtgtgtgctcagaaagtgaggacccaccttgcttccactggactttccactgaaaaatctatttccatggtgataaacctagccttcagccttagaactagaagtcagctgttgggctctaaaacccacacttggtttaaccatgacattcttttgtgagattttacgtgtttcatctttgaaaatgtcttttcacagaggtaggtacttccaaatactgattacatggtagaagtcatatggcatgaagatagtttatctctgatgatggaaaagggggtatccatacaaaccaggaagatttccttccaactcttgcttcctcagtctctccccatcacacgtgtggactgtaactcatctttttgttgtcactgttgttacaaaaatggagaaggaaaaataacccagcaaaaactgacagctagcaaggatgagtcttaagaattgactgggagcaataattgtttttcaaactagggaactggaggcaatttgcttctgatgtaagatgaccctcacgttgtgtctgctggtacccagctgtcctatgcccatgggtttaaagtgcacagctgttgtcttgtctttgacagtgtgtactcctggcattcggtcagtcccttagaagggggtagttcagtaatgataccctgtcccagaggttaccaaactttttctgtacaggaccagatagcaatttttttttttttttaaacagagttttgctctgtcacccaagctggagtgcagtggtgcaattgtggctcactgcaacctctgcctcctgggttcaagcgattctcctgcctcagcctcccaagtagctgggattataggtgtgcaccaccatgcctggctaatttttttatttttagtagagatggggtttcgctatgttggccaggctggtgtcaaactcctgacctcaggtgatccaccctcctcggcttccctaagtgctgggattacaggcgtgagccactgcgcctggcccagatagtaaatattttaagctttgcagaccaagaggcaaaatcaagggtattatgagacttacctcaataataagaaacaaaattttcacagatttttttattgacaaaattcataacataattattgagtccagcataataatacacatctactaatgaggggaatagaattctttttagggggataaccatttgcttaattggggttcaaaattagtgttccctcgcatcaaatcaattgcagatgttcatctattaatactaatctgtgatgacattttacatatttcattttgaaaatgtattttcacgcagataggtattgccagacattgatcatcaacccacgaggatgtgatttaattgggcatattcattgcttggaagacacttatagaattctgtttgtttctcggtaatttcttcttaacacatcattacattgcagactaatctccttccagttgcaggttaggaggaagcttctcaattgcacagttagatggatattcaaatgtggatatttcctttgtgcttgcatcagggtccaaaaaatgttgctggaactgtagtttgaatttggaaagatataactgctatacatttgtgcgggagtggaagtataccacaagttgctgactttgggcccatattaatggagatggtgggctgccaggggacaagtcagtgctgctttaagagatcctgactttcttcctgattctaggtcatagcctgcagtgctacaactgtcctaacccaactgctgactgcaaaacagccgtcaattgttcatctgattttgatgcgtgtctcattaccaaagctggtaagagcctcccctgtctgtctcctaaatgtaatggggtaataagtgcctgggaaaaaaattgtgccactgtaatcctcattaggcttgcatcaagtaatagctaccatttattagcgtcaggtgtgtattgggctaagcactttcttcatacattttaaatttaatgttttgcacttctaagggtgatcttttatttccatttgataaatgtggaaatggaggttcagattaagcaagaaattatggttaagtaaccgactcaggaattgaacatggaagtccatctgattccaaagcttgtgctcttttacagcagccctgtgctgcctcccagaccttggagaacctactgtgtgcccagcagagggttaggagctagggatgcaaagataaagaaaggacacatacaattaaaattatgacaaaggcctgtttggctgtcctaaatgtcattatatatgcctctgtctcattccatggggtatctggtatattcagagtcctgaggagactcaagctgagctcaaaggacacgtaggaggtaagagggctaagaagggaagggtgtgcctgggaggggcaacagcaggtgccagggctcggtagcctcagagcaaggtgctcatgaatttggggatgggcaatgctaacatgcacaagtcctgtccagtctgcattttccaaatttgttagactacagaatattcacctccatcaccctgttaaaatagagtttaggaagtggtagacagaggaaagaaaccagcaaagacatgccctctgttcttgctggggtgtggttctggatagaatcgatgtgtgcaaatgatgccagcgaggaatggcagtttcagaatgttcttagtgtccaaggtaaaaccctcaggcttagatttctaagagattaataataaaaacactccacaaggttatttgtactcttagaccttctacaccagctccccccagtgtcaacatcaagaaatggtgaacatgtcaggtaaactcagaaaagccttgggacacccacatgttcagaaaaacctgagataaagatgattaacttccccagaaaggagaaatccctcaataactaaagacaaattatagttaccctgtctaaaaaaacaggggcatctgataattttgatatatttagctggatttgataaatttgatatagtttagctggattgcagctaaaactccaaaccttccattcagagctcttgattctgtagggcaccagtccctctgcccccactggaagaccatattcattcactgttaatgtaggaagcgtagtaaggcccctagcgagaacatggtcattatgtacgagcacagaagacttggctctttagcttgatcaactgtgtctcttggactcctcactactaagtataattaaactaagtatagtttccaaatgagacgataagggcaattactatgtgttgaatgaatattacagcagcaattagagctctgacttctgtcctgccaccagctagctctctccacctctgtttttcatttatgaaatgtatgtgttggacagcagaggtagggaggagaggaaaggaggtcaaagccaagatctttttccagctcttaaatcccaaaatttcttataaatggttaatgtaaacaaaaatgagacacacctattaaaatggccaaactccaaaactctgacaactccagatgctggtgaggatgtggaacaatgggaactttgtttttctggttttttttttcttttttgagacaaggtcttgctctgtcacctaggctagagggcagtggtgcaatcttggctcactgcaacctctgcctccagggttcaagtgattctcatgcctcagcctcctgagtaattgggattacaggcataagccaccatgcccagctaatttttgtatttttagtagagacggggtttcactattttgcccaggctcatctcaaactcctggcctcaagtgatctgcctgcctcggcctcccaaagtgctgggattacaggcgtgagctaccacgcccagcagcagtgggaactttgattcattcctagtgggaatgcaaaccagtatagctactgtggatgacagtttggtagtttattacaaaactaaaatataacacaatatataatacttgatattttgataattatatacagtatataatattttataataaatgtgttactggtttgtgtatttactatattttttatcatgttagcatgtagtccttctacttactaaaaaaattaactataaaacagcctctcgggaggctgaggcagaagaattgcttgaacccaggaggcagaggttgcagtgagccaaggtcgtgccattgtactctagcctgggtgacagaacaagactctgtctctacaaaagaaaaaaaaaaaaaaaaacagcctcagcaggcaggtccttcaggaggtattccagaagaaggcattgctctcctaggacaggacagccccatgagtattcttacccctaagaaccttccagtgggacaagatgaagaggtggaaaacagtgatactgatgatccagaccctatgtaggactaggctaatgtgtgtgcttgtgtcttcatttttaacaaaaacaagaaaagtttttaaaaatttttttaaataaaaaagcttataaaataagaatagaaagaaaatatttttgtgccactgtataacatgtttgtgttttaccctgttttattacaaaggtaaaaacatttacaattaaaaaatttctaaagtaaagtggcagtaaactagggttgattttttaaaataagcttagtgtggactaaatgtacaatatttaaaacatctacagtagtgtacagcaatgtcctaggccttcacattcgcccaccactcattcactgacttccaatctcacaagctccattcacagtaagtgccctgtacaggtgtaccatttttaaaatcttttgtgtcatatttttactgtatttttctatgtttagatatggtcagatacacaaatatttaccactgcattacagttgcctacagtattcagtatagtaacttgctgtacaggtttgtagcctaagagcaataggacataccacatagcctgagtgtgtactaggctattccatgtaagtttgtgtaactacacgctatgacgtttgcacagagacagatatgatggtgctatacaaagtaagtctagaagagagacaggttggctgctaattcaaccaatatttactggcatcctagcagtataaaccatggaagtgtaagcaaggttaaatgtacttagtcttgaaggagcctctgatgacagtgtcaagtggtcactgctgtaatgacgttctgaacaagggccacatttaagggtgcctaggacagctgaagactgttgactttagatagacttgagccgaagtcttcaaaaagagtgaggaggagaaaacctgtaacactccagggattctgatataagccacttttatgtggataattccaaggctggctttggtgagattattaccatcgttaaggctgttgtttgaatatgataattcaagtaaagcactttggtacgctgcacgacacatagtaaatgattaattggtagcaattattcataaattactgtctgttctccccaagcttctaggcttccctaattaaaattctgatagctttaaagcttttcaagttccaatgcgtaattactgttacaaagcagtaacttgtctgaatcaccagcagcctctagtacaatattagaagcttccagttatttagttaagacttcagcaactagagccatttctggaatactctatgtggactctgccacttgactaaacttcattaaattccaatccagatacccatcccctcagaggaggaggacaggacagttatgcctgcagttataaactgagaagtgttgtgttccaagctctgcatggaattgggtaaattagctacaagcctgaaataaggaagtatgcatctgcgtttttttctttccagcacagaagataagaaaccactttcagggcaaggacaaataccttcttataccccagtatctagcacacaggcactcagttatttttggagaagaaaatctaccataataccactctctcaactaatacatttttcacctaacatgctttttctgaatattaaaaaaactgtgataagatacttggagtatatacttctggcctttattttcctgtgtgcccaaggctatttttccaaaaatgggaccatgatggcgtgttttttgtagaaacttttccagtattactgaataatctaatgatttttaaaatgaagtttcaaatattttaaaaataaatcatccatgtggcaaattaaaaaaactcaatagaaacataaacgaagtgtattcttccatgatgataacactattaaattacttgggaatccttccagagaaaaataaatgcacttacctcaatgtatatgtgctttatttccacaaatgggtcacattctatacactgttctgcatctagggtttttattgagatataattcacagaccagaacgtttacattttaaagtgtataattcagtggctcttagtatatttacaaggttgtatgacttatcgcaactgtctaattccaggatctttctgtcaccttgaaaagaaacctgttagcagtcagtcctcattcctccctcctgcatgccccagcagtgactgatgtactttctgtcttcatagatttggctctcctgggcacttcatatgcaaggaatcatacagtattgtggcactttgcgactagcttttttttcactaaacataatgtttccaaggttcactcatgctgtggcatgtatcagtacttcattctgttgtggccacatagtattctattgtgtggatatatcacattttgtttatccattcaccagtaatggacatatgggttgtttccactttttagcaattttgaatcatggtgccatgaacattcatgtggaaacttgtgtgtgaacgtagttttcaattcaaactacgataagatacttggagtgtatacatctggcctttattttcctgtgtgcccaaggctatttttccaaaaatgagaccatgatagcatgttcttatagaaacttttcctgtattactgaataatctaatgatttttaaaatgaagtttcaaatattttaaaaattatccatgtggcaaatttgaaaaactcaatagaaacataaacgaagtgtattcttccatgatgataacagtattaaattacttgggaatccttccagagaatggcagaagtatatacacttgtgagtggaattgctcagtcaaatggataactctatctttaactttttgcagaaatgccaaatttgtccagagtatctacaccattttacattcccaccagcaatgtttgagggttccaattttttccacttccttgcaacatttgctatttaccattttcttgatcttagccatcctagtgagtataaagtggtatctcactgtgattttcatttgcatgttcctaatgactaatgatatcaagcatcttttcatgtacttattggccatttgagaatcttctttggagaaatgtttattcaaatcctttgcccatttttttttaaagaggcaaggtcttgctttgttgcctaggctggaatgcagcagtacaatcatagctcactgcagccttaaagtcctgagtccaagtgatcctcctgcctcagcctcccaagtagctaagactaaaggcgcaacaccctgcctggctaatttttttattttttatttttgtagagttgggatatcactatgttgcccaggctggccgcaggcaatcctctcacttcagcctcctaaagtgctgggattacaggtgtgagccatcacactggcctcattgtccatattttaattgggttagtctttttattgtagagtttaagaatgttttctatatcctggatactatgctcttacatatgactttaaaaaagaaatagagagggggtcttgccatgttgaccaggctggtctgaaacttcccgcctcaaacaattctcccatctcagcctcccaaagtgttgggattacaggtgtgagccaccgcacctggtggtttacatgtgatttgcaaacattttctccctttctgtgagttatctttttattttttgataatgtcctttgaagcacaaaagttttaaattttgatggagtccagtttacctatttttctgccccccccccacctttatttttttttttttaaatcaagctccttccatgttagcacttgaaggcccacgtcatttcttatctgcatggaacttgcattgtaaggaattctattgtaatttctttaacactttttaaaaattaatggactgggtttttcaggtttttttctgaccattcttgagcatatatcttatacatagctttggctgggcatggtggctcacccctataattctatcactttgggaggctgaagcaggaggaccacttgagcccaggagttcaagaccagatgaccgggcaagaaagtgagaccttatctctctaaaaaaaaaaaagaaaagaaaaggaaaaaatccccaagtaacttcatagcgtaaattctaaaagtggaattgctggatcaaagggggcatgtgtttaaaatcttggcagatattaccaaatttccctcttaacagtataaatgcctgttcctcctccgtcccacccccataactatactggctctgatgagaccttggttttctgtaaaagctctatttagaggtgtatcattatttacttaattgttctcctttacaacccacctgggatgagcatcttgcctagaagtctctacttgcacaggatacatacgaaatagaattgaggattcaaaagcagatacagaactcttcccacttactttcttacccttgtgtgtgtctccccacagggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttctatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatggg

SEQ ID NO: 15332 - DNA, 71251 bp, Human
tagagggtgagtttatatgtttcaggaaaggcttcagcaagaagatattattttactttgattgaaatctgaaagagtttttaaagtgttcaatagtagatgtgagtctgggtgcagtggctcatgcctataatcccagcattttgggagcctgagatgagaggatcactcaggccaggagttggaggctgcagtgagctatgattgtgccactgcactgcagactaggcgagaccttgttaaaagaagaaagggtagatgtgcagaaaaacattaagagaacataatgcaaagttcctgtatctggcttctcagcttatttttacacttgatcatttgtattaggattttaccattagggaaattccaagataattttgtgcaagtagaaaacatggagtattacttaaagtgatgattctgtcaaatggtggttttgacgtacacgtttatatattgttgtggcagaccaagtagatggaaggcagatctaacacctgtgtaattatcagtttttctagctatggtactgaggattcattcttatgtgtgtatatgttttgagttcctatagataggtcagcagttgctaggttgatttcatattttataaattctaatttggtaaaataaggtcataggggagaatattaaatatgccagaataaaactggatcctctttcatatctatgttatatctgaatcaaataatgtttataaaatcattatacatttaatggttgtgtggtaagaatgttggctatttcagcctcaataaactcacatcctttttggatgcaggcataaaataaatagaatgtcatttagtccttgagaaccttagaatgattttaaatctgtttttcaaatatgatttgaaatttgatttgaaaatatgatttgaaaatttcaaatattttccaatattatttggaggaagtttaaaggaatatccatataataaagtacacattgagaagaatgggaacatgaatataactgggtagaaagtcattaacttgtctttgtaatataatgctttttaagatcaaaggataatatttttagtaaatagaatgtagcatcagctattcatgaaattggcaccctaattttatttaaaatccctgccataggtggggcatagcgaaactctgtctcaaaaaaaaaatatatatatatatatagttaaagcagacatagattttttttcctcctgaggcaattcttgggctttaggtttaagaaatatggctataaactatgtttatataatgtatattttcttttcttgtcattggttcatacatttgaatttggtaatagaatgttttacttttgtcaaatgtgtacagttaaaggatctgtactttttttttgagacagagtcttgctctgtctcacaggctgaagtgcagtggtgcaatctcggctcactgcaacctccacctcccaggttcaagcgattctcctccctcagcctcccgagtagctgggaccacaggcatgcaccaccatccccagctaatttttgcattattagtagagttgggatttcttcaccgtgttggccaggctggtcttggactcctgacctcaagtgatccaactgcctcagcctctcaaagtgctaggattacagggatctatacttttcttttgagggaaaatgttggcaccgtttctagggcatattggccatttcagcttctcagtaaatatttgttaagtaattaaatgcacttgattctttattcttagccttttaacgcaatactcagaatagctgaagcaccaattaactgaaatggagatattataaagatagttatcttctccaagggaaaaaatcatcttcatggaaattaattacttttttacaaattgtgaatttgacccttaagagttttcttcctgatatttaaaattgaaaaaaaaattgttgacattaatatttcttctttccttttttttcttttccttttttttttttttttgcaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacaggtaggtaacaactccatactttttggttgtttattaatgtgaaatttctgctaaatgaaatacttttgtgtgtgtttgtggtagaagagaccacttcagttaaataaggaaatcaagagaggatcaatttaggttcgttttaaagagattaaaaaaaatcaagacataaaatctacccaagcaggatagaaatctccactgcaaagttccatgccaaagacatctggttatttttatttttaatggaagacttgaaggaatgataggtgattaataatgatcaaacagaagtctttaaatgttggaaagtatttacattaatctttgtatatatcattgggcattttagcacttgagagaaatagtttattaaagatataatcaatcatatgtaactgaacatttagaaaaattatatacaggtttgagtagcccttatctgaaacttttggggccagaagtgttttggattccagatttttccggattttggaatatttgcactgccaactagttaagcacccccaaatttgaaaattcgtttcctttgagtgtcatgtcaatgcccaaaaagtttcagatatttggatttgagatgctcaacctgtataaggattcagaaagttattctgattaatgattttaagattcagatatacagccgggtgcagtggctcatgcctgtaatccctgcacttagggaggctgaggcgggtggatgacctgaggttaggagttcaagaccagcctggccaacatggcgaaacccccatctctactaaaaataacaaaaattagctgggtgtggtggtgggtgtctataatcccagcaacttgggaggctgaggcaggagaatcacttgaacccaggagatggaggttgcagtgagccgagatcatgccattgcactccagcctgggccacaagagcaaaactctgtctcaaaaaaacaaaacaaaacacaaatatacttctttggctcccgtgactctttaggtcacctgatcataaccagttttattatgttctatccacatatatgctatgggtaatgctattttggtcttgcttcttgggggaagttaaagaagaaaataatgcccatgtaagtattgataaagtgctacaatgtaacactagcctgaagtgcaatagatagtatgagaggctaactaatgattaccaagattcagaatactgaaaactcattctggagtgtaaaatggctttgaattcatagtttgataactttgagcttaaattattttcatataagcctgagtgaatttatgttcttggtatttgctaagccctacgaggtccaacatgatggacctgccatcaaatacagacaaatacaggatctgccaatattggtcattcatgcagtttattgttagaaatggttagaacatgggggatataaatttagacccaccaaggagtatattctgatactgcatttgcctttcactgtacctgattacccttcttgcaagtatatgctatagtgcccagtataaaataaaggagaaattaattaactcttacacaaatcatctctaaatacatgccctaccagtaggttatcagaaagaattgcccatttatgtcacttagtgttagtaaagcttattaaaatatgtatttgagctgggcttggtggctgacacctgcaatcccagcactttgggaagtgggaggatcgctttaggccacgagtttaagatcagcctgggcaacagagcgagaccctgcctctccaaaaaaagaaaaaaaataatgagccaggaatgttggtaaatgcctgtagtcttagctattcaagaggctgaggtaggaggatcccttgagcccaggtgttagaggctacagtgagctatgataatgccactgcactccagcctgagtgaccgagtgagaccctctgaaaaaaaaataaagtgtgtattaggaattagaaataacagcctgatatacctttagtatattctttttttaaaaacatttttatttttatgggtccatagtaggtatatatatttatgaggtatttgagatattttgatataggcatacagtacataataatcacatcagggtaaatggactatccattgcttcaagcatttgtcatttctttgtgttacaaacattccagttagactcctttacttattgttaaatgaacaataaattatttttgactgtggtcactctgttgtgctatcaaatactacatattattcattctaactatttagttggaccccttaatcatctctactccctacccccatctactacccttcctagactctggtaaccatcattctactctatctccatgagttcaattgttttaatttttagctcccacatatgagcgagaacattgtgaagttttgtctttctgtgcctggcttatttcacgtaacataatgtccttcagttccatccatgttgttgcaattgacaggatctcattctttgtatccattgtgtatatatgtatcacattttctttatccattcatctgttgatgggacacttaggttcattccaaatcttgcctattgtgaatagtcgtgcagtaaacactggattgtagatatctctttgatagactttcattcttttggctatgtatcttagtatattcttgattgtatgggttttagtagtagagtgctagataccattaaaacttttcagatcatttaaaattttaaatttgctgttgcagggtagtagctcttgcttagtatcacataattagatttattagatatctgtgctccgcaaaagatttttttttcaatatacaagattagcttttaatttttttctggaaaaaaattgtaaaatcttatttaacagtatgagaagaatagtagtttttgtttttttctttcccttggtactctatggattctgtcttgagagcttttagtagtgagctagcatattatataaactcccaggcttcagctgcttgggccctatatttagttcacttgctagtaaatgacttcacttcatttgggtcctgcattattctgcatatcagaattacctcattttctttatttgaaatctttttccactagagttaaaaaaaaaagtcttttttttttttaatacttgagaatgtctgtcggtttactaaatctttcaagggaatgaaggaaatcctttaaaaagcaatctaaaatgctgaatattttatgatactggtttctagcattaggcctttgcacaaatactagcctttgtattaggaatgaacaaatctatgaataattgctaaatacagttagtagtttctaatttgtgtttatatataaatttcaggtaaataatttacccgacgttcagaagctatacaattgctatgctaaattacaggctctgggtttagagtgaaaaataagaggctcttatttgtaaacaaagactagtgcaggcattttggttgatgttgcctcgataaaaaactaaaaatagattttatgtcatttagatccaagagttagaagagttagtaagtattcaggtatatcagtgaaaatatattgtagtccttaatcaggtactgttttaatatctagtgtaattttgcatgaaaatggcagataccactactctgtttaagtatttgtttgtactttatttgggaccctgccaattctggcctagtttatgactaggttacttataaatctgataaggcagtaagctaaagtgtcttatacttgatttttcaatttttgttaaaatattttttatttcataaatgaaagcaggaagtggaaactaaccaaattaaatatttttgagcaaagcacagtaggaatgcacatatcctgatttctgaggtaaacgatttgtgtttaaactcaggtttatgtgtattctatttctttgtgcaacacagaagtgtagtagggatatcttaaaatagacaggggacagtggccagaaattgttgactactatagatggtgaggctgtctaactcttgcagtgatacaagccagaagtacgtgctaagggcattgatttgcttaaggtcagcatgttctaaattgagctgcttgagtatggtttctgtcaagaacacgtagggctcttaaacgtgtaaaaggctttagcggcagaaggtgctgtatttatgaggtgtggtggcaacatttaggtcatgaatttctttttctttttctttctttctttttaaatatagaattttagcctgcgattctaagtcatttcagaacacagagacaggaaagtgggctgtaaaaataacctgtgtagcagttatattctttgctactctactgagtaatttagcattaattgctgttgagttttaaaaaatgctattttgcatgtaatagttaacaaaaaggtatgtaatgataaacagttaatttagacatatttgttctttcatggcattcttacctctcatgccttcttagatccagaagtatcaaagtttctgtaacaaaattaagctacataggaagacccgtaaaataacggctaatattttacatagggtactttatgatgaaacaccgtgtatgtataatgcatcattttttcaaagtgcctttcgttatattttctagtttgtttctcacttctctatggggtagttaagactgggtggcattattctttgataaggagaaaactgggacttatgtaagtcagacaggttcaaattcacactgtaagtttaactttacaaattttgttaggcctttttgggtgctggtacagtgctaggtgctaagaatacaaaggtgatttatgtatgttcattaatttatttgattaatgatttcatcatttaatggaggggaaaaatagtttgcttcaagaaatgccagggtggagaggtgtgtgcagggtgatataggaacccaaaggagggctccgagcctgatctgaggggcagggaaggcttctaggggagcgatgaccccagaatgacccttgagagcagagcagagaaggagccagggttgactggtcttgagcattttctctcactaagccactcttaacctaaaaaagctcagcattgggatgaaattgctggtgatttcttttgtatatcataaagtagttgtttgggaacctttattagacaaatacaagattgtcaattgagtttagttttaatagaagattaggaaattctaaaatgaaatggttttcttttttttaagatggagtctcgctctgttgcccaggctggagtgcagtggcacaatctctgcttactgcaagctccgcgtcccgggttcacgccattctcctgcctcagcttcccgagtaactgggactacaggcgcccgccaccacgcctggctaatttgttttgtatttttggtagagacgggatttcaccgtgttagccaggatggtctcgatctcctgaccttgtgatccacccgcctcagcttcccaaagtgctgggattacaggcgtgagccaccgctcccggccaaatgaaatggttttcagcgccatacctgtggctgcaaatgtgtagtactttactacataaaggactttacatagacacagatagtcgactacatatatcgggccttctattaaaaattctagcagagctcttaagtttttttgttttgtttttgtttttaaaaacagctttattgagatataatctacataccttgaaattcattcatttaagtgtacaatttaatggcttttagtatatttatagttgtgccatcatcagcacaatcaattaaaattttaagtttaaaatttttttggccaaattatttctcacctgacacaatttttgaatatttacattaccctcaaaagaagcccgtgtgccttttagccattgttccccagtctgcccatcacccccagccctaagcaaccactaatctacttgctgcctgtgtagatcatctattctggacatgtcatatacatgtaaccatacaatatatggtccttttcgactgagtttttttttcacttaacataatattttcaaggttcatccatgttgtaggatgtatcaatacttactactttttattaccaaataataaaccattgtgtagatatataccacattttacgtatacattcatcagtagaatgtattaaaattgtgtcaatgaaaagatatgtgaatagaaactgtaatatggtccaagattaaatatcaaaatactttagtgcctctaaaatgtaaagtgtggtgcttggtgctgcttgtacaggaggagaacaaaatgagtctctgcttttatggtgtttgcaatctaatgggtagacaaagaacaaaaaaaagtagttggagaggctgagtgccgtggctcacacctgtaatcccagcactttgggaggccgaggcaggtggatcgcctgaggtcaggagttcgagtccagcctggccagcatggtcaaaccccgtctctactaaaaatgcaaaaattggccgggcatggtggcaggcacgtgtcaggaagctgaggcaggagaatcgtttgaacccgggaggcggaggttgcaccaagccaagatcgcgccattgcactccagcctgggcaacagagcgagactccatctgaaaaagaaaaaaaaaaaaacgtagttggagcaaggagagagaacaagagaagtttaaacttttttagttccttttttttctttaacttttacattgaaattatcttcaacatacaaaataagtaaatttaggcatacgaaaaagttgtaaaaatagtacaaaggattcctgttatccttcatgcagattccccagtgtttcacgttagtgtttgaccaccctagttttatcaatcattctctctttacacacccacacacccaccctcacctacccacccacctaccttttcctacagggtgtgatacgaagttgctttacctctaaatgcttcagtgtacatttcctaaacataaggacattctcttgcataacttcagtacaattatcaaaatcgtcatcagttaacatcagttcaatattattgatttgatgaactgtttaaactatttttttttcttttcttaaagacaaggtcttgctttgtggcccaggctggagtgcaatggtgcagtcatagctcactgcagtgtcagactcctgggcacaagcaatccttctgcctcacacctcctgagtagctgggactgcagtcatcagccacccagctcatgaatgcaatttggttttgaggaaattaaaatcaactcaatactgttagctaatttactgactttatttagattttgccaactgtcccactaatggacctttttttctcgtgcagaattcagtccttcatcacatgtttacattatttgccctgtctcattagtgtcctctaatctggtgatatatcataatgatgtcattctcatgtctcaaaatggagtcactcatgtcaagtagcattgagctcacagcaaagtcgccccttcccccccagcgataaacatatgtaatggactgctgtgacaacatctgccctcaccgggtaccacctgagacttgaaacgaacccgtagaaagtgaaaggtggctgagataatgagaatagacccatttgggaggatcataaaatgtgccaggacgagacgcttttagaggctgtgcccaggagacctctgaagcttcctcccgatttggcatctgctgccacctggagagaagcagccaccaccgcccccccccacaactccaccccatccccgcccatggcatccgaaggacttcgggactgttcggctcatctgtttgcctgttggtctccctagccagggttgtgctttgttccccacaacccccttttcttctgcctctgtgttgaatattggttgtgtgattggttggctgtggaggcctcgcaataaaacgtgaattcaagcttatgttgcgtcgttatgaaaccttcgggcgtaggctccgcctgtggtcggagtcagcgcacctgcgcagaacctcgttcacatagtacccaggttaaggcccgacagctgcagcagctccttacatctttctttgccttcatgcctctgacacttttgaagcgtactggccagttattttgtagactgttcctcagtttgcttatggctgatgttttctcacgattagattcaggttttgcacttttggcaggaacttcacagaactgatgttgtgtccacacatattgagaggcgcatgatgtcaatttgtcccattattggtaaggcgaactttgatcacttggttgaggtggtgtaactgccaggtttttatcactataaagttaccatttttttctttgtaattaataagtacaatatcttgtggagagatactttgagactattcacacgtactatttcttatcttgtattcactgaccaattttagcattgttgatgagtttggccttaactgaggtttgccaaatggttttctaattctgtagttcctctattaggaattcttccacaagaagagctttttttccccctcccttcctttctttcagtatggactcatagatttttgtttaattcaatgggttgtaaatatcactcatcattctttgttttgttcagtaaattatcccagatggttcagagagagcatctttctttaggctttttccagtgtccctgtggtatggccgcatcctttcttcagggtttactttctggcaccacagatgttctgacttaccttgtgctttttctgtccagcccttggattggacctctaaggagcacttgttccttttattggagaatggcttttggaaaacaggacctggacacaggtcaggtatgctcagtggttctaggatattacttcttttaggtcttttgagtggcaaagttagaaaatatagaagcataccttgttttcttgttttgctttattgcatttcacatatacgtgctttttacaaattgaaggtttgtggcaaccttgtgtcaggtctgttggtgccattttctcaacagcatgcgctcattttatgtcactttttggtaattaatgatatttcaaactttattattatttgttacaatgatctttgaacagtagtctttgatgttactattataatcgttttggggcaccacagactgtgcctatataagatggtgaacgtaataaatgtgtgagctccgactgctctaacaaccagctgatccttggtctctccttctcctctggcctccctattacctgagacacaacaatattgaaagtaggccagttagtaaccctgcagtggcctctcagtgttctaagagaaaggaagatctcatgtctcttgctttaaatcaaaagctagaaatgattaagtttagcgaggaaggcgtgtggaaagccaaggcaggctgaaagctaggcctattgtggcaaacagtcaagtggcgaatacaaaggaaaagttctgaaggaaattaaaagtgctactccagtgagtagtaaatggtaaaaaagcaaaacagtgttattgctgatatggaaaagatttttttttttttttttttgagatggagtctctcaccctgttgcctaggctggagtgcagtggcacaatcttggctcactgcaacctctgccttctgggttggatcaattctcctgcctcagcctcccgagtagctgggattacaggtgcacaccaccacgcctggctaatttttgtatttttagtagagacggggcttcgccatgttggccaggctggtcttgaacccttgacctcaggggatccacccaacttggcctcccagagagctgggattacagatgtgagccaccgcgccctgctggaagagatttttgtggtctggataagtgatcaaattagtcacaacattcccttaagccaaactctaagccagagccaggccttaactctcttcaattctatgaaagtgcagaaaggtgaggaagctgcagaagaaaagatggaaactagcagaggttgattcatgaggtttaaggaaagaagcctctccataacataaaagtgcaaggtgaagcagcaagggctgatgcagaagatctagctgagatcattggtaaaggtggctacactacacaacagatttttaatgtagatgaaacagctttatattgtaagatgataccatctaggactttcatagctagagagaagtcaatgcctggcttcagaacttcaaagaacaggcttttttttttttttttttttttttttcttgagatggagtcttgctctgtcacccaggctggagtgcagtggtgtgatcctggctcattgcaacctctacctgccaggttcaagcgattctcctacctcagcctcccgagtagctgggattacaggggcgcactaccatgcctagctaatttttgtattttagtagagacagggtttcaccatgttggccaggctggtcttgaactcctgacctcaagtgatcctccctccttggcctcccaaagtgctgggattaacaggtgtgagccaccgcacccagccagaacaggctagctttgttgggataatgcagctggtgactttaagttgtggccaatgctcacttaccattctgaaaatcccagagccctttagaattacgccaaatcgactctgcctcgactctgcctatgttctagaaatggaataccaaagcctggattagagcatatctatttacagcatggtttactgaatattttaagcatgctgttgagacctactgctcagagaaaaatatttcaaaatatttattactacacattaacaaggcacctggttacccaagagctctgatggagatatatagggagaataatattgttttcatgtttgctaacacaacatccattctgcagtccctgcatgcatcagggagtcatttttactttcaagtctcattctttaagaaatatgtttggtaaggccatagctgctatagatagtaattcctctgatgcatctgggcaaagtaaattgaaaaccttctggaaaggatttattgttgtagatgccattaagagcattcatgattcatggcagcattaacaggaatttggaagaagttgattccaaccctcatggatgacttcgaggggttcaagacttcagtcttgaggaggtaactgcagatatggtggaaatagcaagagaactattagtagaattagaagtggagttagtagaattagaagtggagtctgaagatgggactgacttgctgcaatctgacgattaaacttgagctattgacaagttgcttctttttgtttgtttgttttgagatggagtctgtgttgcccaggctggagtgcagtggtgcaatcttggctcatttcaacctccacctcctgggttcaggcaattctcctgcctcagcctcccaagtagctggaattacaggtgcctgccaccatgcctggctaatttttgtatttttagtagagactgggttttaccatgttggccaggctggtcttgaacccctgacctcaagtgatctacctgcctcggcctcccaaagtgctgggattacaggtgtgagccactgtgcctggcctagacgagttgcttcttttggatgagcaaagaaagtggtttcttgggccgggcgcggtggctcacgcctgtaatcctagcactttgggaggtcgaggcaggtggatcacgaggtcaggagttcaagaccagattgaccaatatggtgaaaccctgtctctactaaaaatgcaaaaattagccgggcacagtggcaggtgcctgtaatctcagctactcgggaggctgaggcaggagaatcgctggaacctgggtggcagaggttgcagtgagccgagatcatgccactgcaattccagcctgggctgcagaacgagactctgtctcaaaaaaaaaagaaaagaaagtggtttcttgagatggaatctaatgctggtggagatgctgtgaacaattgaaatgatagcaaaggatttagactattatatcaacttagttgataaagccagcagcaaggtttgagaggattggctccaattttgaaagaagttctcctgtgggtaaaacatcattaaatagcatcgcgttctacagagaagtctttcatgaaagagcaaatcaatgtggcaaactttactatagtctttgagacatcgttggccaggtgcagtggctcacgcctgttatcctagcactttgggaggctgaggtgggaggatcatgaagtcaggagttccagaccagcctgggcaatgtggtgggacctcatctctacaaaaacacaaaaattagctgagcttggtggtgtgtgtctgtagtcgtagcttcttggatgctgaggtgggaggattgcttgtgcctgggaggcagaggttgcggtgagcagagattgtgccactgcactcaagtctgggtgacagagtgagaccctgtctcaaaaaaaaaaaaaaaaaaagaaagaaagaaaagaggccaggcacggcggctcatgcctataatcccagcactttgggaggctgaggcgggcagatcacaaggtcaggagttcgagaccagcctggccaacatggcgaaaccctgtctctacttctactaaaaatacaaaaattagctgggcgtgatggcaggtgcttgtaatcccagctactcggaaggctgaggcaggagaatcgcttgaacctgggaggcggaggttgcggtgagctgagagatcttgccagtgcactccagcctgggtgacaagagcaagactccatcgcaaaaaaaaaaaaagaacttgcagccattttaaccttcagcaaccaccatcctgattggtcagcagccatcaacattaaggtgagaccctccaccagccaaccagccaaagtattacaactgaaggttcagattcctgttagcattttttagctatcaagtatttttaaattaagagctatacatttttttagacataatgctgttgcacacttaatagactacagtataatgtaaacataacttttatatgtactgggaaaccaaaaaatttgtgtgactcaccttattggggtatttgctttattgtggtggtctggaaccaaacctgcaatatctctgaggtattcctgtatgttgatatatttgtgggtgtttatgtgtgtagtatttttttgttttgtttttttgagagtctcactcagtcacccagactggagtacagtgacatgatcttggcttactgcaacctccaccccgccgggctcatatgaccctctcacctcagcctcctgagtagctgggacttcaggtgcattctaccatgcctgtctaatttttgtattgttttgtagagacagggttttgccatgttgccaagggtgagctgaagcaatctgccagtgttggtctcccaaagtgctacaattaccacacccggttttatgtgtatatttctatgtctgtctgtttgtatattaaaatcataaattcatgctgatatgtccaattttgatacctgagagtttgttctttcttatgtgtaatccctcatttgacaccaagaaactgactctcattagccacaatatgttacttatttgctcaattttggaatacatttaaaggagttttagaattgttcacccctgccactcctaatttagtaaccagagtacaacatgtatttgcagctcttttattctttagcctgagacttggagtatgtagtcaaaatactgtgttccaaagttacttaggttagttcctccccaaactccttctctcccaccttcagtgtgattatgttattatttttgaaatacagttaagtttatttgtttctgtttgtattccattttgggtctcccatgtccttgttgattgattgatttcaccatgtgcaaaattaacatgtttctaaaaatcagaactaagggtgaggtatagtgtctaatgcctgtaatcccagcactttggtaggccaaagaggattgcctgagcccaggagttcaagaccagcctgggtaacatattgggaccccatctctataaaaaaaaaaaaaaaaaacttgggcatggtggagcacacctgtaatctcagctacctgggaggctgaggtgtgaggatctacctgtcagctatctgggatgctgaggtgggaggattacttgagcccaggaaatcaaggctgcagtgaactgtgattgtgtcactgtactccagcctgggcaacagagtgaaaccctgtctgacacacacacacacacacacacacacacacacacacacacacacacacacgagtacagtacagtaccttgcttagaatattgtccttgggctctgtgccatgagaatatattttagataggtctcttaagtacttttatatgtactgggaaaccaaaaatttgtgtgactcaggagacctgtacagtacctaaggaatgaaactccttagagggagagggagaagcaatactactactttaccatgtactaaattctattcatttggaaacagcattgtaatcaatctagatatctaaagtgttagatcctgtgaaggttatctagaatccctttcagttccagaattctatgattcctgtgtgcctagacacttgtaacttctaggttccttccttcccaatttttcctaactgccctccattccttcctgaaatgaaaaatggtatcatgtttcacatctaatcattttcctacattttaatgaatccttacttgattctctccaatgaacttctctatgataattccttacttcttttttttttttttgagaaggagtctgactgtttcccaggctggggtgcagtggcacaatgcctactcactgcaaccttcgcctccctggttcaaatgattctcctgcctcagcctcccaaatagctggaattagaggcacctgccatcacacctggctaatttttgtatttttagtagagaagaggtttcaccatgtggccagggtggtctcgaactcctgacctcaagtggtccacccaccttggcctcccaagtgctgggattacaggcatgggtcactgtgcctggccacttatttgttgttatataatggtaaaccagtgcgtttgattcaataagtgatttcaataatatgaagaagataagaataataatataatcaaatttgcatagaacgagtggaccaggagctgttaattttaatcttaatgctattactgatttttatatgtgacttttgaggctacttaattttatatgtttgtacattaatgagttaaagtatgtatttctatcctctttccttaggtgtgacattagattgtaagacagtaatacatagatgttaaagaatactagttaggcatagggcaaaaacatttttaaaggcttggtcacaaagtgagtttatttaattctgtacactgtagctgtaaaatatgtagtaaatgtaataccatgcaaaccagtctgatctgtcatttcatatcaggttttaatgactgtatttaagaattgtttatacccattagatgtggttgtcccttgatatctgagggattggttccaggaccccccacggacatcaaaatccacagacactcaagtcccttatataaaatggcatagtatttccacgtaacctatgcactgcctcctgtatactttaatctctagattacttattataatgcctaatacaatgtaaatactttgtaaacagttattatactgtattgtttagggaatatttacaaggaaaaaaagtctgtacgtgttctgtacagatatgatcgtctgttttttaatctgtggttggttaagaccatgagtgtagaaactgcaggtacagaaggctgactgtagttactcgtaggttaaaagaagactttagtggtggttttaaaatttttggaataaaagcctttaatgtcaaaggttattagttttttttccttgtgctatatatgtagctttgttttaaaagtgcatatagcttcatgaatgtactatgtcaatagaatgtaatggtatcatggattagatgtccttcccgacctcacacacttcaaaatgtgtgtacctatttgttctgagtcttcagcattttcctgtgaatggaattcagcacgctgaatgttattaacagcatgtgtgccaccatgaaagagtgccagttcagtggccagtgaataatttaggcatcagctggtgtggcaagattgtattacttaggacagagaatctaatatgtgctaaactttgacattaaaaggaacaaacatttctttcgtgagaaaacattgcattacaaagaatgtcgtgtatatctaaaaaccaatatactaaattaaaaattatttgatatatatgtgtatatatatatattatgtttttgaaatggagtctctctgtcaccaggctggagtgcagtggcaccatcttggctcactgcaatctccgcctcccaggttcatgcgattcctctgcctcagcctcccaagtagctgggactacaggcgtgcaccagcacgtccagctaattttttgtattttagtagagacggggtgtcaccatgttggctaggatggtctcgatctcctgacctcgtgatctacccaccttggccttccaaagtgctgggattatgggtgtgagccactgcacctggccaattaaatattttttaaattaaaaaagtaatggaagcgggcaggcgcagtggctcatgcctgtaatcccagcactttgggaagccgaggcgggtgaatcacctgaattcgggacttcgagaccaacctgacgaacatggagaaaccccgtctctactaaaaatacaaaattagctgggcttggtggcgcatgcctgtaatcccagctactcgggaggttgaggcaagagaattgcctgaacccaggaggcggaggttgcggagagccgagatcatgccattgcactccagcctgggcaacaggagcaaaactccatttcaaaaaaaaaaaaagaggtaatggaagctctgtcagacaaaatttgataatagagaaaggacatgaagtagggacaatttctccttttatattgtggctgtattttataattttacaaaatacatattatgcttcgtttaaccagtcctcaatgatacacattcagttttttgattatgtcagagagaaccttcttctgtgtctatggatacttgtaggcacattttcataacatatttctagagggagaattgttaggtcaaagcatatgtaccttttgaccttttgctcatggacgctgccggatttccttcagaaataagctagtctggtttatcatctcatcagtagtgtgaaaatgctcttttcttcacattcttatcatgacaaggatatttctggtctttcacattattggctttgaataggcaaaaaccaaaactttttttatttttgttttttgagacagagtcttgctctgtcgcccgggctggagtacagtggcacaatcttggctcattgcagcctctgccccccgagttcagatgattctcctgcttcagcttcccaagtagctgggattacaggcttgcgccaccatgcctgaccaacttttgtattttttggtagaggcagggtttcaccacgttggccaggttggtctcgaactcctgaccttaagtgatctgcctgcctcagcctcccaaagtgctgggattataggcttgacccaccatgcctggcctttttttaattttaatttttcactactctgtattaccttgaaataagttttaggtctgttttctctttcatatgttattaaggtagatgctcttatatgaggaataagaatctaaaagtaaacagttcatgaaataatgatatttactgactgcttaggttcagccgctgtgctagaaactttgcataattaccctttactctgacaccaaccataatagatgataatactatcttcattttacaaatagggacattgagattcagatatgctaagcaggttgtccagtggtgcacagctaataaactgcagagctatgatttgagctcagttgtggatctctatttcccacaatccttctccaaggattttctctcatcttcctgaaaatctctcgaagacactgatgagttatttgttaatcaccaaatctggtggattttttgtttgtttgttttttaagtcctcatctggttggacctttatcattcagcacagttagtgtatattttattgaaactttctttcctggcttcctaaacaatttttttattttttttttggagacagagtctcactgtgtcatccaggctggagtgtagtggtgtgatcatggctcactgcagctatatgttgcccaggctgctgttggactcctgggctcaagcgttcctcttgcctcagcctcctgagtagttgggactacaggtgggcatgctactgtacccggctggaagcacataactttaaagctgaagatattttagaaaacatttacatagacatttcgtctaacttaatttatagaagaggcaactgaaatctaatatacttaaatgagaattggtatatcaacatttatagataactcttttacttaatttttacgtgtatgttataggaatgtatttgattttgagtaatagtaaaatgaaaataaaattatacttctaatctaaggaaagcattcattgtaaatggttaaatataattatagaaattgtcaatttgtgattgtaaaaacaggataccattttcaaacaaaatacttagaaaaaataaattcattgagggaatttttgcttgtaatatggttttgaagctgtctaatatgacagaaatatgtgtttaaatttattaaagattttacttgctctaaattgcttttttttaaaaaaaattaagtcataaaaccatgaaacaatatacttatgtctgatagtcctaaatattaagtaactaattatatttccgtatttattcacaggcttataattttagttctgccacttattgtgtcaccctgagcaagttgtttgacctttcttggcctcagtttagtcatctgtaatataatgatgatagtaactacctcacaggttgttgtgaaggttaaactccataatgtatataaagtatttaatacagtcttaggacattgtgtacattttataggtagaagctattaaagtggcatggtttaaaagaaaattatacagtagtaatgatatgatgatagggagtctcccatagttgtttcctggcagcctgcttttggtattatgtgctgctgttgcttttcagggaagaatctttgaaagaagtggctttgtatgaataatgatagatgcatccacttttttttttttttttttgagatggaatctcactctgtcgcccaggctggagtccagcggtgcgaactcagctcgctgcaaccttggcctttccagttcaagcacttctcccttcctcacatccccagtggctgggattataggcatccgccaccatgcctggctaatttttgtattttcagtagaaatggggttttgccatgttggccaggctggtgttgaactcctgacctcaggtgatctgcccgcctcagcctcccaaagtgctggcattacaggtgtgagccaccatgcccggccagatgcatccatttttaaataaactatcttattgaattgtaagatagtttaatgtgtacgaatagtatgtaaacagcatggtaaacttttataatatgaacacacttatataaccactacccaagtcaagtgtattgactaaatttgtgtatttatgaagtgttttttttttttttttgagacagagtcttgctctgtcgcccaggctggagtgcagtggcgtgatctcggtttattgcaagctccgcctcccaggttcacgccattctcctgccttagccccccgagtagctgggactacaggcgcctgccaccacgcctggctaattttttttttttttgtatttttagtagagacggggtttcaccgtgttagccaggatggtctcgatctcctgacctcatgatccgcccgcctcggcctcccaaagtgctgggattacaggcgtgaaccaccgtgcctggcctaaagtgtgttttgactttatatatgtgcttggttgttttattcttgttggtgtgtgtgtgtgtgtgtgtgtgtgagtgagacagtgagtgattttaaaagatattctccttatgaaacttttgggaaaataccttcaattttatgacttgctttttcactccccaggctgtcttaggtgaatacatggtcttaattttaataattttaatatagtttaatatgtttttatttttgaaagatttcccttatgattatgattgccatttgtgtcctatttaagaagtgtttaccttccctaaagtaactgtgatattttcctgtttcctttttaaagctttattctttcaccttttacattttgatttgccacccatctggaattgatttttgtgtatgatatgaggtagagattaagatgcattgttttccccatgtggctatccctaaactgagcaccatttattattctactgcataacagtgacagctgccatattcatgaatcagatgacctcatatgtgtgggtctgtttttggactctttattcatcattttgactgttcttctgcctgtgtcagtgtcattaccataactgatagtgtaaatcctcctgattgttcttcaagggcctatttttttgtcctttgcattctaggtgaattttataaactgtaaatttctgcaaaactattttaatttcaacgtatattttctcctaagtatgttttgagagttactttctgtctgcactttaattacatcattccatttaattctgccttctattatttccatagaaaattggctactttgatagcaatatgtccttttcccccctctggctgcatttagggtttttctttgtcttttgtttaagcacttgatctacaggtgtgtgcctaggggtgtgtgtgtgtgtgtgtgtgtgtgtgtgtgagattctgcttggggtttatagagcttcttgaatctcttaatagctttccccagttttggaaaattctcaggcagtgtctctgcaagtatttcttttaactttttttttttttttaacattttctctttctcctttgcttctggcattttagttctatatatataagactttaaaaatgatctgtatatttctgatgttttccctcccctcaatactttttttatatttccttttactgcttttctgtttcaatctgtgtattttcagtctggcctatcttttaaaaattcctcttctcaccaatattttactgtaaaacattaaaaaaatagtaataataaaataaaaaggatggatttgtgaacaaaagttctctgaaaaggaatttagaggaaagaggctttattcgagtgagcagtttgcaaactaggaaggcatagccttctgtgtaaaaatgaagatactttccagagatcaaagggagggattatctttttatttatttattttttatttatttgcccagagatcaccctcaacctgagggaggtattgtcttttatagagatcccacccaggttcccactcaagtccatttatgcaaatggaggattagaacttgctcccttcttccctccttccctcctttttgttagagacgggatcttgccatgttgcccagcctggcctccaacttgtggcctcaagtgatcctcccatgttggtctcccaaagtgttgggattacaggtgtgtcaccacacccagcccaaacttgcttagttctgattggttgactggttggttcaggcagaatatataggaacaggaagctatgaaagtcccaaagttaaacagacatgtaagtttccctggaactaatagtaagtgtgtgacctctaatcagcaagtggctgcttgactcttatttttaatttagacccagttagccacttaggatccatcttgaaggattggctcttttggggttcagattatacagcaaacacacatacacccaccacctggattctacagttaacattttgcgacatttgctttatcccatctttccctctatccatttatcaatacatttttatcttatgaggcaattcaaagtaagttatagataccagtacactgtactgctaaacacttcagcatgtgtatcataaagtaaagcttaatatttgtttatggttctttttttggaggtaaattttatatatggtgagatgtacaggtggtatttataagtcaagttatgagtagccatttgttgaatttgtttttttaaaaagtagattccagctttctgctgaagttctctgccattccatccattttcttgcacatttctattgttattttaaagtccctgttttaaaatttcaatagctggataactgtggtgatgcttctaccaatatcttttcccccattggtttttggcatttgattatatttcttgttagaatgacaactttgttttttagcattggtccttgggtatgaaaaattcttgacacgtgctgttcaatatggtagccactaatcactgtggctggctggctggctatctttgtctgtctgtctgtctgtctgtctgtctgtctgtctatcttatctatctatctatctatctatctatctatctatctaatctatctatctattctattgagggtcttgctgtgtcacccaggctggagtacagtggcaccatcttggctcactgtaacttccacatcccaggttcaagtgattctcctgcctctcagcctcctgagtagctgggattacaggtgtgcaccaccatgacccagctaatttttgtatttttagtagagatggggttttgctatgttgggcaggctggtctcaaactcctggcctcaagtgattcgcccagcttggcctcccagagtgcttggattacaggcatgagccaccgtgcccagcctatttaagtttaaattaattaaaattaaataaaatttgcaattaaattcctcagttacattagccacatctcaggtgcccaatagctacatgtgcagatagagatagtacaaatagtacagataggaacatttccgttgttgcgaaaatacggtaggacagcggtatgctagtgagtctacatgaaatcttcctccagagaaaatgcagttttatgctggaaggcagatcaagtaggtagatcatgttattctaagggagaccggtctgtttcagtttgtctttgttctagtagttcagccctttgtggttttgcttgaaaagcctgaggcatctgccaaggcccctcttccttggtaggttctgaattccaggttttgttttgccggcccagtgggatggctgcaggctcttgactactactttctgttcagcctctatgccttactttgaattgttgactaccttaaggatatataaggctcactttagtaagttttctctttactctgggattttattctctcaggtcctggctgtcttgtctgttctctgatgactttgcgcattgttttttaaattgttttttgtttttttgagatgaagtcttgctttatggccaggctagagtacagtggtaagatcacagctcaccacagcattgaccccctgggctccagtgatcctcgcacctcagccttctgagtggctaggaccacaggcatgtgccactacacctgactcattttttcattttgtgtagagacgaagtcttgcagcccagactggtctcaactgctgggctcaagttgtcctctaaccttggcctcccaaagtgccaggattacaggtttcagccaccatgcctggccttttttgtttgtttgtttttcaatagactattttgtagagtagttttaggttcgcagaaaaactgagcagaaagtactgagttctgtataccccctgcctctgtacacatacagcctgccactattgacatcctgtaccacagtgtacatttgttaggattgataaacctccattgatgcattgctatcacgcaaagtcagaaaacacacccttttttgtttttgtttttaaagagttgaagtcttggccatatgcagtggcatatacctgtaatcccagcactttgggaggctgaggcaggaggatcgctccaggagttcatgagcagcttgggcaacatagcaggaccctgtttctacacacacacacacacacacacacacacacacactacacacacacacttgggcaacatagcaagaccctgtttctacacacacacacacacacacacacactacacacacacacgggcaacatagcaagaccctgtttctacacacacacacacacacacacacacacaccacgaaaaaatacagcttttaattttttgtatgtgtgtgttttgtagagacagggtcttgctatgttgcccaggatggtcttgaactcctggcctcaagctatccttctgcctcagcatctggagaagctccaactacagatgtgcaccactgtctggctacacacagctatttttatgtgtatattttttctagctctatagttgttcagtatccttccattttctttattagacaatataattcagtatatttgaaggtgccttgatggctcctggcagttctctagactgttatttgttgggattactggttttgataggaaattatgcagggtgtgttatgtggaagagtgttatattttcatgttcactttaatcccactcttctagatatagaagttgattaattttgttggctattccgtatgatatcaaaaacctgagaatttcatttaaaatacagattaaaatggaatgtatttggggagcattatgtctctatattttgtgttcatcgaatacatctttaaggagtgatttaagtttgtaaaagactctgccagggattgtatgaaatatacaaatgagagacagtttctgatctttccagtcttcttaacagagttgataagatacatatataaatattgtgaggacactttgtagagggcatattttatttctaatatggtttacaatttaaatcttaagtttttgtcttgccactatcatttattgaccctggggaaatcactcaagcactcttaacttgtgatgcttttgggtttaagggagactagttatgtgccaagtgctttacttggttttattgtcacaataatctggaaaggcaagtatatctctcatttacaaatgtatgaattgaggctgcagtgacgtttacaattcacataaggcattgagtttgtaagtaattgccagagttgggatttgaatttagttctctattactccaaagtctgtatttatttgactataccagcacataacaattgttctaagaatcattaataggttgtacttgaaaaattgatggtaataatatgttttctaataagcgctttgaaaaaatcaagtgtaagatagcatcactcctgtagtaatcctgctaaaaattaactgaattttcttatgagaaaatattaaacaaacaccaattgaaggatattatacaaaataactggtgtgtattcttagaaaatgacagtgtcatgaaaaccacagaaataccaaggagctatttcagctaagcaaaactaaagaaacatgaatctgggatttatttatttttttaaagtattgttgtgacattattgggacagttggcaacattgaattgtaatatcatattaatttcctgattttgacaaatatactgtagctatgcaagagcttgttttggggaagtatacactgaatgaagcatttagaagtaaaggggtacagtgtctgccacttaactctcaaacagttcagaaaaattatatttgtgtgtgtatataaaagaaagagagttaaggcaaatggagtaaagtgttaacatttggggaatctagttgaggggtattatcagaattgtgctattttttgcaacttttctgtaagtctaaaattatgtcaacatgatcagttataaggaaaaaaaagtataggaaaaatactaatgatttttctagctgttaagtgataatttaagaaatggtgtgctccagagcaccatgagattacgtgagatcacctgatgaaccagagtgtcattttctatgtgctcatttatgcacaagtacccggtcttatggttaaataatgtgtttattttatttttatttatttatttttttaaatttttttgagagatagggtccaggctggagtgcagtggtataaagacagctcactgcaatcttgactttgtgagctcatgcaatcctcctgcctcggcttcccaagtagctgggactgaaggtgtgcatgatgttgcttgtatagatggggccttgctatgtgcccaggctggtctcgtactcctgggctcaagcagtcctcctgccatggactcccaagatgctgggattacaggtatgagccactgcacctggctgaataatgcatttaatagttcataaagtaaaaaatgatttatctacatggtggtgaggagcttggactgtcactcagactgcataggtttgtataagccccacctttcactaactgagagatcatgaaaagttacttttgcacttagttttctcctgtctaaaatgggataatgtatctacctcaaagggttttgttaggattaagtgagataatgaatgtaaaacatttagcacagaatctgactctaggctggggagggtggctcatacctgtaatcccagtactttgggaggcctaggcgggtggatcacttgaggtcaggagttcaagagcagcctggccaatgtggtaaaaacccgtctctactaaaaatacaaaaaaatttagccagccatggtggcaggtgcctgtaatcccagctacttgggaggttgaggcaggagaattgcttgaacccggcaggcagaggttgcagtgagctgagattgtgtcactgcactccagcctgggtgacagagagagactccatctcacacacacacacacaaaaacgaataaagaagctgactctaataagtactcaatcaacattttaaattattgttaataattttacaaagttagaaagttaaatcatttattgcagttaaataatttttgttgtctgatctagcctaaatatacctaatagattatgagcctctgttggtgttttactgacgatacattataattttaaatatacttcatagtcagataaatttaagacataattggattgttccatactcacctcctaatcacctgtaaaatcaggatacttacatttattttgttatgtcatacaataagatattcgaaaagattgtaaaatccaaatgcaatacaaatatgtagcactaataatatagtgtgtatatatgagctgtgataatcatacattaatttttcgacattaacatgtaaagaacagatacatgctacctcagttactgacatgttttgtctttattttccacagatactttttgtgttaccctaccaatctggtcccttagcttctctctcttgatatatgttagtaatgttctcacagtcttctcttacatattgtgagatttttgatagaatcttgctctgttacccaggctggagtgcagtggcgtgatcttgactcactgcaaccttggcctccggggctcaagcaattctcatgcctcagcctcccaagtagctgggattacaggcacgcgccaccacacctgcctaatttttgtatttttagtagagatggggcttcaccatgttggccaggatggtcttgatctcctgacctcgtgatccacctgcctcggcctcccaaggtgctgggattacaggcgtgagccactgcgcctggccctagctaagttatttatttgtagagacaaggtcttgctgtgttgcccagccttgtctcgaacttctgcactcaagctgtctgcctgccttggcctcccaaagtgatgggattacagatgtgagccactgtgcctggccctgactcctatttttataaaatattagctattgatcagtcatagaaatgcaaattattgctgtattcatctcttttggtattgggctgtgaactatatttgtggcatattggtaacaaatattaaatctttgctgtcttctatcctccatctcttgagtttaaaatttaataggctttgaaaatatttgttattgttgttattctttgtacttggtgctttgatctggatcattgtcctgcatacttaaaagattaagtggcctttcaataaggatatttttaactgtgatatttttagtctaagacacaaactacatttgaatgagtatctattctgagcctgtactttgattacatttcaacatgtaatcacaacatggatagttgcggttatagagtcataaaaacaatctgcatgaaggtccagtattctgtagtgatgttatttcttattatatcgaaaacattcataacaaaaaatatttgtagaagcggttgatcatctgttttgaaatctgtctacctttctaagaatgttgagggtttgttgcttgttttaaaaaagcaccattctgtgggatattgaaaaagctgctttaacctgaaataaactcactagtagtattttgacagtcatccttctgttaaagttccacttgtggaaatgctgttctgtattttcataaattttagttgcattatgatttggaaggagtcttgcaggtactctagtgtaagttcccctgttatgctaaaagagtctcctttatggtatcctctacacagcgatagaagcttgaagggacatctccaatatttctttccccctgaggcaacacattcccacttcaaatacatgtattagaaaattgttcctggctgggcatggtggctcacacctgtattcccagaaatttgggaggctgaggtaaggggatcacttgaggccaggagttcgagaccagcctgggcatgtagcaagaccatgtctctacaaaaaataaaaaccattagctgggcatggtggtgcacgcctgtagtcccagctacttgggatgctggagggaggaggattgccagaccctggaggttgagactgcagtgagctatgattgcatcactgctctccagcctgggctatagacaagaccccatcacaaaacaacaacaaaaaacccagaaaattgttccttataataaataaaaataaataagattcacttaagatctaatttgatacttatagtaagaaaactagtaaattcctttgcagtctcaaagactgacaattttaaacattaatctttttttattatgtgtttaattaattttttttgagacagagccttgctctgttgcccaggctggtgccatcttgcttgctgcaacctccgcctcctaggttcaaggaattctcatgcctcagcctccctaatagctggaattacaggtgtgcgccaccatgcctgactaatttttgtatttttagtagagatggggttttgccgtattggccaaggctggtcttgaactcttgacctcaagtgatcctcctgcctcagcctcccaaagtgctgggattacaggcgtgagccactgtgcctggccctattttttttttttttttttttgagtcttgctctgttgcccaggctgcagttcagtggcacagtctgagctccctgtagtcttgctcaggctgtcctcccacctcagctccccaagtagctgggaccacaggcacacaccaccatgctcagctaatatttttaaaaaattgttttgtagagacggagtctccatatattatctgaggtggtcttgacctcctggctcaagtgatccctcccagcttggcctcccaaagagttgggattacagtcgtgagccactgcacctggccagtcttattttatagtatgagatgcttgttttagaaacaataaaatattgtggaaatatatagcatttcctactccttgccaggttgattcctcattgataattgctgatacaacttaggtgtgtatccttctatttgctgtgcttgtacaaacacttgtttatctatgcctgcattttataaccactttaggtctttgctgtcttttgttacaagtataggggtttaacttgtaagaatttgttgagtgcatgatgaattggtatctgtgactaatcacacctactgactagtagatggtcacatccactgttgagctcatttcctaactgcctctgtaaaaagatgttacagtcgtctttaggaactctgtgtcccccaaaataagagctttgttttaactaagaggtattttagaggatgtctatgtatttaatgtgaaagattttttatggttaagatgagtaaatgcttaaattacaggaagagttcagtaaaatgtctgctagaattctcttaaatatgttatattttacatttcctgattagttttaaaatcaaaggtgataggtttaaagaaaaagagattattgagaaatgcagcatctaagtctgagcacttccattaagataaaagtccaatagtttttttttcttaaattttttttatttttattttttatagagatgggggtctcactatgttacccaggctggtttcggactcctgacctcaagcagtcctcccatgttggccacccaaagtgctgggattataggcgtgagtgagccacagtgactggcccaaaagtccagtagttttagggatcataggaattatttattttaaggtgtagtggttaaaagcatggattttgagttctaactatacctcttactagctgtgtgaccttaggcaagttacttaccctttgtctgtttcttcatctattaaaagtttttatatgaatatcaaatgggttaatactcatgcttagaacattgcttggttcatagtattatgttggtactttattactgttactgtatattttaaaaaggatttatgtaggatgaaaagtttggtttaaaaaatgccagcaaaatctctctgtctcttccccttttcttttgattgtcatagaaatctaaagaccagttaatcataaaaggaacataacaaatgttttctcacgttatataactattagaaaatataagtcagtattttcctgctctgtagaaaataaaatcagaggatatctttattgaattgccaaaaattacttctgggccaatttctaggttttctgttcatttggtttcctgtgtttctttgaatcaaaaggttttatgatttgagatgaaatggaatagagaaagaggctttagaatcaggggtttacatttaaattccagtcccaccactttctgagtaactttgggcagtgtatttgttatctgttgctgtgtgacaaacaattccaaaatttggttgcttcagaaacaatgatttattatttctcattctgtggattggctgtactcaacccaggggttcttctgtttcatgtagaacattttgtttacccacatttttggtcttgggtagaagaacaatgcagtaatctgtttttaaaacattttctttaaatgaaattatgctcatgcctgtaatcccagcacttcgggagaccgaggcaggtgggtcatgaggtcaagagatcgagaccatcctggccaatattgtgaaaccccatctctactaaaaatacaaaaaattagctgggtgtgatggcaggcacctgtaatcccagctacttgggaggctgaggcaggagaattgcttgaacccaggaggcggaggttgcagtgagccgagattgtgccattgcactccagcctgggcaaaaagagcgaaactccatctcaaaaaaaaaaaaaaagtcatgatacctggcacattgttaaagctcagtaaatagtatttttttaaattttgtagtgataaaacagttgtccccaatgcaaaatggctatgtaagagtccattggttcatacttgttcagctcttattggtgatgtttaacaacattttctttgttttcctgaatgaatgatgtatgctattagcttttgttggttgatcaattcattgaacaaataatgaagtgttttatgtgttgggaatatagcattaaaagaattaaagttcttgcccccatggaatttatgttctagtgggggcagagaggaaatagataataagccaacatatttatcagttaatgacaagtgctatagagaacagtcaagcaagataaaggaagaaaggcaagtgccatgtgttggtgagggtttactcttctatttaagatggtcagggaaggcctttctagtaatatgactgttaagcagtaacacaaagtaagaggaagggatcaagtcttgtattctctctgcctggaactctcttctcccagatatttttaaatgcagaggtcttgaggcaggaactatggtttgaaacagtaaggagactaatgtggctggaccagagcaagcaagtgggagaatggtaggaagtttcagatgtagctaagggctgccccttgtaggccattgtgaggaattgagataggaagctatcagggttttgaggagaagagtgacatggtctaatttatgtattaaatggatcactcaagctgctagattgagaatagatggcagagggtaaggacagaagcaaagaagaacaggaagctcttgtaataacagatggaggtgatggggggttggattagagtggtaacagtaaaggtggttacattgtgaggaatttgacttttactgtgataggaagccagctgggattttgaggagtggagtgacatggtctgatttgtgtactaaatggatcactcagactgctagaatgagaagagatggtagaggataaggacagaagcaagaatagttaggaagttcttgcagtaatccagatgagaggtgatggtggtttggatcaggatggtagcagtaaaggtagttacattctgttaatagatacaccatattttgaagatagagtcaatggaatttgctgatgtgggaagtgagaaaaagaggagttaaatttgattctcacaggttgtgggcctgagaaactgaaaggacagaattgtcgtttactgacatgggtaggactgtgagagaagtgagtttgggggaatcaggagtttttctgaacacattcagtttgagatgcctaataaacattcaaaaagaagtgctgagcagacaattggattcacaagtctggagttaaaagagagaggtctgagttggagatgtacgtttgggagtcttaagaatagaggtgcttatgtaaaaacatgtgacaggatgagatcatgtaagggaggttagtgcacatagagaggatagattcctaaagactgagccttcagataccccaaagtttaaacgttgggaaaatgaaacggaactagtgaagcaatctgaaaagggtgtgctagtgagataaggaggagaacgaagagttctggtgccctggaattcaagtgcaggtagattaataatcagctgtgttaaatactgcaagtcaagtagattgaggacgtagcgaatgcagtggtttagtgaccttgataagagctatctgggtggaatgatagggtaatgaaagcctttttgaatgagttcaagatgggggtggagttggaggcagcttgtataaacagtgctttcaagaaggattggtgtaaaatgggaacagaaaaaggggtgatggctgaaggaggatatataatcaagagtttttttattctcctttatttttccaagatggagatctagaattgtcctatagagaaagagatattggtaatgagggtgggaaattggagtgatgtacttcagtaggtgagcatggatgtcttagatagaagcattacactgacagctgcaagtggtctagtagatgtggtaagaatgtggaagctgtctttcaaattacatctatttattttagtaaagtagaatacaaggacaacagtgaggatgaggaggaggtggatgtttgaaaagaggaagtgtgaagtaggacagtgagtatgaatagttcacaggaatgtatatactgctttacatttcacacacattcttttacttagtcctttagataatcttctgagtgtgtaaggttagtaaaaccctgttttaaaaatgaaaatactaaggcttaggtaaattactcgctattagggggagagctgtgtatctactcctgagtatttgaaatctagctctatttaggtgatttttattatgtgaaatcagtgcttccttaccaggctccagtgtttgtcttcccagagcttttcttcatacattcccaactttttatttttattattattttttgagacacagagtcttgctccgtcacccagactggagtgcagtggcgcgatctcggctcactgcaagctccgcctcccgggttcacaccattctcctgcctcagcctcccgagtagctgggactacaggcgcttgccaccacacccagctaattttttgtatttttagtagagatggggtttcaccgtgttagccaggatggtctcgatctcctgacctcgtgatctgcctgcctcggcctcccaaagtgctgggcttacaggcatgagccaccacacctggccattacattcccaactttttagtactactgtaacataaagttcaatgaaatttgcttgaagggaattgcatgcatgatccatgttcttttatattggattgccagtatatgagcaagaggttcttactattttcttttagtggcctagaggtttgaaaaatgaataggacaagattagctcaatcataaaggctgttgcactggacaaagtaggaagaaaaatcaatagttcctttaaaaactagtgcccatagccaagggctcacacctgtaatcccagcacttcaggaggccgaggcaggcaaatcacttgaggccaggagttcgagaccagcctggccaatgtggcgaaacctcatctttactaaaaacacaaaaattagcctggcatggtggcacatgcctgtagtcccagctactcaggaggctgaggcagcagaattgcttgaacccagaaggtggagattgcagtgagtcaaggctgcgccactgcactccagcctgggtgacagagcgagactccgtctcagaaaaaaaaactagaaaaacgagtggccactgtttcctttttgaatatatgttccatcaaaggcattttcttcctgaataggccagttctgtctgaggccatagttgttcttcatgtagaccctctctactctgaccttcctgagcactggagtgtgttcttctcagcatcctggtgagctgacatggcctgtcctgttaacagctcattttttataatagacaaaaagtagaaacaacccaaatgtccattacccgatgaatggataaataaaatattgtatacaagggaatattattcagcagtaaaaataaatgaagtgcagatatgtgttaaaacatggttgaacactgaaaacattatgccaagtgaaagaagccagtcacaaagactacgtattatgggattccatttatttatttatttattttttgaagacagagtctagctctggtcgcccaggctggagtgcagtggtgtgatcttggctcactgcaacctttgcctcccagtctcaagcaattcttctgcctcagcctcccaagtagccgggattacaggtgcacaccaccacacctggctaatttttgtattttagtagagacagagttttaccatgttggccaggctggtcttgaactcctgacctcaagtgatcctcccggcttagcctccaaaagtgctgggattacaggcgtgagccaccacgtccggctggattccatttatatgaaatgtccagaataggcaaatctatagagacagaaagtggatttgtggtggcctaatgatggagaagtttgaggaagtgggggagtgacttctagtggataaaatgaaaattgtttttcaacttaaccactttaacataagttttatatcagtgcttcaagattttagagtaaaaggattgataaattcaactaaaagcacatggcaaaaaattaaaaaggaaaagaaatggcatttcagatgtagattggctttatcacatgccctaaactgttgtgtttatggttttcacacttaccttctaactgtgagttattatttatagagtgggagaaacaggtttagttgtattctccattcaactggcatgtttaatttgcgccttgactgttctacaaaagtacaaatgatgtctattctctgcaatatccttagcactgccacatacacatgcccagaggataagagttaaagtagaggaaaaaagtggaagaactttctgtaggagtaggacagaagatttctgtgagtggtccattagtcagaattcttgctatggtcttttccatacataagtatatttagcccatgggaggaatttgagagccaattaagatgaaaccagtaaactaagctttattcactactgacagacggatgtattctttcaatgcatggtttattttttaaagtgtattgtgttgtaaactggctggtagaactgtcatgtctctggcagtttcatctagattttaagtgctttcaggcattgcttcccaactttcctcatgctatggtatgatatacatagaaaatgcatggcatgctacggttaactggggaggatttggtcttgtttgtaggggacttagtgaagaaatttactgcattttctctatgatagataacgtattgtgaaatgaaatgcggaagcttttgggaagctagttgtggcagctgtgaaagtgtgccactcagaatccccttcaagagagtcccctgtgtagagcagctggctgagagcctccagctgctgcaccttcagatgtgctgcagtgctcaggctgaggccatacttcctttgggccccttcccaccaatgaccaggcacagtgtggggcactagagttgggctattcttgcttgatgggaggctcctcatacagataatgtttgcttagggacttggtattggcctatccgagactttctcataactgcactgctgtgggaggttctttgtacctaactactcctttgcctctcttcttccaccctcagaccctgctcaagtttctcctcacctccttctgcttcctctgcctgtatgctgcccaggcatcttccccagcaaatttctggtgtatctaatttgcttctcagaggatctgaactaatgcaataatagatagtgaacttgtataaaactcccagttaaaactcttttgtattttaaaatgggaaacttgaatttgcttctgtgagtgtaacttttgtatctcaggttttatgtttgagtggctatgtgcaattcctgatcaagattttgtaaagatgactctgtattcttgttgtcaccatcagttagaaacttgacttattcattaaatggtagcacatggcagaaggaatttgttgctctttgtctgacagaaactcttttcttactgttaacagaattaaaatgatttcagtctctttaagtggtatatcttaggtgctgttattgttactttcctttattgccaaatgcgatactgaaaagttctacaccgaaaaatttcaaatcctatgaagaattttccatattaaatatttcaaaataatcataaaacttttatacacacagtaataggcctatcattagtcttactgatttttgttttgcattcagattagtatatggttaacattggtagtgaatctcatttccacgccgtactttcaaaactgcatttttgctttgaatcttttttagtataggttaatatatgctctttataaactcttgtgccccgttctctttctttctgcctagacttctgtatttgaaggcctagtccaaaaccagaccgtactctgatacttttctttgtgtgactcaacctgtgttgaaatgatttatttgagaaatgtttactgaatgcatattctttacaaggttctaggtacacaaataatgaacaaaaagggataaggtctccatctttgatagctttttttggtacaatattgtgaatatataggattaataacagtgcagcttcctttttttatctttctacaacacgttttagcatttgattatacctaaatataattaatgtgtatacatccatacacacacttgaatattttgtcaaaagaatgaaaacttcttataaccatgttttgaagatcttttatacctcatagaatctccccgtggctcttgttttcaacaaatgcctgtggattggttaaggttctactgaatcttaagtattatttacagcagagatggggccaggagtagaatattcactggacagatcccaagtctgtagtagaaaacagcttgttcattatcctctgaatttcctttgccagaagagttgtagggaagaaatggggtggtcctcccattggtctaacttcttgagtgtaaggctttggttctcaactttggctatatgttgaagccactcttgattcctaagtctaatccccagggtttctgatttaattggtgtagggtgtggccaggaccaaataattgtaatgtgtagccaagattgagaaccactgccttaggagatgacaacccccagtctcagttaagaaattagcaggcttattttgcttaactctaggtaatatacgtactgagaaggtctgggaaccatcccaatagtaatgaggatccatagctccctgatctttgtttcaaaggtctattctatacgaaaagataccagagatcctcagagaaatagctgtttttaggactggagcagggaaagaacaagatgtgcctggaatatcttgctgtgtcagaaagcaaagaaataatcagagattattgtcagaagaacataaaagtctgagggagttatgactggtcaaatctgggatttttttttttttcccccgagacagagcctggctctgtccctcaggctggagtgcagtggcacaatctcagctcactgcagcttggacctcctgggctcaagtgacccttccacctcagtctcccaaatagctgggactacaggtgcggaccatcaccctggctaattaaaaaaaaatttttctttttttggagagatgaggtctcattatgttgcccaggctgatctggaactcttgggctcaagcaatcctaccatgttggcctcccaaagtgctgggattacaggtgtgagctaccacgccaaatctgggaaaatctgagaatcaaaataagtaattatagtcatggattataactcattgaacaaagtaggaatcctttaatctgtactcatacaggtaaataaatgaaaaaaatgaaagtttgataagaaatggattatttatatagtttcaatttgagatcccacaaaatacttaattagaaagagaaaagtaggaacttagtagtagagaaatatagcagacatcatgtgatcaaagtaaaaattattagtaatggaacatatcagaattgcatgcctaataagatacaatgagaaaacatgatcacttctgtgatgttcctctgaatctaattatgaggaaacatcagacaaacccacactgagggacgtttcttcaaatatctgtcctgtaatatgttatacaaaggtcatggaaatctagacaaaacttaggaattattccatattgaaaaagactgaaagagataggacaactagatgcaatgcatgatcctgagttggatccttttgccaaaaaggacggtattagtataattggccaaacttaaatggagtctgaagcttagaaggtggagatgtatcagagttcatttcttgattttgatgattgtattgtggttatgtaggagaatattcttctttgtaggaactataaagtatacagatatttggcaagttattctcgggtgatttaaggaaaaaatatgtactgttcttgcaacttctctgtaagattgagattgttttaaaattaaacacatgcacactaatctaggataactgtgatccatatgacttctttggaattacacagctgtacatggagtctgtcttagaacatgaatcttctcaagggaaatccatatgaaggtgcaacataatttatctaggaataatatgtttcttggagtacatttcccaaatgaccaaacacttttaagtgctgaaatgctttttaactatgttgttatatgctgtatacttgtctgccttttaagacagaatacactgaatttagtttaatctcttggatgactaatggctccaattaggtaaatatttattactgtattctgaagtaatatctaggtctagattcacttttagcctttgaggattttgctttgtttttgttttctctctcaatgtctggttttcagttctgctgatgtcatagtatgtatttaatagtttgccagttctcttcctattgtgttatttctgatctgctgtagtcttaaaaacaagatgtatgtttttcctttttcaaaaaatgttatgttagtaaaactataagggaaaaggattacagtggaagagactttattatagaaatgttgtactcatagtacccctttcagattaattcaggattatgtctaggtttcaaagagttctgaaatagtgaagagttcctatacatagaatgtgatacctctgtcattttaccaacttcctagaatgccagttgaaattaggtaattttagagaaaaaccaccctgatttttgttttaattttaaatttcagagctccagagattatattggggttgccattttgtgaagccatagacatgtggtcattgggatgtgtgattgcagaattatttcttggatggccgctctacccaggagccttggagtatgatcaggtaacaaataatgataatctaatagaattggtaaaaagtaaagaataataacagacttacaggaacacatggctgcaggtgtacaatacactggaaagtctttttaacataaagtggcagaatctgggatcttgtagaattgattttgaaaactgttttataatgctgaagtaagttttcataaagttacagcctatagaatctcaaaaccagttttgtaaaattattgggaaaattttatactgtaaacatataaaaggttggattgtgtgtccatttaattaattgtgctttgcttgggtgacaaactttgatgtgtgaaacgtcagcccctcccaaggcataaaagctcctaaaaggcgttataacttttggtcttaaaccaactgccattattggtgttttaaatacctcagtaacttgaactcttctcagtctttttagctgttttgagtggtgctgaaattctcttttagcactgtttaatgattctcggtagaattcagcaaattaccttattaagcacacttttcatggtagttttcaggtatattcattagcctttctgtactattaaacagtgttgtgtgctagtagtcttaaatattaataccaagattattttttggagaaactgccatcttatttattattctttgagtatctttgagataatgtactcaactcattctaatagaaaatgctagtcaaaatcaacaaagtagttacattaattttgtcattctgattagtgaatatttttatttagatgatatttaactttcaagcaagaaaaaatagaaaatagaagaatttaaagcacctattacataatcatgattatagccttgtattttagggctattttctctatcaagaggaaaaagagaggtaattaatttaggtgacttaaatgttcctgagatgactctgtcatttaatactgattattagattagatgttatcattgactttaatctcttgtcatcatccatgaaccttcccttttaggttaggttttccatattctctaccttccctcctccatgttcagaattccactgggtttctgtaaaattttccatacatcctgtcttctttcagctttctacccaattactagctttgatacagatgcaagactaccgtcagttctgaacgagttagtaattgaatcagagtcccataatcctttagctgttggaatactgaggcaccagtaaaatgctagaaatacacccttggctttgtagattagcctatggcatgcataccgccctggagcaggacaccctctagtggcaatttcaagttgatttgttattatactcgattaggacttcacagttcatcttggacaactgatattagtattgaaaaggaccccagagattacccagtaactgcccccttttcattttataaaggagaaaactgaggcccagaaaaatgaattcacttgtcaaaagtcacaatagtaattttaaagacaaagccttgaccaaaactcagtttttctaaattttataatgaatgtttgttttttttaaactaaacttggaacaggtattatctgatccagattgacaatgttttcaggatgtatattaccaaagggattaaaaaaagtcattggcccttggcatatagcatcaatagtctcacagttcagtggggtttttttgtctttgtttgtttttcttttttcttttgagatgaagtcttgctctgtcgcccaggctggagtgcagtggcgtgatctcagctcactgcaacatccgcctcccggattcaagcgattcttctgcctcagcctcctgagtagctgggattacaggcacacaccaccatgcccggccaatttttgtatttttagtagagatggggtttcaccatgttggccaggctggtctcgaactcttgaccttgtgatttgcctgcctcagcctcccaaagtgttgggattacaggcgtgagccactgtgccccgcccacagttcaatgttttaaaatattttacaaaatacatgaatgcaaagcaaataaattgtagtgattttgtgggcgtctttgttttggccctaatctgggactttaagctcattttcaagcatggtatttgttataaaggctttgataaattttgataatttttttttttttccctatcagtcttaacttggtttaggactttcaagtgcttttttttttgcacttgttaaaatgttcacatatgtttttcttttttctttttctttttcttttttgagacagggtctcactctgtcgcccaggcctgagtgcagtggttccatctcggctcactgcaacctccgcctcataggttcaagcaatttttccacctcagcctccttagtagctgggactacaggtgtgtgccaccatgcctggctaattttttatttttagtagagatggggtttcatcatattgacgaggcaggtcttaaactcctgatctcaaatgatccacccaccttggcctcccaaagtgttgggaatacaggcaagagccactgcgcctggccacatatgtttctcagaacagctttagtctgtttattaatgtgtttgactttcatagattttccccatctcgctagattgtgatcacctaatgttaggatgtgaaagggccaccagtagggtatgtctctctctattatctgttccttattccagtaatcagctgcctagatatacttggacaccccaactggggagttggtattttttttagacagggtctcagtctgtcatctaggctggaatgcagtggcatgatcatagctcactgcagtcttgaactactgggctcgaggaatcctcctacctcaggctgtgcccagtagctggggatacaggtgtgcaccagcatgcctgactcatttttaattttttgtagagatggggtctctttctctatgttgcccaagctggtctcaaagtcctgggcttaagccatcctcccgcctggacctccagacatgctgggattacaggtgtgagccactgcacctggcctggcagtttttttctaattattattttttgccttacagtggcagtgcagtgggcaatagtaatattaactaattaatgcttactgagctcttttatgtactaggaactgctgttaacactttatattaactcatttaatgctcgtaacaaccctatgaagtacacactactgttgcctccattttatagatgtaaactaaagagttcttaacagtatatcatattcttctttagagacagagtctttctctgttgccctggatggagtgcagtggcaggatcatggtttactgcaaacttgaactcgtgggctcaagtggtcctcctgcctaggcctcccaaagtgttgcaataacaggcacgagccaccgcgcctggccaaattattatatttttaaaagccaaatttgagtcagcaggaaaaatattcaaagtattttaattcttcattatagggtttgtgttctagccctttaatcatatttatcatgtcttaaaacctttccaatgccattttctctttggattttagattctgtaagtagacactgaccgtgttgaaaatttataatttcatattttcttgtatgtgcattttatttccgtttatatagacatctatatttagtgtgtgtggttagggaagatcctacccaccaattgttacagtgcgtgaatcccttcctgtcttgattgtagataaactgtcttattagtgttctatttacaggacttatatttactagggacatatcaaaagtattctagggaattaaggactattttatggatggatggatggttgaatggatgaatggatggatagacggatggacaatagttggtaaatgttcattatttctccaaaatgtttgttggagtttagatagaatgttatccagaacaactaagagtctgactttatattcaaattatatttggtaatttcaagtcttatgtaagaaaaataaagttcactatttcaactgcagagaaaataaatctttcaagatttctatttttgtcaggctatttagcaaagagacccacacaagctggcccaaataaggggacatttatttatatgtgtggatgtattaggccatttgcattgctataaaggaatacctgagtaatttataaagaaaagagatttaattggctcacagttctgcaggctgtacaagcagcgctccagcatgtgcttctggtgagggtcttaggtagcttacaatcatggcagaagggaaggggagcaggcgtttcacatggtgagaataggagcaagagatgggggagatgggtactacacaccttgaaacaaccagatcttgagagaactcactgttggggggacagcaccaagccattcatgaggtatcggcccctattacccaaacacctcccaccaggccctacctccaacactggggattatatttcaacatgagatttggaggggacaaacattcaaactatatcagtggactatcacaaggatctaagaatggaactataatatgactgggatttgtgaagtatggaattgaaggtgcttttcaaagtaaggcgacacgagaggaattaacagatgttggtagaacttcactggtactggaccatcagtgtgacttggctgttcttcaagtgcctttgtctattctgatctgagtttctgctcaccttacctttgattaggtttcatgaccataaaactccggctctacctaataaccctttagctcatcccccaagagtcattggtatttcttagttcacatttctgacatagttaatctgattgacttagtttttttctagttgagttcatgaggccagtttagaattatgtgtcagattcccattcttcatccactggagatggaggaaggcaaatatatttatatattaggggttctagatggaacatttttctcttcaaaagactgggcagacagtatgacaagtaataaactcagattttcactggccacttttgtttgtttgtttgttttttgttttacagagccatctcaactcctgaggtacattaattgctctattctctttgcttttttagcactttgttttcttcttcacaatggcttactagcttaattgcagattatatgcttaaatatttttctgttctactgaattgtgcttttgaagattggcaccatatttatctacatgtctttagcatctagcaaataatagatgctctgtttgttgaaattgaattgttgatggcttttctgtctgatgcagcatctaggcaccaaactcttagtactttttccttccatttttctgtttccttaaaataaggaagttagctacttagtgggtgggaggtggggagaaagaacagcactttaacgaaatgaagccagtttgtaatgtggaagttttcgttgtcattttatataaaattggggatacaaatgtggataaaacagactgttattggaaggcacacaatctagtagggaaaacagacatgtaaaaaattgtaatatagttataataattataaatgcatgttctaggtgtgatgatagcacagagtagagtaattacctctgcttggcatcgtcagggatggctttatagaggagaagattcttgagctgagtcttgaagaaggaatagtagaagtttgtcttgtggatttggtgaaagggggaatatgtatgttggataagtagaagttcgagaacaatataggaaagagaaactggcccatgtggttcgacatggtgccagttggtgccgaagtaccaggagaatataaaagggcagggaatatatatagttggagggcctgtttgctagggttagaggtctggaattgatcctctaggtcaggggtgtctagccttttggcttccctgggccacattggaagaagaaaaattgtcttgggccacacataaaatacactaaaattaatgatagctgatgagctttaaaaaaaaaaatcacaaaaaaatctcataatgtcttaagaaagtttacaaatttgtattggacctcatgcagcccctgggccgggacttctggttggacaagcttgctctaggcagtaaagggttattaagtaattttacacaagtgactaacagatgcacattttgccagaatgtttggcagtagtgtgaataatgaattgggcgtgagcggctaaggacattaggagagactggaggcaggtagaataatcaggaggcttgtgaaattgtataactcagaattgaagaggatctgaggtagggatggagaggaggggacagttgtgaaaaatgttaatgaagtaaaattgttaggcttttggatattgggggagcatgatgaggaagaggtacagggcatcaatttcaggtttctgatttgagtggatggtgttgctattaaccataggaggaaaatacattaggattagcagatctgggggcaaatcagtttaggatatattcagttggagatatagagtccagccaggttgaaagtttcaataagcggttgggcctggagctccagagctagagccaaagattgaggcgcagatttagagataaaattgtgggcacttaggacttgtagagggaaaaaagaaagacaagactctggaaagcagtgtcatataaagaacaaacagaggaacagagttaaagactgtcaggaagtagaagagacccagaaaagcatggcgtcgtggaaattgagcgatttttatgtaaaatggtagtagccattagtatcaaagtaaaataaggatttatatgtgattattaaacatgtctgttactaacaggccattacttatcttaataccatatcatgagggtgatgagactaaaattcagattgcagtgtgttgaggtgtgaatgggaagtgaaataatataggctactattttaagggtaagacgagagagttaagtagttaagggaggtttactttttttttttaggatagaagatattgaacatttttgtatttggtggggagagagctcagagggaggaagaaatagaagatgcagaagaggatggactaattgatggagcagagtctttgaggttaaaaaaacatctttgcacttattctcaaatacaggttaggggagtcaagttttagtaagaaggaaggatggaaaaacaattttagcccccagagatctctctctttgctaagcccctgtttatcccccgtgtttcccactcattaagtgggggaatcaatatttcagggcctactgtgtaccatgcactttcatgggctctgggggtatataagtaaacaaaaaaattcttccgttcatggaacttagagtctcatggagaggtaagaaaatggaaagtaaatgcatagaatattagataatgaaaagcgcagtggagaaaaatatagccaggaggatggtgggtgagttactgagaagggcagagtttgccgttatttattgatgggtcatggaaggcctggtcaataaggcaacatttgaaccaagagctgaaggaagcaagagagccatacagatatctaggggaagaatgtttcaaacagaaatattaagttcagaagccctgaagctggagttttttagtatcacccttgggagagcccatcaactaccatgcctcttccccaagagacacagctgtgtatatatcagtgtctcaaaaaagtgtttcctccaaactcccaccatagtaattcacccagtgtttatcaatctaaatctcttttgaatccattccttcctctctattcccattcagtctctcagttcagaccctcttcatctcttctctggccttatcccttcacccattgtcagacatttctttaaaatgtaagctgtcaatttcttgctgaaatttttccagtggtttcccattattacctcctggcatataatccaaatttcttaatttgctgataaagccctttacctgctagttcaatttcatctcttaccattctctgttagtgaccctctgtacttccagtctttgaatgtgaggttattctctcttgattttctatatttacacatactataaccttggcatagtttttctccccactctttcagtgcaaactcctatttgtcctttaacaccaaacttgaggaccacctcttctagaattttacctgaccacaattactttaggtatgccttttctatcaagcatgcatttattatgatacttataattccacattataattttttccatatatgttctccactagacagtgcatttcttgagggcatagactatgtattttcatacctgacctaacatatagcctagtgtctgacttaagtgttctgtcacatgaaagaataaactattctgttctgtaaattatttttcagattcgatacatttctcagactcaaggtttgccaggagaacagttgttaaatgtgggtactaaatccacaagatttttttgcaaagaaacagatatgtctcattctggttggagattaaaggtaattcattaaaaaatagaatatttagaagactagttttctaagatgcctcatatgcatggataataccttccatgtctatttacattttactatatttcttcctttttttgaattttcatttttggcccttctttattttattttatttttttcaatttttttagtttttattttttgagatggagtttctctctctcgcccaggctggagtgcagtggcgccatcttggctcactgcaacctccgcctcctgggttcaaccaattcgcctgcctcagcctcccaagtagctgggactacaggcttgcaccaccatgcccggctaatttttatatttttggtagaggcagggtttcaccatgttggccaggctggtcttgaactcctgacctcaagagaactgcccacctccgcctcccaacgtgctaggattacaggcgtgatccaccatgcctggccccgtccttctctctctctttctctttttctttttttgagacaaagtcttgctctcttgcccaggctggagcgcagtggtgtaatctcggctcactgcaacctccacctcccaggttcaagcgattctcctgccttagcctcccaagtagctgggattacaggtgcctgccaccatgcctggctaatttttgtatttttagtagagacagggtttcaccatgttggccaggctggtcttgaactcctgaccttgtgatccgcctgccttggcctcccaaagtgctgggattacaggtgtgagccactgtgcccagcccccttccttctttaagaagaaagccctcttggaataacttcactaactctctaattcagcaacataattattaattcatcttaaattaaaaaaacttttatgtgtataactacatttgtgttgtgtgtttatcttctcagttctacattattacactttataggacagggaatgaatctaaccacttactacatatcccaagtgtgctaggatctttggaggaatcagtaaatcctcaataattaacttcataaacagttattattattattgtattttttgagacagagtcttactctgttgcaaggctggagtgcagtggcgcgatcttggttcactgcaacctccgcctcccaggttcaagtgattctcctgcctcagcctcccaagtagctgggactacaggcatgcgccaccacacgcagctgatttttgtatttttagtagagacggggtttcaccatgttgaccaggatggtctcgatctcttgacctcgtgatccacccgccttggcctcccaaagtgctgggattacaagcgtgagccgccgtgcccggcctagttattttctttatggggtttgttacatttgtaatatttttcttggcctaaaccaagcacttctcattttttttttgcgtatactttaaaaaatacatttttgatagtgtctcttttgaaattactatttgccttagaatatttaatatattagactaaatgtgccaggattaaagaaatttgtaataatgtattcttttttccctttgatatatgcaataagacattggaagagcatgaggcagagacaggaatgaagtctaaagaagccagaaaatacattttcaacagtctggatgatgtagcgcatgtgagtaccatagccacatttgttcatcttacatgcttagatggtagacttgaatgccaaggggcccaaaacatgttactcagtttttaaatggctacagagtccatgctgtttttaagtttttcaaatgaaactgattctattttcaacctttcaggaactaaattgcatttgtcgttatcaaaattttaatttacctattcgttctttagtaaaaaagtttttgctttgaaaggaaaaatcctagccaacagatttccctatatttcattagaaatggatatttgtttaatttttaaaaacttcttttatgctttgaatcctatttggtacctcaacacattttgaggatttgttaatattatttgttcttctttgttttaagataattgtagttccctctcctctcctgtgttgtgatttttgttttattttttaacggtggaatttatactactctctgtgacttatttttacttgatggcttgaaattttgatttcttaggtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccagtatgttactttaagatcttttaaagtggttctaaaaaaaaataagtctgtagaaaatgactgcatcagagaaattacttttcttcattaaacacaagtaacctgagtcaaaagaggctaagctaacttgaccaagttcacatacaccagtaagtgtcagggaactagaacccaagtctgaattgcagtccagtgttccttctccaaaatgcgatactaaaaataagactgagtggttttgtttttattatacatgactttcttaccttaataaccaggcatatataaaaggaaatgctaacagttttctctttaaagtcacatttcagttttcctacactgtaggttctatcatattttgagtcgtgcaacttccattttacatttttttttccccacaacttttgctttcctttttcctctttttctcctgcattttgaagaaaaggaggtttttcatgggtcagtagatcataggtcagtagggaagaatatatactaaaattccaaaggccttaaatattacaaattctttgtgttttgtttgtttgtttgttttggagacagggtcttgctctgtcagttgcccaggctggagtgcagtggcacaatctttgctcactacaacctccgcctcacaggctcaagtgctcctcccaccacctcagcctcctgagtagctgggactacaggcatacgccaccatgcctggcaaatttttcgtagagatggggtttcaccatgtcacccaggttggtctcgaacttctgggctcaagtgatccacccaccttggcctcccaaagtgctgggactataggtgtgtgccactgcacctggccaaatcttacaaattctttgaacctcagacatattttgggagatgaagggagtaaatttaagtgacttaaaatggcttccttcagtatttaaaaagacaaaatgaagaaggcatgggaatgaatccaatatttatcattgtgaattgttcttaaaaattacgtttttctacagcccagttacattttcccctcaaacacttaaaatgtcctaatgtttttcatatacagtcactttgaaagtaacatgatagcaactctttggtactgttaatttagtggtgtggagatctcgaaatttcggaaaaagtttttcgtgtaggggatcgtaaaattattgcatgctaaccaaaaaatgcttactgtggttttactgttttaagaaaaatattgcagaatatatacttttacttgctctgaaacttaatcttttctggtaagatttcctgttagaaatactattggaaataagcagattaagtgcaaattaggatttttttcttttaggaataatttttttattttgtcaatgtacctcaatttaaaactaagcttttaaaataatactgtaataccttcactttttcttttacagtgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggtaagaatgtgtagtaattaataacttagggtctttttttaatgattgctcattttacttttgatatatacagaagtttggtgtcagttgttagaatgtacagtgctgtgaggtcttactatacctgtttttaccaaatctcttaaaattccaaggtaataattggaacatatctactccgattcacttttttccattcctctcttcattctctcaatacctttcacctgcccttctatgccacaactctaccaaaagtagaggtcagtagaatcggtttttaaattttaatttcggcagcttgtttttgttctcattttctggacacattttaatagtagaattatgatcttaagaaatgtgtttgaattctatttatacagcgtgtatatttcatttagaagactgctctatataatgtgctcgttgtttcaggcattgaccacatctgctcattcagttgtgcaccatggaatacctctgcaggcaggaactgctcagtttggttgtggtgatgcttttcagcagacattgattatctgtcccccagctattcaaggtattattttatttaaattttgctttgaatctaggcatgctttattttaaaataagtttaggaatctgttcattaaatatattgtataatttttgctgcatttagtgctacatttgaatttaagctgttcaggccaagtgtggtgtttcacgcctgtaatcccagcactttgggaggctgaggtaggcggatcacttgaggccaggagtttgagaccagcctggccaacatggtgaaacctcagctttcctaaaaatacaaaaaattagctgggtatggtggtgcgtgcctgtagtcccagctactcgggaggctgaagctgggaaatggaggttgaagctggaaagtggaggttgcagagagccgagattgcgccactgcgctctagcctgggcgacagagtgagactctgtctcaaaaaaaaaaaaaaaaaaaaaaaaatttaagctgttcaataagccttcagaccagtgacactcatttcttgactggaactccgttacagtcatcactaacaaaatgggtcatatgataactgtatttcctgtagagtctagcatgataaaataccttaataggaatgaatgaacttgggctacaggttggcctatactgggtatcactgttttagacatttagctaccaatactaaacataaaagtgactgagagctcagttatttaaaattttggtcaaaagagttttgtcccaaaatattatagtctttattgatagcttaggtaataaataatggattgatttcaattacattaatgtcccttcattaaataaaaatagccaattaaatcctcaagcggaatgggtgacagaatacctttgaagaggctatacattcttttttttttttttttttgagacagagtttcactcttgttgcccaggcaggagtgcaatggcactatctcggcgcactgcaacctgcagcctccgcctcccgggttcaagcaattctgccttagcctcccgagtagctgggaagctgggattacaggcatgcgccaccacgcctggctaattttgtatttttagtagagacggggtttttccatgttggtcttgaactcctgacctcaggtgatccacctgcctcggcctcccaaaatgttgggattacaggggtgagccaccatacctggctggctatacattcttaaactaggaaatctcttagtggtttctagggaatcatagcagcaaacctcactactggaataactggactaaaaccctacttcctaagtcctttcctgggattttgtccttgctaagctttaacatctagttaatgcaagaggtcaattacagatggggccctaaaccaacatgtccaacttagtggtgatactgtacagagtaaatgaaaacagttggtgctgagtcaggacacctggaatctaattctgtttctcctgtttgctgtatcattgtaggctagcctgtttacttatttcagccttagtagaaggaaatagcctgaatagataatatattggccatttctaactctaatatattttgattctgaaggattatttgattttgtgtgtgtgtgtgtgtgtgtgtgtgtgtgtgtgtgtgtgtgtctttttttgagatagtgtcttgctctgttgcccaggctagagtgtggtagcacgatcttggctcactgcacctccacctcctgagttcaggtgattctcatgcctcagcctcccaagtagctggggttacaggtatgcaccaccactcctggctaatttttgtatttttagtatgtacagggtttcaccatgttggccaggctggtctcgaactcctgacctcaagtgatctgcctgcctcagcctctcatagtgctgggattacagtcattagccgctgcgcccagcctctgattttttaattttaagcattcaagcaactctaaaactttttttattttaatatttacctcagtaccaaataaaaaaccaagaatatgtttgttgacttgatttgctggtaataagagatgtgaaaacaggtcagatctttagttactgttgttctatcggggtagctttattttcattgtttttatatattggattttcaagtaatgtatcattgggagaaggatttatatcatagaaagtataataaaagggcaacttagatggttgattctgaaggtgaaattgtggcccagtggccacagtggtggtctgtgagtatctgtaacagtgacatttttattactttctggtaataaaaatgcccacatcattgtagtgttaggaataatagatgctaacaatataatgctgttgtgtttttcagttttttcccccaagtgtttattataggaatttcaaacatacagaaaaattgaaagaataatatgttttctaccctagattcaacaggtgttactattttaccatatttgcattatcaatctacctacctacctacagtgcacatacatgtactatttgaaattaaatggtagattttatgacactacttctaaatacttcagcatgcaagattgctgtttaaaaattttttttaatcagttattacttgtgttatcttgacaaatgcattttcacttaaatttataatctgtactaacaagtaggttatttggttctagtaatccctcccatgtaccaaaatcagtttgagggtcaccacttatactgtggtatatttcacgaagatttagaatagcaggttttttttcagagcctagcttctttggcaaaaacttaaagagacttcggagacacatttctaaacagcattgagcataattcttaaaacatttcaatgaggttagaaaaatcttttatctttttatatggcttataattgatgaaaagttagaaacctttctgtacataaagtaacaactatatcagtggtttacaatatgggataatcgaaggaaaagaattactgtcacagactcattaacccattaaatgtcatgaacagcacttttgaattagaattactagtgagaagaagcacaatatgttttagcttttataacaggtgcagttgcagcaacaggccaggcaggctctgtaagtatgttgtttctcttcttagtagagtgtctgccttagaaatgaaagcactccctctacagtcttagtatctaacgggtagatgttatatagaaattgtaatgtagaaaatttcagcattgggcttcttgcccctccccttcatttaccctttcccttcagaatgtgtcaatccatttacaagaaacatttaaaaataattattgggcagctatttgagatagtaattatggtaccattgtggtttgtattttaaaataaactttatccctttgacttaaaaattttactttggagctatcatgtttaagtaatgcatttaatatattttagatattataatatgtaggtataggtatataaatactatatccataagactgtgcttattttaaaaagtcagtttatttttaaaaatcagctaagcttttatttaacatctgagtgttttatatattaaacaagcttttaaaattatttagtgacctgaaaagttaggtattcatcccctctagatgacaactactatattagagtaaaatatattccagcaaaattctcttctgttatactaaaataatattcataagctttttatgtcttgtcttccaagtattaaagcaaatataatcaaagataaagtttcagctaacctaataactaactatacaaaaattaagatcttatcccactgttgaatctgatcaaaaattagatctcctgtggagagggtatataggagaattcttctcatcttaaggcattgcttgtggagagaatttacagacaatgagatttttgttcagatttggaaatttgctctctctgttcatccttgtcaaagtgaagagatttttttttttcttgaagagattgtctatatattgcaatatatctacactgcctgggtgtgcttatattccatgtcttggagaattggatgatcaagacaggctttttagcaggagtaagaagatttttattaaacttgactcatacctggctctttaggtggagcacagagagtagaataccctggtatggtagtaaggtaacagtctcagtgaagaaaataaacaggctgaaatggacattctctttaggattaacacttacatctgtgaaatagaaaatttgaggttgttttacaatagagaaagaaaacaattgtagtatttttctcttatgcctgaagagaaacactcaacatcacatttatccccaaattgattatattatatttaaataatttgcaagcccatgttgaaagtaactgctgcaataaactggaattatgaagtgctgaaatgattttcattaatgtactttctgatcttcggggatgtccctaaaatcttgtcaaaactttaagctggaatgtgatactactttgctctctcagagttcaatattataagacttaatatttgcaaggtgctttgcagtgaaaacagctatattaacattatagtaacattaacaggattaacatgtctggtaatcctgctttctaattttcctagtgggcaagcaaaatggtagcatgtttgttctggagtttcagctctctgctaagaatactagtcaattaagccacattgcggaaaccttagttttatcatcaaattggtaaataggttagttttgcctttcctttggaggttgaaatgagtgtgccatcccggaattttcatccattatgtgaaccattatgtccattaaattatgaagttgtgatgtatttctgttttggtgacaggagcataagattctatcacagttttaaagaagaagataactaagcatagctaaaagtttgtatgaaaagaagaaccttcacctgctaggttgtcagcatactaagccagattcttctttccatgttctttatcatggtgactgaactatttaaaaaggaaaataaagcttcaatagcaaacttcggagatgagaagtttcaagaaaattaaatcgttcaactttgtagtatgcattttgaaacagaaagggaagctttatgataatttttggaatgatgtatatcacaaagtagacaagaagtacctcattttgctactagattgctctgttagtgttatgaaaattttatgcagagaatggtatcataactccacaatcagggctgggtgtggtggctcatgcctgtgataccagaaatttgggaggccgaggtaggaggatctcttgagcccaggagtgcaagaccagcctgagcaacatagaccctgtctctaccaaaaattaaagagattagctgggcatggtatatgcctgtggtcccagctgctcaagaggttgaggtgggaggatccacttgagtccaggaggttgaggccacagtatggatcatgccactgtgctccagtctgggcaacagagcgaggccctgtctcaaaaaaaaaaaaaatctgtcagaatctaagcaattcttgacatttaaaataattgtataagttaaataagaggaagattttttcttttatttgataactattctgtttcacaggtattcctgcaacacatggtaaacccaccagttattcaataagggtagataatacagttccacttgtaactcaggccccagctgtgcagccactacagatccgaccaggagttctttctcaggttggtaataattcattctttgccatatatcagcttgtgcttttgggaaatagtgaaaatgacctggatagggatttaatccattttgtaggttatggactttaatgtttataattgttagctgttacttttagatagttttgagtttaagatatggtaaagttcaattacttataacttgttattttctattgttttgctttgctgcaagcagacgtggtctggtagaacacagcagatgctggtgcctgcctggcaacaggtgacacccctggctcctgctactactacactaacttctgagagtgtggctggttcacacaggcttggagactgggggtaagctgaaaacaaaagtactttgtgaatagtttgcagactagatcttgattaaagaaagatcttgattaaaaacattgttctgaacttctccctaggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacaggttggtattggtgctttagctttcctctgcattttgagaatcttttaaatgaattttgcatgtactctaaagggtcactctgttgtattcaaaatgacctcttttatagctttgttacaaacactaagccagctcccttctcaatttctcagaggtattttggtaaaactaatggaatgggagccaggaagagaggaaataaatgctttcagttggtaagattgtctttattgcccttttgatttattatctacctgtaatgtagcaattgtggacattcagatagcacatttaccaaaaagcaactatttaaatgtatgtaaatgcagtctacatggatatttctagagctattttatatttcacaaaaactcaagatctgttagtgtgttatattcatgaactcgaacaagtgaaggttctcattttctggtttaacaagataccttagacaattgattatacatattttgattatagaaattataaattattcctttggttgcaggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagagtaagtgccaaacgctgcatcctcaaaggatatagatggcatcctttggtgtgccgaaaaacaactttctgtgacttatttcttgtttgtcaatgtactctggagtaaaacctttaaattagataacccagttctagacagggaactttctaaataacatttagcacgattattatagcattttccctgtatctgtaagctttaactttttgtccatgtaggtcattcttaacagtttcatatccttaattaaagaatataaattttggctatttggagagtatcttcttgtatttgactcatgtttttcccttttctcttccactagatgtaaaggtagtctagattgtgaagcttgccagagcactttgaatattgatcggatgtgttcattaagtagtcctgatagtactctgagtaccagctcctcagggcagtccagcccatccccctgcaagagaccgaataggtaaaagaatctcaatagtagtgtgtaataaatagtaagtctactaaaaagcctacgatttctttctgttgtttaataagtacctgccagtttaccacagtgacttctatcttgaacacaatttttgaactagatcagtttttataaacacaggtttgtttgtttgtttgtttgtttttgagacagggtcttgctttgttgcccaggctggaatgcagtggcatgatctcggctcacagcaacctctgcctcccaggctcaagcaatcctcttgccttagcctcttgagtagctgggaccacaggtgcgcacagcgatgctcggctaatttttaagttttttttgtagagatgggatcttgccctgttgcacaggctggtcttgaactcctgggctcaaccagtgctcccaccttggcctcccaaagtgctgggattacaggcatgagccaccatacctaactaaataatctttttttgctgaggggcgggtgggaggagatgaagtgtggctctgtcacctaggctggagtgcaatggtgtgatcttggctcaccgcagcctccgcctccccaggttcaagtgagtctcctgcctcagcctcccatgtagctgggactacaggaacctgccaccacacctggctaattttttgtatttttagtagagatggggtttcaccaggacatgctggtcttgaactccttacctcaggtgatctgcctgcctcagcctcccaaaatgctaggattacaggcgtgagccaccacatccagccaaataatctatttttgaaaggataaaaaagccacattcttaatttcagccccacagactactattgtaacttaaatttggaataaaaacatatactttagcaaaattaaaaaggaatgttttgcataatgaagtactcactggcccactgtctacaggacatccactatgatttttttctcccattggtgactgatttgcatggttttatccatattaacctggcttacccatcctttggccagcgacatgtaccactgctaagatagtaagcttgtcctaagcagaatgatttactaacgcattgagagataagccacagtctaggcacagtggccaacacttgtaatcccagcactttgggaggccaaggcaggaggatcacttgaggccaagagttcgagaccagcctggacaacatagtgagaccccgcctctaccaaaaattaaaaaaaaaaaaaaaagcaggatgtggtgttgcatgcctgtagtgctagctactcaggaggctgaggcaggaggattatttgagccctgtaatttgaggctgcagtgagctatgatcacaccactgcactatagcctgggcaacagagtaagaccctatctcttagaaaggaaggaaggaaggaggggaaggaaagaaagaaataaagtcttattttagtggcaacaaacatttgaaaaattttaagttttaattttacacatctttttccttaggaaatatgatattgcattcttatagccaaagctctatggaaaatataaggaaattttaatgtatcttcttaaaagttgcttataatatggtttgaaaattgataatgtacataactatacattcacatgtaaaatatatataaacaaatatacgtataagatatataaataaaaatatgtataaaaagagatgcttcaaattcgtaagtaagtatggaatgagtggttgaaacagacaataaatgctgtagaaatcccaaggagagagagattgtcagggcccaagagtgtcaggaagagatgagaaatatggggctctgtctaggccttcagaggtgtggggatacctttcagatacctggttaggtacaaggacccaaattaccagcagaggcacatatcctgatgttagaatttaatttgaaatagccaagtcacatacatatatgtttgtatatttcatttaaattatccagagcagtgcctcttttgtcatgtcttgatgaaattatctggaatttataaagaggaattttatgagctgctactaaggatcaaatgggaagggaaagaagaaaaaaaaaatgccaaaatgatgttcctgaaatggaacagaattaggtttggcagttggaacagagaattaatttaagggtctagaaattttatgaaaaagtgctattggacaaggaaaaaggtgtaattatatataaaataactgaataatgttctcatcagttcactggagcctgaatattacttaacattagatttaatgttggaaaaaaatatcactcataaaaaatgctttctttttgtagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacaggtaagttgagtcctcccatttctctggttgtcctttaaatacggtcttaatttaggaaaatctgagaatgcagttgccaaagtcatctctgaattttgacttgaccctgccttatgtattgtacagaggaaatcttctagtattatccagtgcttggaaaccatgacctctcctttgattttatttaattttaaggctctcaaatcactattgtgtaaaatatctaaagactttgctaattttttatttgaaaaggaaaaagcataaactctttaatattttattcgtcgccagattctatatgccagccattaataaaaggacgatctgcccctggaagattaaaccagccttctgcagtgggtactcgtcagcaaaaattgacatcagcattccagcagcagcatttgaacttcagtcaggtatgttcatttgtggatatgtaggagtctgtgggattcaaatttagcagttgtttttcacgtggaggagaaagcttctgaaactgtatgtagtgttaatgaatttttcccttctcattatcccaagtggctaaagagtaactggcttaataataggataattaagcaaattatccatagaacttgtagcctttttcagaaagattaagtccttaggttctcttacataatattaacagagtgtgtctgttatctcagaacatcattaaccttcctgaatactttccatcttattcaacactatatttggcggttgtgtttcagttgggaaaagaaaagatcacagatactggagttggacggggattcaaatcttggttttgccatgtactatatatatatattaccttggccaggtcttttcaacaaatctgatttggagcacagttaatgggaatcgtaattatatcatgggttgttttagaagtaaataacattgtgtatgtaaatgttagctttacatataagaagtgctccacaaatggtagctgttagtagtgatggggatagtaataggtagtactagcagcagtaatagcagtgtttatattataataatatgtagtaataaatactaaaatgttaatactaatatatatggaattgatatttttctctcctctagttattcttagtataagttagttctgagagatccactatgagttatcaatcacaaagggtatattgtaatttccctttctttctttccttttatcttttaaggtatgttattcagtcattttttttttttctttgtggataggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtgaaaaacagtatattggggaagctcaatgatacaaacatttgattaaaaataaaaacatggtatttaatattagccatggcacaagaaaattatttttgaatcatgtagacttgggtgcaatttaaacaactttgagctttaaaaactcacttttgatgtgttttgcacatttggtataacttgtctttggtcatgttatcttcttatgtagtaactctagacaggtgacttatgggagcagaagtccagttttgctcctgctattttttataaattgccttctaactagtgcaagacacgtctacatttgggaagccattctgtgtacagacttagagcaacagatgcacatatgtcagaattacagcatacaagtgaattgtattatccgtgtcttagtgtataaatgttgggtcacttacctaagaaattgagctattgttctttacatttgcatgtgtcttttgcatgggcaaaatgttgcctagactttgctcttaaatgttgttctaataatctcagctgcattgtaaaccgttcctacacatagtgccttaaatatttgaggttgttaatgttattacctatatataaatgttgaggactgcagcacttaaaattcagacctactatttagtttccttttgatagcgtaatgttcatttttgtttttgtgtggtatgatttcaggtagtagctgtttttttccttattaagagggcagcatgtttgctatagctgaattctgctgtctgatttttcagaatgatctagcttcaagaaaagcaagcagttagtagtgcttaagaaaaattgattcagtatctaatggatagttgataactgtcacagcacagcattttatatactgttaagtgaaactgcaatacaatctaagtttattttgagagtgtttgctgtataattggacttaataaaatgtttagaggtacagtaggcatgactttgggtagataataagatgcaaaatgctcattgattcatgatgtggttttatcttagcttgggcaaaccatgcagtatttaataaatagtagcagaacttttactattgaagcttgaaaagatgtgagttctttgtgtgcaatttttgatttatgcatgtgagagggtttttttttttttttaagtatttttacattgcagtacttgttttgcttgttggtgatgtttgcttatttaatacattccgtcagggacagaaattacatgcttttttttctttctaggaagtgtgttgagttccccccttccccgacatttttttcttttttgggtggtggtgatggtagtggttatgtctgtttaaatgaagttgcttttacagcaccaaagacttaatcatccatttcctatataaaggtagctactttttgcatagacctcaagtatattgtagtgtaaaggtggaatttaaggaaaggtattaaattgaggctgtgttttagcttacaggcaagtaataaattgtatcatttatcttgaatgtatcatagataagctgctatataacgattgccacttcagatagctgtgaaattaggtgattaactagttgttatttagccttctaatttctgtataagtctaattacatgaatagaaattggggttttgattttttactttgcttttctgtttggagtgtcattgtaactactgtattgtaaatggtggaaaataattgcatttgttactttggggtgtgttatttgcatcagtattttatctctattaatgtttgtgctcatcactgcatattaaaaaaacttggatgtatcagtgtaacttaattttttattttcatactggcattgtagacacttgagaaagctgtatcttgcaggcttgacttaacttttttccttaaaaatctggaatataatcttacagcatttactggaataaacagtacaaagcattggagtgtaaaactctagatgttttggatttacagcgtttctttgataaatgaattgtataccactagtacagctctagtacagcgttcacaataagctaataatggataagttttcttcactccattaa

SEQ ID NO: 15333 - DNA, 51807 bp, Human
  misc_feature (1)...(51807): n = A,T,C or G
cttggtgtttcctctacctggaaaattcctcctccaaggtagctgcttagccttcttcctcacttccttcagtactagctcaaatgtcagtaaggctttccctgaccaccgttttttcttttctctaccatttcactatctgacatgtatttacttgtcttccccttacttagattgtaagctccatgtaaatatgttttgttcataatccctagcacttaagagttcccagcacacagtaaggtgcttaataaatatttgaatgaatatataacagactttgcagctaaccaggatatcttgaggtcggaggctgctgttgtttctccaggctccctcaggatgcactgttgccagtcagcgttactcattttattccctagggaacagtgggtttggtagaactctcttctaaatctctttttcatagaatttaaattataaattggtcatttactgttgtcacacaatattgcgttgctgaattttccactgattatattcattttatttcctcccagaacttggtttcttgtttttctgctcactgtccacacccactccaccccaaggctggaataattctcttggagcaaaaaaatcatctttttctttgtatttcattgaacgttctctttacagtgttaggtaaacctaaaaaaaaaggaaacaaaagtctaataattcgtaatactcaggcctactggatgtataacatcatagggtagctgaagactctttgtgaggccagagctttaggatttaaaaagccaccaaccatgaccgtgtccgacacgttctacagagaactcctaggttactgggtgattgtttggtggggaagcggcgagttgtctttttttcaaaagacgttttggggtatggagtttgctcgctctgcatacagaaggaattctagaagctgggatcgcaccacccaccccacgcaccccttacttgcagaaacctttgccccccaacccccacccccaccccaaataagggctcttcaaggggcagttgccagctccagagccagctgcttgacacctattgtccccgtttgggcgtcaaacgatttcgcctgaaggaccctagcgtcgattgctctcaaaactcaaggggcctttccttcggccttgccggggccatccccacctgcgtccaggaggcgccccacagcgccggggccgggggacggcggagaagctagcgggcggcctcttccgggcaggcgttcgcgccgggcagcccgagcggccgcgaaggcccccgctctccgcttctcccgcccctcgcgacccagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacggtgagcgccacccgggaccgagccgctgcaggggaagagggccgctgcgcccgggtgtcctttatctccggacccgctggagcttccgaggggcttgcccccaagtccccccaccccaccccggtcatttcccatgcccttctctgcccccaagccccgacctctctctttcctcccttctccggaagccggcaaaagccggccctccccggtagggaccgttgcagtggccgttggcggccggcgcggcgatgccccgcctccggcgcgagcctcggagcccccgggctggtaggccgagccggcggctccgcgggggaggggcgggtcggggggcggtgcgaggcccagccgggcgccccgctggcgggtcgcgcgcgcgcccgcgcactcttcctgccctcgaggcgcgccgcgccccctcccccacccgctcgcgtaggctaccgctcgctgcgcgttttgtcccgcgtctcgccccgtccgtctcctgactggccgctcttgtccttcctcccgctttttcttctctctccttgcggtctgaagatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaaggtgccaggagttggcggggaagggaggggtggctgcggccgggctctgcggcccctccgaccctggtcgctggagccttcgcttcttttcgtctcgggagcgttactaggtcccctcctcccaccccctggcccacacgccccgtctccacgttcagcgggagcttcgtgcccagaaaacgggctcttggaagaggcacttgtcacctgactcggacgcggcactgtaccccaggcctctttattactcttccgctgtgggtccggctttttggcctttaggagtgggacatgtgagggtgggggcctgtcgtcaggacttcactgtatggtgcccttctttccgtctctgaggcccgatttctctgacgagggcccaaaatgaagaggtccctgcgcggggggctccgggttcaaccgaccgcctcgtggagttggggcggcctgcgtcctgcagccttggggtctgtccgctcggttaccatgcactcgagacctgtcgagcgtcccctcttcttccgtaggagagaagtgtgtttagaatcttaaggtagaactgcctttccggcaggcccattttgaatgggtcttcgatttgctacccccgcgcccatgcgatgggctcccctgcgtttccctctttgtttcaattgtttaggtgtccccccgagcctcaggctcagctcaatcgcgagatgattttctgcagcgactttttgttcctaggggactgtgaaggggcgggggactgccacgatttagattcgttgggggctgggtcctggggagactggagaggatggctgggactcggggcacatggagagagcgtctaacatggcggcggctgcggggagagggaagcgctttactggagctgcattgtgagcacaaagcgaaagcagagggggagggcagagaccaggcagccgccccgactggcctccttaggcccccctctaaaaaaaaaaaaaatcgagccacacccacgattttttggattcaatatttagtccttgtagatcaaactactgaggtatatcttcatctgcaagtcagccttttgttttatgctttcatcgcaggacagtgtaaactcttgtttagaggggcgtgtgtatgtatgtagagaaaaggtctgggcagagtgaataattaaaatgagtaagatcagaggtggaaggggagaaacaaattagtcgtttgtaaaaacgaggtaattacgtctgtgactatcatgttaacttgaattttaccttataaagtaaaatgaagccttgataacttctacttgtctgcctctaggaaaacatatttataacatcttgaatttccaggaaatcattttgcagtgtttatgtggccagacacctaatagtgttacttgaggtgctgatatagtaactggctaaaacttgggctgtgggaaataagttgaagaaaactggtgatgtttaggtcttattaattttacttatatattttacattttgggagagttttaaaacatttagatttgatacttccctgtttcatcttcggtattgaaggttggaagttttacttgaatttcatggacttgggatttcttttttttcccaatcctttattttgataaatgtatgttttattataggtaattggaatagtaaatgtagttacatcaagaaagtaacaaaagtattttaagtgtaaggtagctacattcaaatgttgaatggaataagcatgcccaaggccagtatcttctgagtctgacacatgatttagtttaccctgttgggtatcttcttaaatttttttttttttgagacggagtttcgatctttttgcccaggctggagtacaatggcgcgatctcagctcactgcaacctccacctcccgggttcaagcgattctcctccctcagcctcccaagtagctgggagtacaggtgcctgccaccacgcccagctaattttttgtatttttagtagagacagggtttcaccctgttggccaggattgtctcgatctcttgacctcctgatccgcccgccttggtcttccaaagtgctgttacaggagtgagcccctgtgcccggcctctttttaaaattttaatgcagtaagcaagcctgctgatctggctgctacttgagtttttgattctttagaatttcttggaaatgtttttttctaggacagtaattgaacataaaatattaatgattgtgaacattaataatgtgttaatactaattatgaacattaatgattagtgatataaagtgtagagacattaatgactgaaagataactcctcagagaagttaatataaaggtaggtgctgattggcagccaatttagttgtgaggtggctgttagaatctagtgttcaagtacttctgaaaaaaaaatataaatctagtttataagcccctcctgaggacttgaaccatgactggtcattaaatgtgtataggtgtatgtgaattactatactctgtcatagcctaccctcaagtgattttgttattttatttttattttttgagatgaatctctgttgcccaggctggagtgcccaggctggagtgcggtaggatgatcttggcttcctgcaacctccacctcccgggttcaagtgatcctcccgcttcagcctcctaagtagctgtgattacaagtgtgcgccaccaccccaggcaatttttttttctttgagaagtctcgctcttgtccgccaggctggagtgcgacgatgtgatctcggttcactgcaacctccgcctcctgggttcaagcgattctcctgcctcggccccccgcccagagtagctggggttacaggcacctgccaccacgcccaactaatttttgtatttttagtagagacaggttttaccttgttggtcaggttggtctagaactcctgacctcaggtgatccagccgcctcggcctcccagagtgctgggattacaggtgtgagccaccatgccgggcctcccctaaagtcataaaggagaaaataatgtaattattacataggttattaactaggctaatacatactgaaagattgccgtgttaataatggagattcaacaaactgcacaaagtaacttttttttctgtcttctcagtgttttaagtggtagatagcagcaaaaaggtcaagttacagttaagtcttgagactttgataagccacagactgaactctacctacatgttaagtagttaagttggcagtattgatgttgacttaattgctattaaaactatatcttttgccctttgaaaaacccagggcatttggatttgccctaaatttaagcacatctggtttttagtttaaatcctttttatatttagatgatttacttgtgagaagacttaactgtttttaagtataagtgagcatttctaatgcactaaaataggattgctttacaaatcagttttgaattcctctttagaaacccttgtggagtaaagtgaggtactatttacaattagatttgttttgacttcagtccatttagcaacttacatttgagctttatttcaatcttgacctattcttatcggagccttctggaccaaaatgctttttttatggattttaaaatcaaatatcctggcaaaaatgactatggatatgtagtattgcttaaattaaaacagagaattgaaataattttattgtactttaaaaaacaaagttgtttatttcctaataatttgagccattaaagaaaaagctaagcatctgctcattgagaatgcatgctcttaatgttgatgaaatatgatcgtgttatgtaatgcaactaaaaggcttggtgggtttttaaattcaggcttataaagagtacatgaatgtttagcaaagagaagaaatacagctgtgataatcaagtgtaaaatccatttgcaaatcttacaggtaatattgaattgaatgattaactgcctagttttctttatcagttcattggtgctgaactgggccctaggctatgcaagatatttcaaaaccaagtcttaattttaactgaagagagacctcatttgatattattagatgtaatcagttgtgatatagaataaaggatgttttaatagatgacatttaaaattgttatattctttgtgaatataataggtttagactctagtgactttggtaggtgaaagattaactaatgatcacttgcgtaaaatgcaaaaatagcctgacagctttttaaccactaagtgaccaaaactgatagccagaagtgtagtgtttttaatactttttcctgaaggctttctgcacttcatctttgcagttagtagtattctttaaaaagaatgctgttgttgtgagggtaacatttctttctagaacgttgcagtgtgtctgtgcttagaattttcattgcagctgttgtgcagaacttatgtgttcagtgttctaaaataaaaacattcttaactattttataagtaaaatctttccttgaggctattacctgaagccttctttgacatttaagatctcttgatgtgtttgcttttccatgggttgcaagaactattcttctgcaatgcagagggcaagattattttgcattcaccttgtcatagaaaaaagctgtaatgcttaatttgtttccctttgcttgactgtgtgtgtttgtatgtgtagcactgggaagtatttaaagctgtgaattcccccaagtgataatgggtacctttttctagggtgagagtcgaagcctaagtattacattgagaatgtattgttttaacgtggccaaattagtgtactctaggatactacccatgtggcagatatttgagaatgcattttgtgtgacttacagattaagcatacaatttgccaaaattttatgtaattaatttcctagtttacatttagggctagatgaagactagtactgtttcatcttttagaaaaactaacacttttcctttagtaaaagtgttaatttttgcaatacttttgcaaaaggttaaacttatagcaattttgtcatagctataatcttacactgttataaaatttagaggatttttaatttttatttattatcattatttgagacagttttgctctcgttgcccaggctggagtgtaatggcatgacctcggctcactacaacctccccctcccaggttcaagctattctcctgccttagcctcctgagtagctgggattacaggcgcccgccaccacgcccggctaattttttatatttttagtagagatgggatttcaccatgttggccaggctggtctcaaaacgcctgacctgaagtgatccacccacttcagcctccaaagtgttgggattataggcatgagccaccatgtccggcctaagagtttttttttagagcttaaaccaccttagaatttagtccagttcattttatagaagacaaaattgagatgtttatatggaatgacttaggttggaatgggtgatttccaaaattctcgcagttttttttgaaacagaatcttgctctgtcgcccaggactggagtgcagtggtgcaatctcagctcactgcaacctctgcctcctgggttcaagtgattctcatgcctcagcctcccgagtagctgggattacaggtgcatgccaccacgcccagctaatttttgtatttttagtagagacggggttttgccatgttgaccaggctggtctcaaactcctgacctcaagtgatctgcacgccttggcctcccaaagtgctgggattacaggcgtgagccaccacacccggcctcttaaataatgttttatgggagtaattagaatttgtaatgttccacggcctaagtgtagttttcatgtttaattatgtagaatcaagtaaagccttttgcttcaaatccttagagtttttctgttttaaaaaactgaatgcaaaagaaaaatgctttccatttccttattattagacttttattaatgtctcattgttgaactttgtgtttgcattgtccgggtaatggggttctgagaatatcggtaaggtaaaatcccagtgtgtcaggtatcattgggacatccatattgtaatgaaataaacttttataaagttaaaactcttaagtttttctttatgtttagcttcctatgtacatttgtcagactctactccagcttggtatgttgtagaccggaaaaatctggaaaaagcattaccagtagagagaaataagaagtgtgacaaccttttcatccaaattactgtattccaagcttctgggtattttttggtagttggttcctttttctgggggaaatgaatggtgtgtgtgtatacagtatagaagagtgagaggagtagcagaagagaaattcatccaaagttggaactgtaaattgctttgttttagctcatttatttctttctttcactagctctactacagtgcttttgttagatagactatgagtacaaaaacgtgggtgaaagataatttactgagtagagttcaaaattcaaacttcctgaggaaaggggagggtgtgcttcttgaccatgctcagctaaagtagtttgtttcctttaacttcccctgttacctattgtctgtacacttcttgacattgttttttttttttttttgagacggagtcttgctgtgtcgcccaggctggagtgcaatggtgtggtcttggctcactgcaacctccgcctcctgggttcaagtgattctcttgcctcagcctcctgagtagctgggactacaggtgcatgccaccacacctggctaattttttgtatttttagtaaagacggggtttcgccatgttggccatgctggtcttgaactcctgaccttgtgatctgcctgcctcggcgtccaaaacttcttgacatttttatattgccttgtgttgttaaccttacatgtttttctaaattggtaataagctctttgtgggcagagactattaacattactttgctgcgctttctcacacatggtatatgctgaataagtacttggtagtttggccaaatcattacatagaaatatctgtagcttcattaacaaccctgttaaaatggattaatccatggggttagggaggaaatgctttttgcacagaactatttacttgcagtgtttttttattgaaattgatttttttcctgaagggttttttactttttacaggtgtgtagagttgatgagtaggcaagtagaagaatactttttttttttttttttttaagctgggtagcaggctgggcatggtggctcacgcctgtaatctcagcactttgggaggctgaggcaggtggatcacctgaggtcaggagttcgagaccagcctggccaacctgtgaaaccccgcctctattaaaaatatgaaaaattagctgggcatggtggcatgcagctgtagttccagctacttgggaggccgagacaggagaattgcttgaacctgggaggcagacgttgcagtgagccgagatcgcgccactgttctttagcctgggcaacagagtgatactccatctcaaaaaaaaaaaaaaaaaaaaaaagctgggtagcattagcaagatatgtgaatggtcttaagagaacacagataattcttattattagaaccattgtacattattggaaatttcattgcattctcctcaatactgttctaaaaatattttaattttaattttttagagacagggtctcactatcacccaggctggagttcagcagggcaatcatagctcattccaaccttgaactcttagccttaagcgatcctcttgtctcagcctcccaaagtgttgggattacagggttgacccactgtgcctggcccccctcaatactgttatctaaacatagaaataactgaaatatattttagtcattaaaaaaccctttgggcttacactttgagttacattgaacttctttttacattgtggacaggaaagatagtaagcaaaagtttcctcaatttttaaaaggacgacggtagaaagaacacattgcaatctatagatgatccatggcagctatcttcaaatgctgaaagcttgctcatgtagcaggagtctgtgctgttttagaaaacgaaaaagtattaaaacagtgatggtggggatgtaatttttttacatttaactcccaaggaatgtattaatataaataagttgtacagaattatgctaaggaatagcttggttaaagcaactaatattttgaaagatgccctttaagattatttatggtaatttgcttttcaaatctagaagctttagactttttaagaatatagttcaaagtaggtgatgctggaacttgttaacatttctttttcctactagagtcagctgcttcaattcactcagacttacctgcataattataaccttggacaaggaataaaggtttttacaggattggcttttatcttttttaaaaaattggacaaacggcttgtgaaactaaactcctggatacttaacctgcttgaaaaattatcttacaatggaaccttaggtaacatcctttttttttttttttttttttttgagatggagttttgcttttgttgcccaggctggagtacaatggcgcaatctcagctcactgcaacctctgcctcccaggttcaagtgattctcctgcctaagcctcccaagtagctggtattataggcaaccaccaccgcacccggctaattttctgtatttttagtagagaccaggtttcatcatgttgcccaggctggtctcaaactcctgacctcaggagattcgtccactttggcctcccaaagtgttgagattacaggcatgagccactgcacctggcctaggttagcattcttatgccattcttagcgttcagaaatccagcattcctgacaggtgttcattcagcctctgctttaaccagtcttccagggcctggtagagtgctcgtttctcaatgaaaatttgtttcattggtgtgccactctttaagttcttggtggtagaagtatatccttaccggccgggcacaatggctcatgcctgtaatcctaacacttttgggaggctgaggcgggcagatcacctgatgtcaggagttggagatcagcctggccaacatggtgaaaccccgtctctactaaaaatacaaaaattagccgtgcgtagtggcttatgcctgtaatcccagttacctgggagtctgaggcaggagaatcgctggaacctgggaggcagaggctgcatgagccaagatcgcaccactacactccagcatgggtgacacagcgagagtctgtctcaaaaaaaaaaaaaaaaaaaagtatatccttaccaccactgtttaatagtctttgttttctggaacagcatagactcccgctacatgagcatgctttcaacatttgaagaaagctgccatggatcagctatggattgtagtgtatgttctttctaccctgcttttaaaaattgaggaaacttttgcttactatcttttttgtcttctggggatttcactagctaacaatactcagttgaatttgtggagggcaaataggagacagtcagctgcctaccattgtgggcaaagtcaaaactcgtaattgtctaagtgaagaacagagaatgtggggattggggacttgaaataatacctggaaaaactggtaaagattggaccgggcgcggtggctcacgcctgtaatcccagcactttgggaggccgaggcgggcggatcacgaggtcaggagatcaagaccatcttggctaacacagtgaaaccccgtctctactaaaaataaaaaaaattagccgggcgtggtggtgggcgcctgtagtcccagctactcgggaggctgaggcaggagaatggcgtgaacctaggaggcagagcttgcagtgagctgagatcacgccactgcactccagcctgggcgacagagcaaaactccgtctcaaaaaaaaaaaaaaaaaggaaaactgctaaagattatggaaagttgagaggaaaagaaatattttgtttttgcaaaagttggtacagtactctagaagtgatttatttggcctggatacataaagtatagctaggtgctcttaactactttggttattttaggcttcatttttaagtattccctctcagtttagacatctccttatttgagaataggagttacgaagttttcctggaaagccaagttagtttttttcagatgtttcctcctaatcttccttctgactatttaaaattgtctagttgaagaatttttagggttttttggagtttatcatctctctttgctatttatttttaattgcataattaaaaatttcttcttaaattttttatttgtggaatttgttggctataacaataaagaagcaaagcccaggaggacatctatcatggatatccctcttctggcaccctaatggcacctactgaacttaatttaaaaaatccatttcaagaaagtaactttggtggtgatgaaaaacttcttgggaagaatggaagatctagatgtattgcaattcagcacaacataataatctgattggagaaaggaagaaaacagcagcagcagaggcagagctggaatgtagcaacagctggaatccagaatgacattctaagggggagggttgttaaggcacaaatgatttttctgggatttaagaccttacttaggtaagttatttaactgtgtctttcaatttacagttaggtgaaatatgattgatagtaatgcctccctgataggtttagctaccttttaaatttgaatgtctgttacatagtgaatactgtcaactattaaaagcagtaaagaaacaggatatagagcgagactggatagcacttgttgggataattatttcccagtaccacatgactctgacatctgctgggtgtggtcacacctctcccatgattcccccttaaagactctgggtaatctgggaaatggcctgatttttatcttgctcatatgtgtgctgtaaatggatttttaatacacttaggatactcagctgaaaaggaactctaaattgaatttcaagttagaaaggatctaagagggcaggtgtgtgttatcaacattgtaacgtagtaggctttctgatgaagatagtttttttttgagatggagtttcgcccttgttgcccaggctggagtgcaatggtgtgatctcagctcaccgctgcctcaccctccctagtagctgtgtttacaggcatgtgccaccatgcctggctaattttgtatttttagtagagacggggtttctccatgttggtcaggctggtcttgaactcctgacctcaggtgatccacctgtctcggcctcccagagtgctgggattacaggtgtgagccaccgcgcctggcctgaagatacatttttatgctaggaaaatggtttcattctctaggaaaaatacttaatatcttattttatttgtttcatgagtagctgaccaatttattgttacctcttctgctgctgttagccatgttccagcccaggaaagaataaagctgtgtctgtctggagccctttattactcctatcttaccattctgttcttagtataatgttggatctgtcaatgtgacaagctattccttgtatattcgcttagttcatgctgtaaattttaacaccagtggacaaattttctagttggactttaatgtaaaccatttgaataggaagtgacaataggaatgaagccacttaagatggcatcatttttctcttgagtagtctgtgctttcaaagattaggcaaattgtatttggagaagtgcagataccatatccttttccttatcatggaaggccacttaaggagtaagctgagattgcaagctatagtaatctttatagctatagtaatagctactttcattttgaaaagtaaaaaattagaccaattgtcgtaagaggctttctgtttatagtgtacattttggtatttaccacttagtttaacttctgaggtgtcagctaagaatgcaagatttaacaaaagtactacttacaaatggcagtggtaagcctttgttttttctctctcacctctccttctcaaaggtggtaacccctaagtgttcagatcataaacgagtgttctctttatgaaatagttactaggttagattcgtaaactggtctagaaatccagccacagttcaagttttctgggttgtttaaagtttcaactttaaagtttattaaacaacttacttccaaattaaagctgctgtataatggtttttttttttttttttttttttgagatggagtctcgctctgttgcccaggctggagtgcaggggcgctatctcggctcactgcaagctccacctcccgggttctcacctttctcctgcctcagcctcctgagtagctgggactacaggtccccgccaccacgcccgactaatttttttttgtatttttagtagagacagggtttcaccttgttagccaggatggtctcgatctcccgacctcgtgatctgcccgcctcagcctcccaaagtgctgggattacaggcgtgagccactgcacccggccccgtataatggtttttaaggtcactaatcataccatatgtttgattcagaataatttatttccaggttctactgggctattacaagttaattacaatgtatttgaacgagatgagtgtttctcaaacttaagcatgcatcagaatcacccagaagactcaataccaactacaaattgctgggttcccccagccaccactgagtttctgattcagtaggtctggggtagtgcctgagaatttgtgtttctaacaaggtgccagttgatgctgatgttgctggtttggggcctacagttttaaaaatcactgacgtaaaccaacatagggtctctgctctgcagagatctgattatatataatagtgaaacaaagtccttcccagctcagattccatggtgataaagttctttgtatacctcaatagctgagagatcaggaaatcctatattttactgataagggaaaaactagtgccttttaattaagtttttattgtcatcctgcagttttcttaataagttttggtatttcctcttatgagtgctgtttcttagaaactttgatcagacttaggatcctgctttcctgaagcttaggcaaggacaggggataggatatttataatagtagtgtagaaaatgttaacagccatggaagaacatgtgtaatgctatgatgaaactttctttttttattgtggttagaaaaatgttatatggatgacctgtagtttcttttgatctcactcttggtcaggctggagtgtgatagcgtgatcacacgttgaggctactcactgcagcctcaacctccccagactcagtgatcctcctacctgcacctcctgggactgcaggtgcgcgccaccaggcccggctactttttgtattttttgcagagacagggttttgccatgttgcctgggctggtcttgaactcctactcttgagctcagatggtttcctcaccttggcctgtcaaagtgctaaagtgctaggattacaggtgtgagccactgtgctcggccaagacctgtagtttctgtacctttttaatttatttttatttatttatttatttatttattttgagacagattctcactctgtcacccaggctggagtgcagtggcacgatcttggctctctgcaacctctgccacctgggttcaagcagttctcctgcctcagcttcccgagtagctgggattacaggtggccgcctccatacccggctcatttttgtatttttagtagagacggggtttcaccgtattggccaggctggtctcgaactcctgaccttgtgatccgcctgcctcagcctcccgaagtgctggaattacaggcgtgagccactgtgcctggccaccttttttatttatttatttttttgagacggagtctcactctgttgtccaggctggagtgcagtggcagtggcatgatcttggctcactgcaacctccacctcctgcctcagcctcccgagtagctgggactacaagcatatgccaccatgcctggctaatttttgtattttttttttttcagtagagttagggtttcaccatgttggccaggctggtctccagctcttgaccttgtgatccacccgcctcagcctcccgaagtgctagcattacaggcgtgagccatcacacccagcattttttttttttttttttaagacagtcttactctgtttcccgggctggaatgcagtgacacaatctcgactcagtgtagtctccacctcctgggttcaagtgattctcgtgcctcagcctcctgagtagctgggattacaggttcatgccaccacgcccagctaatttttgtatttttagtagagacgagattttgtcatgttgaccaagatggtcttgaactcctgacctcaagtgatctgcctgccttggcctcccaaagtgttgggattacaggtgtgagccatggcgtcgggacctgtacctttgatttactacatttttttgactgggcaattcagttcgctgggtataaggaactgtggtctgctctttgaaaattctgtaaaagagtcttgagattgttgagttatgatttacatacttatttccttacagtaaactcatcagttcttcaccttttaaaaatctcagttattggattgaaacatgagaaatatgttaatagtaatactaaatcagaataaataggcatgtgagctttaataaaatgcacagttgttttttttttttaatttttattttattggccaagatactgtgctgtcacccaggctggagagcagtcgtgcacatcacgacttccgacttgtggtctcgtgatcatcctgtctcagcctcccaagtagctaggaccataggcactaagttaaaaaatttccacgcctcggtaatttttaaattttttgtagagacaggttctcactatgttgtccaggctggtcttgaactcctggcctcaagtgatccttctgccttggcctcccaaagtgctgggattgcaggcctgagcaaccatgcctggccataatgtgtagatctttattttggctatgcagagttctttttgcatactttcttttgtcataatgttccatgaagatgtgtaccatgaagctgagtttcacatactggctgtttcccttttcatttcccctttaaccttgttccagttattgccgtgtaacagattaatccaaaatttaagggattaaaaccatgattttcttatgcacaaagattctgcctgtcagggattcagacagggcacacaggagttttgatgtttctgttcgatgacactgggggcctcgtgggaagactaagacttgttcattcatatgtttgttgcttggactaaaatgagtggaaccacagggattgctgatcagaagcaagaggcctttcttcatggcatggcttcctcatcatgtggcagtctcagagttactgtatttgtatgatggctgaaggctccaaatacaaggtgtttggatcaccagcaaacaaggcagagatagattgcttttatgactcagccttggaaatcatacagcatcacttatacagtactcttggttgaagctcactcaagtacaatggcaggggaagtagactagttgttaatggagtagtgccaaggtcacattttagaacagtatgtgagactgcatgcagattttgtagctatctttggaaaatgtaatctgcgatagctctcggtttggatgaattctaaatttgttattgtgtagaaaattggaggttttctactctaggatagcttgtcctactataggatagtataggttcataattaaggattgttattggtgagagtcctaacaatgtactgaagtctgtcaattttagtatcttttctgttgcgtggaattcttattgttttcattaaacaaactatatgttcattgcacagtagttaagtgtataaaacaaagcaaaaggaacacagctctggctataattttaccactcaggtaccattcttacctttttcattgtttatctttttatatttattttcatcgctacacaaacattttttaggagtttgattctacctccattttggttagatatacaaactctaccccatgagggatgtatggtgtatttctagatttagcaacaattttcttgaaaaatgtacaatactatagaaaaatgaagatagtaaataccaggtataagttaataacagtgtttcttttgttcagtaataatgaactgtgtactagcactgaactttaggccctcctatttgcgtattttctgtttgtatatttttaaatagaggaattgtgattataatattattattttggaatatcctaaatcataaattcaaaacttatttagttttttttttttttttttaagatggagtctcgctttgtcccaggctggagtgcagtggcatgatctcagctctctgcaacctctgcctcccgggttcaagcgattctcctgcctcagccttctgagtagctgggattacaagtgcgcgccaccatgcctggctaatttttgtatttttggtagagacggggtttcacagtgttggccaggctggtcttgaactcatgaccttgttatctgccgacgttggcctcccaaaatgctgggattacaggtgtgagccaccgggcctggtctagttttttatttcttaaaaatagcctaccctttaagcaaatagaattttttattttaaaaatttttagcttcccaagcttatgagtcttcccttttcttcccttttaaaaaagagaatgaactatctgttgatcctcagagtattttgtgaggtaattggacacatcttctgcacctggggtcaggtctgtcatatcagtgtaaaaaaaaatttttttccctcaaatcagtagactgaaattttatacctgtttatttggaggcttatagatggtgtgaaatagttcatctaataataaaattgggtactattaaaagcctttaatgtcttagtgattatcttggttttatttacctccagtgttaggaaggaattgtggtagggttttcaatttggggtagaatggctaggcaagttgacatttgtttatggtacaaagaaaatagatcatttgacctaaaaaaaaaaaaaaaagaaaaaacaaaacttattaccattgcttttaaactggcttctgtggtttctgaatgccctttattagaatttaactttgtactttgtttcacaattttattattggtaagggggtaaggaactatgtatgttcataatttattgggattaagtgttgtcctgttaatttagatttatcctcattcactgtcctctgacctttacaataataatagtttgtgactctgttgcattacctgaatatctgtggggtcttacttaatagtagcctgggaaacctgcaaagttttaatcttagcaagaaaatgggatcttaaaccagatgttagttttctgtcctcacccttgaactaacaaagcaaagctgttgacttgtgtattagtgaggtggtagctatcttgttcaagataaatggatgaagtacattaaagacaatatgcccatgagtttattcagaaaaaaaatactttttttccccttggggtggggagcagcatctcacgctgtcgcctaggctggagttttggcattatttcagctaactgcagccttcacctccagggttcaagtgattctcccacctcaacctcccaagtacctgggactacagtctcgtaccaccatacccagctaatttttgtgttttttggtagagatggggtttcatcatgttggccaggctggtcttaatctcctgacctcaaatgatccacccaccttggccttccagaatgctgggattacaggcaggagccaccgtgcctggcccgaaaaaatactcttttttttttggatgcaaaatttcactcttgttgcccaggctggagtgcaatggtgcgatctcggctcaccgcagcctctgcctcttgggttcaagtgattctcccgcctcagcctcctgagtagctgggattacaggcatgcaccaccatgcccagctgattttgtatttttagtagagacgaggtttctccatgttggtcaggctggtctcgagctcctgacctcaggtgatccgcccaccttggcctcccaaagtgctgggattacaggtgtgagccaccgtgttcagcctaaaaatactcttatatcacctagtcacatgaattctttggggagagggagaggcaaaaatttaacttgataaatgtctgatatgctcacttgggtataagcaggatcctaaccaaattgtggcccttacccatgtgggtaggagccatatgcctagtccatctaatactctttcttgattaagctaaagaatgaataatgttgtgccattggtttacagtacagcctttgatatcattcagcaatggttggagtatatctaaaaagttttatgtacttaggctgggcgcggtggctcatgcctgtaatcctaacacttggggaggccgaggcaggtggatcacctgaggtcaggagtttgagatcagcctggccacatggtgaaaccctgtctctacaaaaaatacaaaaaaattagctgggcgtggtggtgagtgcctgtaatcccagctactttaggggctgatgcagtagaatagcttgaacgtgggaggcagaggttgcattgagacaagatcgtgccattgcacgctagcctgggtgacgagcgaaactctgtctcaaaaaaaaaaaatttatgtacttaaactggaatatatcttaaaagtttatttaagtcaaaatttgagacaaacttagaggattgtgagggttttgtcaagcatgcttaagctggtatataccttcaaaacggaatgtaattcttttttttcttttaacatagggtaagcttgatgattaccaggaacgaatgaacaaaggggaaaggcttaatcaagatcagctggtaaagatgttatatttttattttagacctaatgctcactattttaaagacaaaaattaattctgtggttttttgtctttccagtaaagtttgggttctttgtcattttaggatgccgtttctaagtaccaggaagtcacaaataatttggagtttgcaaaagaattacagaggagtttcatggcactaagtcaagatgtaagtaaaagaaagtatacatatttatgaaatacttttgttgtttctttgggttttagtccttccattactattgataagctctctgcaaggtgagacagttgtatccaattatatctaagatgccttcacattctgtaaagtaaaatgtaacacctgaaagatgtcttttaaaaatactaagtttgaaattgggggcggtggcatgtgcttgtagccctggctcctcaataggttgaggccaagagttcatggctgtggtgcatatgattgttcctgtgaatagccaccgcacttcagcctgggcaacgtgataaaaccccatctctaaaaaaaaaaaaaaacattaaatttaaaaatttttttaaaaggaccaagtttgagatttgacaaccatgtatagtagctatgctaaaggtctcattggtttaaaatgttagctctgcaaatacataaaaatcagatagtcattagaaatacataaatgttttttatttatcatgttccttatgtctaatgactcacaatttaaactgtcagaaaataaagaggctcgtttatataattggtaattattctctgctttaggaaccttaaggggtatggcaaactgatgtgctcctatatcagcactcgatccaacttaatagtgggtttttgatgtgacaaaaacctttgggaataaggacaaaagttaaatgcaagcaaagtcagataatttgttgaggccagaaaattaagccatctgaataagtgtcatcttctttggagaagactaataacattgaaatacaggcatgtactccataatgatgtttcagtcaactttggaccacgtatatgatgatggtcccataacattgtaatactgtatttttactgtacctattctgtgtttcgatatataaatacctctgtgttacagttgcctacagtagtcagtacagtaacatgctgtacacatttgtagtctaggagctaatatgctataccacatagcctaggtgtgtagtagattgtactatctaggccgtgtaagtacactccatgtttgcacaatgaggaaattccctactgacatatttctcagaatgtatccttgttaagtaatgtgtgactatgtaaagttgcctctaatttgctgaaacaaaaaagtttattatatgagacaatgcagtgtagggattaagagatcagattctagaaacagactgcccagttgaatcctaattttgtgacttgactttgtagtttgaccatggatgagttacttaatttcactgttcttgtattagtcaaggttttccagagaaacagatccaataggatagaaagggggctgatgggcagaggccatcacagtgcctcggttttctaatctgtaaagtggtaataataacctcatacggttgtgcttagaacagtatttgatgcataactaatatatttcaagcacttaatcatttttgtttgtttgtcttgttttgagacagagtcttgctctgtcgcccaggctggagtgcagtgccgctatctcagctcactgcaacctccgcctcctgagtaactgggactacagacctgcgccaccatgccagtctaattttctaatttttagtagggatggggtttcaccatgtcagccaggcttgtctcaaactcctgacccctcagatgatcggcctgcctcagcctcccaaagtgttgggattacagtgtgagccaacgtgcctagcttcaattacttaatcttagaattacttattacatctgatcagggaaggaaaatctttgctgaaaacaaaaaaagtaatttaattttgtacctagtgtcttagtcaactttgtgttactataatggaatgcctgagaccggataatttatataaagaacagaaatttgtttctcacacttctggatgctgggaagtccaagatcaaggtaccagcatcttgttgcattactgtgtcctcacctggtggtagaaggcttaagggcaagagagagtgatcatactcctgcaagctctttttatagtagtattaattcattctaaatagctcccaaaaggcccaccctcccaacactattgcgttgggagggttaagtttctaacacttgaattttagggggatgcattcagaccatagcaccaaaggagagatttattccacttagcttaatgaaccctgcccaatttctttttcttgcttttttaaaatagaagcaggattgctatacagtttaatgtaacatctattttggaagttactatcactgtgtaatgaaaatacctgtatccttttttgcttctcttgtaacactggtattttcaggacctttctctgagctttaacttcattagcagagctgttatttatctttgatcctttggtatactgtacacaattattaaacatgctttttgtttagcattcaagaacttctttagcctggctccagcctaccttttcacctttttccttcttgaactgttcatttcatacagaatagctttctttcttatcttcttttgctttgttaacttcctttcatattcctgtccctcttcctgtgtttcctgcctccacctacctataaagaccttcctgggcagggtgtggttgctcacgcctctaaccccagcactttggaaggccgaggtgggtggatcacctgaggtcagaagttcgagaccagcctggccaacatagtgaaaccctgtctctgctaaaaatacaaaaattagccgggcttggcagcacacacctgtaatcccaggaggctgaggcaggagaattacttgaattcgagaagtagaggtgtcagtgagccaagatcgtgccactgcactcctgggcaacagagtgagactccatctcaaaaaacaaacaaaaaacaccttcctggctggtcatggtggctcatacctgtaatcctagtattttaaggaggctgaggtgagaggatcgcttgaggccaggagttcaagacccaagaccagccttggaaacatagaccttgcctcaaaaaactttttttaaattatttttttaaaaaagacttttttttttttcttgagacagtctcactgtttcacccaggctggagtgcagtagcatgatctcagctcactgtagctatcacttgccatttattgctaagatatttattctgcacactctgttaccattatagatttgtcttgttcttgcagccttcatcattcttcccaggtctccttccccatttttccctttagtataggtttcatatgtccctattttggttttctgtgtcttggttcatcctagtgaggcttgagaagggggaaaaggtggaaaggaaagcactactatggcttttgagaagactagccttcctctattcccaacctcatgttagatacacgggagagggagaggaataattgagtttggctgatgctttcctttcagcctttccaggaaagaaaaaaaggaatgtgggaaaaatacattcatacttagctttatctatttttctccaccagcatcatcttattcataaaaacaaattaggcactcttttcagtaagatggaataactttctgagactggcagcggattatttgggacaaaggggcccttgtgggtttttggcatttccttgtgagtcattagtagatactcagagttagaactttgggtcatttgcccatagaggagctagatcgagataagatttttattgttgctgtggttgggtttcttttttaattggcctaggcctttacatttctgtataatttctaaattcattaaatttttactttttatatgcataatgaaaaacttcagatatatatacctaactaaagaaaacaatacaatgaaactctttgtacctgtacccagcttgtatatttatcatctcatggtcaatcgtatttcatataaatccacattcatttccttgctccctttgccctctagattattttcaaacaagccccaaacacattgtttcatcagtaatagttcagtagtaaaataccttctagggaaagagctgttctgaatttttaacaattgcttaaaatagattatgtttaaaactatttgtaagtcaggaatcatccttttgtgtattgaggtcatatctcactcattgagtaaaacatgttttatttaagctggacctgaaatggattgaactaagttttatataactaattttggtgttttacttttatattgttttgcagattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggtattagtggtatttgataatagaaacttctgagtatttaagttgacaactgaaaggttattaattagctatttactattaaaaggttgaatgaacagtatgaacatgcctccattcacctgtgggacctgctggaagggaaggaaaaacctgtatgtggaaccacctgtgagtatcactgtgataactttgattttataactaggaatctttaaaaactaattttcttatgtttatagttcacttggaagaaaaaaattagtttttttttttttttggagacagagtctactctgttgcccaggttggagtgtagtagtgtgatctcagctcacagcaacctccgcctcccaggtttaagtgatttctatcacctcatcctcccaagtagctgggattacaggcatgcgccaccacgcctggctattttttgtatttttagtagagacagggtttcgccatgtaggccaggctggtctcgaactccttaccacaaatgattcacctgcctgggcctcccagagtgctgggattacaggtgtgagccactgcgcccagctagttttcctatttaaaattaatattaattgaataaaatttagaaatgtatacatagcattcatctgctatttactgtttggtttatttcttttttgtttctttgtatgtttaatctgtaatgtggaaatcagaacaccagcaacaaacaactaaaactgggaatatgatagtcctaacttcacatggtcttgtatgtaacttaactgtgtttgaggtggacagattaacattagattgactttccacagcttttggtaatagatagggactgtttgttttatggctgaagttttgtgaaacaattattgcatttcatacattctgctcatggttattgccttagtttttctttagtttgtcttagacatctgctaatttgaggatgttaatttttttctgtatttaaaatatgctgatacttggtctagttttctttgtgagctccttattctcaaacatgcaactgtgaactgatttttttaaaaagggacatttacgtttcactccttcagtataggaatttacgtttttagccttctgtgaaatcagggaatagattcttatctttgccatttataaggttgcattaggaaggtagatttttgaacataaaatgaaagtatctgtatttatgcatttttagctattggttgaaaagaaatcagattggattataagctttaatcaccaaaatggtatgagctttaattggcaaaatttagaagagtatatttgctttaaggaaatgggtgccagtccttgtctgtcctttcttcatttaagaaataattttcttggtttgttaacatttactctggtctgtatttctttgtacaatatgtgtttacccttttgcttttagttctgcaagttctatatgtataagcttgttaacttaaaaaagtagttttaggtcaagcttcatcagattttcatgagcattgttgaagagtaacaaaggtgttattaaacctttaagcttatagcttgttttggggttattttctacctaatcttgttcccacatcttaggaatgtaacatctttacaatggaaaggtactaatctttataatgggaaggtactaatatacccaaattagtgtttttatgtacatttgatttgtatctataactttttgaaaacagttttgagccaggagccgctgaagtgaaataaggaaaacatatgaagtgttcattatctaaagagttgttggtagtttattaagattaatttcccaatgcttttgatacaatatggtcctcaaagttttatttttcttcacagtgacctatcggggagtggccctactatgtatctattaataatacacaagctaagaaaattgaaagtaataactcttcatacatctccccctctgccctgcacttttaaaaaataccctggtacaccaaattctgatagtttttgtttgtttttgaatatctttcgattgtctacttttttctcttctacttttatacctttctcttgtctgacgcagttgcttaactgagtccacccctctccctctttaaaatctttagtggcttcatctcagttttattttatataagtttgtccttaacttcaaggacattcatggtctggcctttaccagtttctccagccacatctttccctatgcttgttttttattccctgtattttagccacagtggcttcctttccttttcttgtatttgacatcttttgtataggactttgtaatgctctttcttctcccttgaaacacttcttcccctctactcttctggatttcaactcttgtagcacttacctagggaaaccttttgtggcctcactctgattgggtccagtccattgtagttctgtgtagtacttttcacagatgtaagttttttgtagttgtatttgataccacttctgttagaccataagcttattgaggggatatattgtgtctttacataactttttgttttcccagtgcctagcatattgtctaatgtgtgtagtaggtgctgaataaatacttttgaatgaataaatgttaaatgtcatctttttccacctaactagtttacttaaaatacataaagttcaggccgggcatggtggctcatgcctgttaatcccagccctttgggaagccaaggtgggcatatcgcctgaggtcagaccttcactaggcaacatggtaaaaccttgcctctactgaaaatacaaaaattggctggacgtggtggtacacgcctgtaatctcagctacttgggtggctgaggaacaagaattgcttgaatctgggaggcagaggttgcagtgagctgagataacgccactgcactccagcctgggtttcagagcaagactgtatctcaaaaacaaacaaacaaaaaccccgtaaagtttaatataactacattcttcttgttccctatcattctgtaatacatttctgttcttggtgaaatgtaatctttttatgtgtatatgtgttttagtaacagttattttttaatcacaatattttatagaatgttggatcttcttcaagccaggcatcctcagataagtcttacattataattcatgttctttttcttagataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctggtgagtattaggtggatatcaactttagtttagggtcctggttttatttgattttgctacaaatttaaactatacacttacttagttttcatatatgtacactagattttatttttaaagagactttaagcatgacaaagttttttttttttttttttggagacagagtctcgctctgttgcccaggctggagtgcagtggcgtgatctcggctcactgcaagctccgcctcctgggttcacgccattctcctgcctcagcctcctgagcagctgtgactacaggcgcccgccaccacgcccggctatttttttgaatttttagtaaagacggggtttcactgtgttggccaggatggtctcgatcccttgacctcgtgatccacccgcctcggcctcccaaagtgctgagattacaggcgtgagccactgcgcccggccttgacaaaatgttaagacagattatcaagagtaattcctaccagtattcattatatttgtcttagtagtcatttgtcttactagtcttgatcactattataaactgatagatagttcttttgcagtagtattgatgggcaggagtatgggtgagggccagctgttacaaggattttcaaataggtttctgtctgacatgcccagatttgctatttactatgccagtgcattggaggaatagtatgagttgcttttgttttgttttaatcatggggagattatagctccataatcttgaactataaattcctccaaggcaaggggtcttttccagttaattttatcatgtagcacaacactaattatatagctagacacttaactgtgaatacttttatgataactcttatgttgatgagtaaaattctgaatacaaggaaacattggagcataagttttgttagaatcagagtgcctgaatttaaatcttcgcttcaacacttactagctctgtaactttgggcaagttaatgaaactcttgtacctcaggttccccgtttagaaaatatgtcaagtgtgtatacagtgcctgacacgtggtaagcacttagtaactggtagctagtaggttgaaactagaagtgaagattgtacattggtggagttaatagttggagattaatataaggcaatctttttccccctcttaccactttactaagtaaagtaagatttttaatctgtatgctgcttcatactactacttatgagacgggagagggcttttaatatagtagctctttatttgcattatacattatctgaaatagctactgttgaacctaaagtaattctggaataaatggtaaagaaaactttctaaaatataaaacactgttaattaactttataaataagtttgtaagtaaattcagattatgtgatggcaaactatttacttatttggaatttaagttgaattcttttttttttttttgagacagtctctgtttgtcactcaggctggagtgcagtggtgtgatcctgactcactgcaacctctgcctcccgggttcaagcgattatcctgtctcaggctcctgagtagtggggactacaggcgcatcaccacaccaggctaatttttgtattttcagtagagatggggtttcaccatgttggtcaggctggtctcgaactcctgacctcaggttatccacccgccttggcctcccaaagtgctgggattacaggcatgagccactgtgcccagcctttttttttttttgagtcagagtctagttctgtcgcccacgctggagtgtagtcgcatgatcttggctcactgcagtttccacctccaagggtcaagcaattctcctgctttagcctctcgagtagctgggattacaggtgcatggcaccacacctgactcagttttttttgtatctttagtagagacagggtttcaccatatcggctaggctggtctcaaactcctgacctcaagtgatctgcccacattggcctcccaaagtcctgagattataggcgtgagccaccatgcccggccttaagttgaattcttttttgtgggggacagggggcactgagtctcactctgtcacccaggctggagtgcagtgacgcgatctcagcttgctgcaacctctgcctcccgggttcaagcgattctcatgcctcagccttcccagtagctggtattacaggcacacaccaccatgtctggctaatttttgtatttttagtagagacggggtttcaccatgttggccaggctggtctcaagctcctgacctcaggtgatcccccaacctcggcctcccagagtgctgggattacaggcgtgagccagcgcgcctggcctagttgaattcttaactttaaaaaagatttattacactttatggcatcatttctaaaaatagactttatttttattttttatttttattttttgagatggagttttgctcttgtttcccaggttggagcacaatggcctgatctcggctcactgcaacctccatctcccaggttcaagcgattctcctgcctcagcctcctgagtagctgggattgcaggcgtccgccaccatgcccggctaattttttgcatttttagtagagttggggtttcaccaggttggctaggttggtctcgaactcctgacctgaggtgatccacctgtcttggccttccaaagtgctgggattacagacatgagccactgtgcctggccgactttattttttagagcagttttaggctcacagcaaaactgaacagaaggtgtagagatttcccatttactttctaccctcacagatgcacagcctccctcattgtcagcatccccccaaccagagtggtacatttgttaacaatggataaacccaaactgacacattattatcacccaaagtccatagtttacatatgggtttactcttattgttaataattctctgggtttggacaaatgcataatgacgtgtatctaccaatatcacacagagtagagtagtatcactgacctaaaaatccttttgttttgcaccattttttaacctcttagaacctgagccagcagaagagtacactgagcaaagtgaagttgaatcaacagaggtatgattttaatttaatgctgcctttactttgctgcctttcaaacaaatgtctcaaacatttactttgctttgcagtatgtaaatagacagttcatggcagaaacacagttcaccagtggtgaaaaggagcaggtagatgagtggacagttgaaacggttgaggtaagagttctctgtattgcaaagttgttgtctttgtcttcagttagtaatttttatctctactgagaacaaattaagattgttttttgcattattagtacatttattataataacagactcattacaccagactgttacttccaaaaaatgaatgtttatccctgtggatgtttaataggatccctgctttgctgaaccaatctaaaaaaattattttatacaaagttatctgtggattaatctgttaccatgatttgtctcttactgaaattaggttgctctgtaaaaatctgggctcccacactgatagctgtgttttggggtatcatcttgcactcctcctttaccctaatgctgtttggtcaccaggctgtagacttcctctagcgttttctaatgctgtctctcaactgataatgatgatttttttcgggtcctcatgtctagttcagtgactctcttcatattactcctctctgactgcctccagaccatcctattcattgtcacaacttaattattggaaaagttagctttaagttacttgtacttgaggctctcagtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaagtagaaatgaactattaacatatttgttttattgaacatagaatgcaaggtaaatattgacatagtaggaagaagttgggaagcagtatacagtgctttgtagttaagtattttttggattttatttgagaagagcatactacttgccactgtgccagtgtggtttgttctttgtatctagtaggtgggcctttctaaaggctatccacatgagattccacgaatttttggagcatcctgaagttggtattacacagattgttggtttcgctttggtagtgatttttatctgtgttgtttataaagggaatagctgattttgcctagtttcaaccagtatgacttgtccagttttaaatccagacagaataatataaatttgatgtaataaaagataggatttccttgcagagcagggaattactaagaacaataagcagaggaaattattagagctgggaaaaggctaatagagtgagctttggcttctgtagcagtttagatgagttggtaaagcttgatcctatggtgttggctgagaaaatggaatgggaaaaacccaaatcttgatgataataatagctaacatttcttgagtgctatgtaccaggttgtgagatagatatatatttgacatagatatataaatccagttactatagaaggcataacagttttaagaaaaatacattattttaggatgtaaacacaggtaatctttctttgaaagcagcttataaaataaatctgaggctgggcatggtggctcatgcctgtattcccagcacttgggatgccaaggcgggtgggtcacaaggtcaggagttcaagaccagcctggccaatatggtgtgaaaccctgtctccgctaaaaatacaaaaattagccgggtgtgttgatgggtgcctgtaatcccagctacctgagaggctgaggcaggagaattgcttgaacccgggagatggatgttgcagtgagtcgagatcccgccactgctgtccagcctgggttacagagctagattccgtctcgaaagaaaaaaaaataaataaataagtaaatcaacatgaagtgctacatagtggtcttatggaactgaaacactgtagaagtgatgacatttttcagaatgttaaatttggcataaatgtaattcatttgggtaactgcattaaagcccgttctgtttatagtatagatggtttatgtagtgtgggggacccatcatggtggtagtgagtggagcttttttgctctcctattccttctaatccttttttttctaccttaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggtatgttcattttagtcaaactctgtaacagaaagtttaagtgtttatattatttgactttattctatcctaacttaacctgtaggattcaatgctggattttgaaaatcagacacttgatcctgccattgtatctgcacagcctatgaatccaacacaaaacatggacatgccccagctggtttgccctccaggttagtagtggtacatttttatgtgagagagaaatataaggccagtactttcaggttttaaaaagattgtgaaaataaattttgtttattttaatgactgtttaattttgactcttaggtcttttaatttgatagaaagaatgttattgttcctatgatttgaattaaaaatgtagtttataactgtttatttttaaacttttcattggcatgtagatatagaaaaatatacgcaagtttaatgagtttttataaactgaaaacacctgcagctagattaagaaatgaaacattaccagtaccccagaaacctacgttgtttcctttcaatcactagttaccctcacccctagcgatagcaaccacttccgtacttgtaactgtaatagaccagttttgtctgtttttgtaactttaacaagtgaaattttgcttggcttttaaaatttcaaaattaatctaggagtaaaaataatagaggtgcctttttttgaatgcttttagctttctaggagaatttctggattttattaccttaaaaaaatacacagcaatgaagtgggtaagggaatatgtaagaggcaaagggaagagagaaaccacaagacagtttcagactctttctggacttacaccattatttgaagtagtagcactaaatacagttggtgccttccattgggttaagtggaccttctctccaggactattagtgattgtgagtcatcttggtttttcccagaacacatcagttttagttgcacaaaagtggaactaaataaaataacctatttaatgttgcatgatgttaaatatcataaaataaattgctgagtaaaagtatgtttaatgacagttaatttggtgtaaggtagttaggatttttctgaagtaaagggagctcatatctctcacatttttttttttttttttttttttgagacggagtctcgctctgtcgcccaggctggagtgcagtggcgcaatctcggctcactgcaagctccgcctcccgggttcacgccatttctcctgcctcagcctcccaagtagctgggactacaggcgcccgccactacacccggctaattttttgtatttttagtagagacggggtttcaccgttttagccgggatggtctcgatctcctgacctcgtgatccgcccgcctcggcctcccaaagtgctgggattacaggcgtgagccaccgcgcccggctctcacatttctatcaagagttttagaaaacagatcaaaggtgacacctacaagagagcaatcatggtttttagtgttcattttctgagctctaccaaaggaagagagtaagtcgttttctcagctggggagttgtgtgaaagtcagtatacatagcactgataaaacctgtaaggctatttagttatttacataatgctgagtccattagactctccagtgaaaatgggtactttctaaatgactaaccaaagatcgtcgttttgattatctgtttaatcattgttgggaagggaggtgagagagtgatgggaattgttaagaagatgcatgctgagttgaatataggctgttaaaaagtatatattatttatttgtttatttagagacgcagtctcgctctatcgccaggctggagtgcagtggcgcattcttggctcggcacgctgcaacccctgcctcccgggttcaagggattctcctgcctcagcctccccagtagctgaaagtacaggcacacaccacactacacccagctaatttttgtattttaagtagagatggggtttcaccatgttggccaggatggtgtcaatctcttgacctcgtgatccacccgcctcggcctcccaaagtgctgggattacaagcatgagccactgtgcctggccgaaaagtacatattttaaattttctttttctctagaaacacttgaaattgaaagttggttatgttaacatatattgagccgggtatggtagctcatgcctgtaatctcagtgctttgggaggctgaggagggaggatcacttgagcccaggagtttgagaccagcctgagcaacatagacctcgcctctacaaaaaaattaaaaattagtcaaataaaaaagttagcttggcagggtggcatgcatctatagtcccagctactcaagaagccaaggtgggaggatttcttgagcccagagtttgagactacagttagctatgatggcgccactgcactccagcctgggcaacacagtgagaccctgtttcagaagaaacaaaaggtcaaaatggaatactatctgtctgaggtctagagtatgaataatgccactttattgtacagctttaaaagtcttttttcatggcactgattatttgttagtgcattctattaacattttactttacttttggaaaaaacaagatgaaaccaattgtgaaagtaaactattaaataataaccactgccggtaaaccaaaatgctcacttgaaagctaaaattttatctgcatttcccaatttactttcatgattgctaaaaagtttatttatggtttggctatagaaatttacctttaattgctgggcatggtggttcattcctataatcccagcacctttgggaggctgaggtgggcagattgcttgagcctaggagtttgagaccagcctgggcaacatggcgaaaccctgtctctactaaaaatacaaatattatccgagtgtggtggcacacacctgtagtcacagctacttgggaggctgaggtgggaggatcacttgagcctgggaggcagaggttgcagtgagctaagatcacannnnnnnnnnnnnnnnnnnngatcacatcactgtactccagcctgggtgacagagtgagacacccccccccccccccgcaaaaaaaaaaaaaaaaaaaagcctttaatagcgaaataaaaggtatttagacgcgtctctctaaaaatttaattttgtttgacaaaaatgttttggtcacctttgcagttcattctgaatctagacttgctcagcctaatcaagttcctgtacaaccagaagcgacacaggtaagagtgataaaactattttcttcagggccaggttaggtggctcgtacctataatcctagtactttaggaggctgagatgggaggatcacttgaggtcaggagttcaagaccagtctgggcagtgtagcgagacaccatctctattttaaaaaaataattaaaaaatattttttcacttttgttttaattggttccttggtttctttcttagcttatgaaagaaaataagaatttcatcagtgtccaagtcttctgttggaattcagcaaatttattgttgtggatagctgtcagcctttatttttatgtttaggttcatttttcctcttgatgactttttaagtttttcttaagtcttgcattttaaataatgtattataatataataagccttttttatttagaactgagaatttcagaagacatagtttagacataattctaaaatttagtgcagatttctccatcttagaagtacttgtggagggcttttataacgagacttgggtttatttaacgtcgagcttcaaaaatatatatatttttgcaatttttaggttttatattatacaaatttaaagagagatggtaatattaatttctcccttctttagcagttgtatctatttcttagccttatgcgtcttagaggtaacttgtttttttaacagtcaattttgtaagcaggaagaagcttttatttctttacttatgtctaggttcctttggtatcatccacaagtgaggggtacacagcatctcaacccttgtaccagccttctcatgctacagagcaacgaccacagaaggaaccaattgatcagattcaggcaagttctgttaccgggtcacatacatttgatgaggcacttactcatgaattgaacagatgtacattaccattaatataatgattcttctttttggacctactttgctttcatgaaatatttgagtttgttaatacatataagtttgagattaatttaccactttagtacatctgttcactttttgtttggctaagtttagtttaccgctaaagtgcatctattcactttgtgtttaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtaagcaaattaactaacattaattgcctagtatgtaatatgaatcatggtagattttcttttcttttttaaaggtcttcatttaactgtgcttgagtctgcatctttcattaactgtagggtatatttaattgaacataaactgattattccagagattaactgatactaacggatattctagagataaattttagccttatgagtgatgtgcctgtatcatcttaatttgtagttttacccttttgatttgattaacaaaagcttaaacattcagagaaatagactaatataacatccatataatcattacctagatttaatagttgccctgtttgcttaatcttttattttactgaagtattttgaagtttcagatgttatgctttaccttgattcttgagcaagcacctttagagaatttctagaaaataataataatactataatctgtggggtgcagctaaatcggtgctgagaggaaagttcataagattaaatattaaaataacttttgattaatatgttaataaaaatgaaaaaacattcaaccctgttaaagttcatagaacaaacttctgtaagtggtactgcatccaggagtttgtcttatttatttattttttgagacaaagtcttgctccgtcgcccaggctggagtgtagtggcgtgatctcagctcactgcaatatccgcctcctgggttcaagcgattctcatgcctcagcctttggagtagctgacactccaggcataagccaccatgcccagctaatttttgtatttttagtagagacggggtttcaccatgttggccaggctggtcttgaacttttggcttcagatgatctgcctgcctcagcctcccaaagtgctgggattacaggtgtgagccactgtgccaggccagagtttgtcttttaaaaagatttctcatatatgtaaaagcatttccaaggctgctgattgcatgtctttttattttttttaattccctacttccatttcacagcatattatactcccctttaagtactatatggtatatatgtctttttccacattgaatcacttggagggatttttgtatgtgtgtgtgatgtttttgtgtttgagacctctgtgatgtctttatttatgtctgaggtaaaaccaccattgagtttggccatgttataaaccagagaataaaaggatgaactaatcatttactttatttactaacaggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacaggtacgaaatccagtgtcacctcattggctccttgctttccagcacagttattgacagtgttaggacagtttagacttcagagtggtggtgtccaagagtttctgttttagtagtagaccatatgaatttttcatttcagatcatgagttaaattgagtctgtacttgtatatgtgaattatgtgcaatttttggaggctttatagccattttccttttgtcactgaacttacataatatccctgttgcattgtataatttatatggaattaaatttgttacttgaattaccataaagtgtacttttttttttttttttgagatggggtctcactctgtcacccaggctggagcgcagtgccgtgatctcggcttactgcaacctctgcctcctggacacaagcaatcctccctacctcagcctcccaagtagcttgggaatacacgcatgtgccaccacgtccagctaattttttgtatttttggtaaagttggggtttcaccatgttgcccaggcttgtcttgaacttctgagctcacgtgatctgcccacctcagcctcccaaagtgctggaattaaaggcgtgagccattgcacctggtgataaactatacttttaattgttaattgattgaaggcttttagcatgatatctggcattgagtcagttagacaaagttaagaaaaaactcatggtggctgcatttcgtggactgggttgaaacataatctattttgtcaagtaaggtcataatttggctagttaccatacctgtcacgatagtaatgtaggtagggacgcttttatgtatttgagacaggttctcactttgttgcccgggctggagtgcagtgatgccagcataactcactgcagcctcaaactcctgggctcaatgatcctcctccctcagcctcctgagtagttggtagttgggactacaggtgcttaccgccatggctggctaattttttttttttttttgtagagatagggtctccaggagctcactatgatgccaggctgatctccaactccttgccttgagcgaacttattgtctctgtctcccagagtggtgggattatgggcatgaactaccttgtctagctcgatagagatactttagatttttttttatattttttttttttaagaaatggggtctctgtctgttgcccaggttggagtgcagtggtgtaatcagatactggagcctttaactctggggctcaaatcctgtactggagcctttaactccccacaagtagcttggactgcaggcttttctcaaactcagggcctccagcagtcctcccacctctaccttataggcatgagccaccatgatgtcttctttagttctttaattcctcagaatttaattggaatcccacaacaaaccagcagtcagaggagttaatactttcattttgtcagcccgattttgaaaagttgtaaaattttctaattattcaatttcttggtaaacttggatcagcattagatttttcagtagtaaattcttacacatcctgtagtattcagtatcactaatatgaagctcgaatcttccatactctgatagaagttatcagttatactatgctcagcttccaaatgataaaaactagtggtgtgatcaccatggctcactgtaacctctgcttctgggttcaagggatcctcctacctcagtctcccaagtagcacaggccaccatgcctggctaatttttttttttttgtatttttagtagagagagggtttcaccatattgtccaggctggtctcgaacaccagtcacatacgcagcaagttctctttaatctcagggccttcatacttactttccttcttgccgaaaactttctcccactgataagtacatggattgctttttctattttttaaaaaaagttcatttgtttatttttaattgagaagtagaaactatatatatgtgtatttatggtatacagcatgatgtgttgaaatgtgtgtccgttgtgggcgggcttcatggctggcacctataatcccagctacatttgaggctgaggtggcaggattgcttgaggccaggcgttcatgatgaaataatatgtatacattgtgggccgttgtccagtgcagtgatgcagtctcggctcactgcaacctccgcctcttaggttcaatcgcttgggttcaagcgattctcctgcctcggcctcctgcctcaggcctcaggtgatccacccgcctcggccttccaaagtgctgggattacaggcgtgagccaccattcccggcctgatatttgttgaagaaatcatttcagtatgtcccatcattttagaaattttattttgaattagtgtctaatcaggaacaacatgacagaatctttggctttttaaaatggcctacaagtttatactttaccaaaatttaagtaggaatttgggtattttaaaataaaatgaaggctgggtgtggtggctcacgcctgtaatcccagctctttgggaggcccgcttgagaccaggagtttgagaccagcctgggcaacacagagccccacctctataaaataaatacagaaattagcagggtgaggtggtgaatgcctgtagttgtagctactcaggaggctaaggccggaggatcacttgagcccaggagttcaaggttgcagtgagccaagattatttgactgaactccaacctcagcagtactgggtgagagagctagaccttgtcttaaaagtgaaaattaaataaaataaagatcacacttaagttattatgctgtgagtttcttcctttctttcctttcctttttcctttcattttttgagacagagtcttgctcttgtctcccaggctggagtgcagtggtacgatctcggctcactacaacttcttccttccaggcttaagccatcctctcacctcagcctcccaagtagctgggaccacaggcatgcaccaccatgcctggctaattttttgtattttgttgttgttgttgttgttgagatggggtctcactgtgttgcccagctggtctcaaactcctgagctcaagtaatctgctcagcttggcctcccaaagtgctgggattaccagcgtgagccactacacccagcctggctatgaatttcttacagtgagatttgatcaagattaaaagctgttattgataaaaagtgattctaaaattcagttcttttggctactttgtacatggatacacatgaaccattttacaaggaaaatgttatgtgtatttgtcattcacttacaattttaaattttgggaatataataaaaggcaatctatgtaaaaagatgacactgatgtagttggtttactaagtaattcaagaggagcagtggctctctctttttctctaggtattccctagtgctttcatcgtaaaataggattctaacaactattaatgtatttggagtttcttaagggtgtaaaataggtcaagtaaagattttcaagagtcatacagctgcttttctctctgccccaaaaggggagatttgggttggccagcagcttctgacccttgttgttagtgtgtgggccttcctttgttctgttgccttcctcacctcccaaaggtacttttagcaccctatttttttctcctctttgaattataaacattgttctgtagtattgaatttttgaaaatttctagattctagaactctgtccattgtggatggagcttgtatatatgttagtgtgtaccttagtctagaaccttcaagtgggttgagtgccaatgtgagtaccatgtgattgttttctaaattggctatacttgccattttaaatactttgaaatggaatttggcattaagggctacaagtcgaaggcctctgctgattaaactatgtagttgatgacatattctaccatctagctgcttaaatatgagagagtggttttgtatgttttactaagtaaaaaaaaggatatttaaaagaataagaaaacttctaccactaaggagctttataatgaaaagaagtaattaaatggtacaaaatggtaatgtactaagagtaaatcttttgagttattttgggtctcttgtgctaaaaagtagatgcctttcagaagacgttaatatagcctttcaaataatttgtttggaaggatcaatcatgcaccctgctttcaaaggtttggaattgtggttggagaattttacccccaatagctgagtctaagggtaggagaaaggtaagagactttattcatgtgtagtttttcttatcattgtatgcaaatttaaggattaaactttaaggagactgtataagacacttcttaaactagaaagtgcgtgggagaacaaacggtaatgagctgtttatgtatatatctttttcttttttaaattatagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggtaaaaaaataaaaaaggaggttctaatgaccttttactagttcaaattattttttgatttgtaaaatatatcacacagtttttgggaaggatgtatctgcattagcctcctatgtgcaatttaaacaatgtatattttggtacaatttgtgtatttggtataatttgttatttaaataacagatcatggaatttttgttcatttggttatgtcaaattaatgtctaccactatctcctggaggataagtattttccacattaccaaaacttacggggattgtttattatatttgtacagatgtgtgtttacatgcatagatgggttaaaagtttatcttctgaggggcagttagtacttacagaaatttataaacagattggatcaagataggaaattggagattaatttgattaactagcctggcttataatttctagttcttcccgtcttcattaataaaaaagtaaaaattccttgtgaagataagaaaattatttcttttcttgtcctaaattttaggaggatatgatggttaccgcccttcattctctaacactccaaacagtggttatacacagtctcagttcagtgctccccgggattactctggctatcaacgggtaggtaaagtagttctaaagtgtaaacctgaactaaatataccaatgaaagtgacttagtgttgttgcttaatgaacctaagtaactaatttggcgttaactttgtggtgtccaagacactctgttgaaacaaaagcttttagcactcaacatcagtactcctttagtaaagcctgttaaagacagtgatttccaagagcagagaaatatatttcactgaatgttctttgagaatagtagaagtacaacaattacagaacaaggtgtagctgtgataaactgatactgaagtgtctaaaagattaaggaagaattctgtattgagtgttagactgaaagaatagatgggtaagcattttttaaaaagtaccttttcaatactaactagcttgtcttttaggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacatttttggaatgagattgaacatttatataaatttattattcctctttcatttttttgaaacatgcctattatattttagggccagacaccctttaatggccggataagccatagttaacatttagagaaccatttagaagtgatagaactaatggaatttgcaatgccttttggacctctattagtgatataaatatcaagttatttctgacttttaaacaaaactcccaaattcctaacttattgagctatacttaaaaaaaattacaggtttagagagttttttgtttttcttttactgttggaaaactacttcccattttggcaggaagttaacctatttaacaattagagctagcatttcatgtagtctgaaattctaaatggttctctgatttgagggaggttaaacatcaaacaggtttcctctattggccataacatgtataaaatgtgtgttaaggaggaattacaacgtactttgatttgaatactagtagaaactggccaggaaaaaggtacatttttctaaaaattaatggatcacttgggaattactgacttgactagaagtatcaaaggatgtttgcatgtgaatgtgggttatgttctttcccaccttgtagcatattcgatgaaagttgagttaactgatagctaaaaatctgttttaacagcatgtaaaaagttattttatctgttaaaagtcattatacagttttgaatgttatgtagtttctttttaacagtttaggtaataaggtctgttttcattctggtgcttttattaattttgatagtatgatgttacttactactgaaatgtaagctagagtgtacactagaatgtaagctccatgagagcaggtaccttgtctgtcttctctgctgtatctattcccaacgcttgatgatggtgcctggcacatagtaggcactcaataaatatttgttgaatgaatgaatgaatgagtactggtggaatactccattagctttactcttcttttagctaagagaacatgagcaaatttgcgcatgacaacttccaggacaggggaaacttgaacactgaagaattgacctcttaagcctaataatgtggtgacaggctgcccacatgcttcttgacttcagatgaaaatctgcttgaaggcaaaacaaataatatttgaaagaaaaatcaaatgccatttttgtcttctaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctatgaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgacttttctcatgtgtggttgtggtacatcatattggaagggttaacctgttactttggcaaatgagtatttttttgctagcacctccccttgcgtgctttaaatgacatctgcctgggatgtaccacaaccatatgttacctgtatcttaggggaatggataaaatatttgtggtttactgggtaatccctagatgatgtatgcttgcagtcctatataaaactaaatttgctatctgtgtagaaaataatttcatgacatttacaatcaggactgaagtaagttcttcacacagtgacctctgaatcagtttcagagaagggatgggggagaaaatgccttctaggttttgaacttctatgcattagtgcagatgttgtgaatgtgtaaaggtgttcatagtttgactgtttctatgtatgttttttcaaagaattgttcctttttttgaactataatttttctttttttggttattttaccatcacagtttaaatgtatatcttttatgtctctactcagaccatatttttaaaggggtgcctcattatggggcagagaacttttcaataagtctcattaagatctgaatcttggttctaagcattctgtataatatgtgattgcttgtcctagctgcagaaggccttttgtttggtcaaatgcatattttagcagagtttcaaggaaatgattgtcacacatgtcactgtagcctcttggtgtagcaagctcacatacaaaatacttttgtatatgcataatataaatcatctcatgtggatatgaaacttcttttttaaaacttaaaaaggtagaatgttattgattaccttgattagggcagttttatttccagatcctaataattcctaaaaaatatggaaaagttttttttcaatcattgtaccttgatattaaaacaaatatcctttaagtatttctaatcagttagcttctacagttcttttgtctccttttatatgcagctcttacgtgggagacttttccacttaaaggagacatagaatgtgtgcttattctcagaaggttcattaactgaggtgatgagttaacaactagttgagcagtcagcttcctaagtgttttaggacatttgttcattatattttccgtcatataactagaggaagtggaatgcagataagtgccgaattcaaacccttcattttatgtttaagctcctgaatctgcattccacttgggttgtttttaagcattctaaattttagttgattataagttagatttcacagaatcagtattgcccttgatcttgtcctttttatggag

SEQ ID NO: 15334 - DNA, 7051 bp, Human
cagacctgaaatctgattccagtgggacttctgggaaagtggctaaacctcttagcctgttcccacctataaaaatgaggagacagaaacctaccaaataagattccttcaagcatttaagtgatgcagcactcaatcaataccagcttctgtgtgttcacgctaatttctattatccatggactagagaagataggatgggggtttgatggatgcagaggagagggaggggggtcacaaaggaatgattaccggaaggtgataagagctatatctgtacaccatggctaagctgtgacaagaaagcagagaggtgtaaatgccagggtgggaggtgagaagcaaggagattggggggaaagccagggccagaaatgaaacgtccctgtcctgtgtgtcatgctcctggaagctgggcctccagctgggtatgacagccagtttttcatgtgagcttccccttctaggatgaggatccacagagctagcaaccttgctgagctagatactaagcaagagtcctagaagcaggtcccattatcaagccagatgggagtaggttctggtacggccactctgttccgtgttccagaggtatccagagtccaaggggtggtctgcacccccgctcctccatcactctctcctttgtgtacttgtctctccaatgagatggttaactcccttgggagcaaggaattatctgtcgcccctcttcttgtgtctagtgtagtgctctgaacaatgggtttcagttaattaagcaaacataaatgtattcttctggagcacagtgttttcctctgctcattatatgataccacttatccagaagttctttccaagaaagtccagacagctcctggggagaacaaagtgccaggtgtgagagggcaggtcctacagaattgttgcttccggccacagagtacttatgctaaaacatgtaaaagtattaaaattagggcagtgtggttattaccattttacagttgaagaaagtgaggttcagccgggtcacagcttgtacatggactcctgggtgcagtgcagtcctgggtgcagtgctctttccactttcttgacccagaggtctgcttcctgcccataagccaggccctccagctggatgcccgttcctcagaagcggccctttgtcccaccctccatcattctgcattcccattctgagcacctactgtgtgccagaacatttccagactgtgatgctggctgtgagagggcagagagcaaggtgaacacgggtcagattcccccaaagggcggaggtgatggggattagtttatggaagtcctttggtgcctagcacttggctggacactgtaaaaatgcctctgttagcctgggaaacctagcgacatccagtctcttggaaagaaaaaaaaaaaaagccaggcatgaaggcgtgtgcctgtggtcccagcttctggggaggctgaggcttgagcccagccctggaggttgagtttgcagtgagccgtgatcgcgccaccgcactccaacctgcgcgatactgccagatcctgtctcagaaaaaaaaaaaaaaaaaaaaaaaaagcctgttacccgggaggagagctcctcgcccgacctctaccctcatgaagagaggctcagagggctgaagtgcctatttggccgaaagccgtggcagagtggcaaggcagggccaggggaagcggctccgccgccggggccgggcccctgtttggccggtgcccggtccttagcctgaaggtggcgggcttccgccagaagcccctggcggaagcggtgcccgcgtgcgggccagagtgtgggtgtgcaggtctctgggcggcccaaagggggtgcccctgcctggtaacctagcgggagggtggggacggcggggagggcggcgggcgcggggcacggctccgctgctcagggcaggctccgcccccaggggcgcggatttaaaaggatcgaaggcagccccggagcccagcggccgggaagcgcgcccgaacgaagccgcggcccgggcacagccatggcccggcgggcggggggcgctcggatgttcggcagcctcctgctcttcgccctgctcgctgccggcgtcgccccgctcagctgggatctcccggagccccgcagccgagccagcaagatccgagtgcactcgcgaggcaacctctgggccaccggtaagtctttggggacggagcaagcaagcgcccctcatccagttcagaccccatttccttctcaaccctctggccgctcctcagccacggacactagtgtcggagcaggtggaaaaccctggggctcatctaatttaatagatatgtacttgagacccggacaggtcagtgacttggctaaggtcgcgcagccagtttaagacagggctgggctagatcctaaatcccactgccagccggtgccccttaccttaggcgagacttaaccgaatcttctaaccgctggtgtgtttttgctgcacctccactttccaggcgcctcttcactctccacttcctaccctgccctttttcgtcccttgtccaagcagcccacacaactagcagagtttctccctggccctggaccatcccaccttcctgccagctgtgccatcctctctacctgttcaggaaaagctgagggagcaggctttgccaccacccagacacctttgtggctccttggtgaggtggaagcaccaagaggaggaaggttaagtgtcttcccgctacaagaacggaaacgtgggagagatgaggaacttttcctctgaggtaggatcctggctgcttgacttccttgtgcctggacacctcctttccaggtcacttcatgggcaagaagagtctggagccttccagcccatccccattggggacagctccccacacctccctgagggaccagcgactgcagctgagtcatgatctgctcggaatcctcctgctaaagaaggctctgggcgtgagcctcagccgccccgcaccccaaatccaggtgagccgggcccctgctccaatgtcaggagggcccagctggggccatccccggatcctgcatgggaggaattaccacccagtactgtattagggtgtgactgtctgactaggacattatgggtgtggaccccagaaagccaggtttccaggcttttccctcttgaggcagagctcaaaggaggaacagtccaaagaaaggaagctgaccttcccagtagaccccatggggcaagaagtagggaaagaagttcccctgactcatcacccagtctaaagtaacagactgggatcatcagccttttggagcaggacctttctcccccagtctacacagtcttgtcccacccatgctgttccctgctgcattagtcaagtccacctttgctgtgtcctgtgtatgcttgtggccggaatgggaccctgaggcccagagagggaaagagaagtcagcagccaagacagagtctggaccttgttcacctggactggagctcttcccattctctcatctgcctcagtatccagtggtagggtttagcaacttcagtacatttgacgttctaggctgaatcactgtttcttgtgagggctgacgtgtgcatcatgggatgtttggcagcatccctggtctctacatactagatgccagtagcatctttcccccccatcaagttgtgacaactgaaaagacctccagacatcaccagatgtctgctgggggagagggccccaaatcattattggttgtcagtcactgatctatgggattcaagactccaaagctggagccaagctagcctcaaggtatagccccgctgagtggcaactccttcattccctgctcctggtgctgtccttactgcacaccaccctccctggtcctgctgctgtgtgcagaaggcagtgtgatgtggtagaatgtgggttttgactacaacgtgctgggctcataacctagctacttagtagctgtatgaccttagaaatgtcccttaacttctctaaagcctcaatattcttcacccataaaatgaagataataaggcccatctcccattaaatgagaccatttatgtcaaatgctcagcatggtgcctggctcatagacagcccttagtagatgcgagctcttatcagtctgtgagctccctggcggcacctgttgtagactcgccttcatatcccccagtgtgcctagcatatagtgtgtgcattttgaagggagaggcattccctagaaaaggtccaacccagcctcaaccaacatccctgacttcctgaggcacagaaccagcagcccctgaggacctcagatgtaaggcctaggagcttgggctggctgagtctgaagggaaacaatgtcacctctaatgcccttggttttgaagctctgacacatgcagaccaactagagaatctcagaagcagcagtgcctacgtctggggcttcagagtgaggtctggggcagagctggggtgggggagtgaggacgctgacactagcccagcaccaggcactgtatttggattttcttccacgatcttctttgactgtcatgaccaccctgggtggttggggctgtgttctgagaaaactactgccccgacccctccaaggcaattcagggtgctctggggcctgcctcagctgacagcctgctggtgcccacctctgcagacatctggcacttaggaatggcaggatgcccctatctttatcaggagcccctccctggctcaattcttctgtatgtttctcttcagtacaggaggctgctggtacaaatactgcagaaatgacaccaataatggggcagacacaacagcgtggcttagattgtgcccacccagggaaggtgctgaatgggaccctgttgatggccccatctggatgtaaatcctgagctcaaatctctgttactccattactgtgatttctggctgggtcaccagaaatatcgctgatgcagacacagattatgttcctgctgtatttcctgcttccctgttgaattggtgaataaaaccttgctctttacatacaatgcctggtcctctcctttcacccgtcttttaggggatgggaggaaaagggggctggagggcagagtgttcagtgagatggggctggctcaaaaagtccagaataccccatgccatggcaccagcctggcactgactctggcctcctacccattcattcagcaagcaaataacgcctgttgcatgccaggcttcgtgccaggcgcggggttctactctcatctctgccacctactggcgcaggcaagtgtcactagtttcctcgctagtaaaagggggctgcagacactacactgccgggctttactcaatacccccgccggacttggaggggagcgccgagttgggatccagaccctgccggccgcttcctctcttctctggccgtcagaagggttgccagcgttagcaaataaaaatactggacacccagttaaattcgaatttcagataaacaataattttatctaataaaatgtaccaaatattgcatgaacatactcgtaagaaagaaattattcaccgtttttctgaaattcgaatttaaccgggcggtcctgtattatttctggccttggagcattcattgcccctctcttgggctgcaaacacctggccctaaaacgggcgatcatttggtcctcaggtcctgcttggagctgacagcgggaaagtcccgatttcaggtcacttttcccggagctttcgcggagaaaacccgtaacccacccatgccgggccgcagctcagcctgttaaccccgcccctaacgggaggccctgcccacatctcgcgagagccgcgcggcccccgaaggctcgcaggcggaagtgagacgccggaagcggtcgttgccatggatcctggggacgactggctggtggaatccttgcgcttgtaaatcgtacggggctgggacatgggagctgggcctggagcttgcctggcgggcggatgggtgtgggtggaggcacgttggggatcctggtgcagagtgggccagctgtggcctcggggctcgccaccgtggaggactccgcctgggcctaggcccccatctctaggaaatggctccttcctgcgtgcgcgcgttgtgagattactagtaagagccgcgcttgtgaagacgcagtgcccagttagtttgcgccagcctctgagttcagctcagaacacagatgatctcattgattcctcacgtcaaccttgggaaatctgggtaccctgggacgtccacacatgaggaccgaggctcagggacatcaagggactggcctggtcccagaaacagggagtaaaatgggaagtaaactcagtcccacgtctgcctgactccagagtttgggccactgaaccatgcggctgccatcttggagttctttgagctgtgaagtgctgtgcatcgtgtgattctgtgtcccttttgtgcaggtaccaggatttctatgcattcgacctgtcaggagccactcgagtccttgaatggattgatgacaaaggtggtatacctttctagccctgaaggagagggaatctcactcctgagctgggtttcaggagctaagcctagagggacccaacccactcttctgggcacctgagagtcacttgtagcaatttgatgccccatcagcactaatattcctcttattaagatctctgaccgggagcagtggttcacgcctgtaatcccagcactttgggaggccgaggcaggcggatcacctgaggtcaggagttcgagaccagtctggccaacatggtgaaaccccgtctctactgaaaatacaaaaattagccggacgaggtggtgcacacctgtgtaccagcagctactggggaggctgaggcaggagaatcacttgaacccaggaggtggaggttgcagtgagctgagatcacgacactgtattccagcgtggctaacaaaaaaagtcttcaggctgggcacttcaggaggctgaggcagcgggcagattgcttgatcccagga

SEQ ID NO: 15335 - DNA, 88036 bp, Human
  misc_feature (1)...(88036): n = A,T,C or G
aggtgcatgccaccatgcctggctagttttgtatgtttggtacagatgaggtttcatcatgttggccagctgatctcgaactcctgacctcaggtgacccgcccgcttcggcctcccaaagtgctgggattacaggcgtgaaccaccgtgcccggctgcttcatgtattctttgtagaagcctagatcctcccacctacgtgatatagtcatgtcctcagttgcacacctttccagtctttttgcctacctctccaccattgaaatcaccggttaaaccagtttccttactgttccctaatatcatggtcagattttgaatgccctctaattctctcttcataaatattatactctctttttcaaaaaagtaaacttgttattaaaacatacatatggaaaagtacacaaatcataaatgtagagcttggtaaattgtcacaaagtgagtacaccagtgtcattagcacccacatcacgaaatagaatgttaaaagcatctcagaaaatgcatctcccccttcccctcactacacacaaaggtaaccattatcctttcttctatcagcattgattagttttgcctgtttgtaaactttacataaatggaatcatgcagcagataatctgttgtgtctcatatcttttgctcaatgttaaagcaattgattcacgttttgcatgtaatggtagttcatttctttcttttgctgtatagtagtatatggtatgactgtaccacagtttatccgttccacatttgataaatggggtcttttccagcttaggattattatgaatattcttttttgttgttgttataaattatgattttattagatacatattttggtccaaatctttgaattgtcgtgactttaaaaaaaattttttttagcttacaagttctgagtacatgtgcaggtttgttatataggtaaattgagtgtcttggagatttggtgtacagattattttgtcaaatgcgtcataagcatagtacccgaaaggtagttttgcaatcctcaccctcctcccacacttcaccctcacgtaggccctggtagctattgctcccttctttgtgtccatatgttctcaaagtttagctcccacaagatgctggtacatgtcttttagtgagtgaatatacatttttctgctgggaatgtgcccatgactgaaattgttctatcacaataaatgcatatgttgagctttagtagatactattcagcagttttccatcgtacagtggttgcactgagttatgctttcaccagcagcatgtgagagttctggttgctccacaccctccgtggttttgccagtcttgaatcataggggttctctggtgggtgtgtggtactattgctttgtgggtttaatttgcatttctttgacagctaatatggttgagtacctgtttttgttttcttcctgttttctaaggagttttctgttacttcctctcactaggttagcaggagcactccatatattcttggcagatgtatatattgcgactatctcctcccactctatcggttgcctttttgctgccctaaatggtgtctctcaatgaatagaggtccttaattttaatatcagtttatcaatgagtcttttcacatttgaaatcatatttataccatgtttagttctgtaaaaccttagaggtagaacacaaatacataaaattgtgaaacataaataaaaatttaaaagcctgggaaatataaattagaagactcagaccagggagttaataagacatgcaaataagccacgtaattctgtgaacgtacaatttagcaatacatattgcttagagcatcttagaagtcaaaactcaattggaaacatgatctgctatgtagttctcattatctgtgagtccgtcagacagtatcgagaggatgggatctgacaggtatctgcactcacaagtaactgacaattcgcatattaaagcactaacaggtatattttatgttacaggttattcagcgatagttatgacctcccggttacgtgcgttgggtggaagaattaataatatacgcacctcggagttacccaaagagaaaactcgatcagaagtcatttgcagcatccactttttagatggcgtggtacagacctttaaagttactgtaagttctctactttttttttttacttttcctgaattaatgctcctaacaaatagttttcatctcttggctcacaaaatgaagaaaaaaatattttaaaatgaaagcttgagatctcagatcttgtatgttgagattgcactggaaatacttaaaaatgttgccccaatttcacctctgccctgagggtcttccccccgcccttctgtgtggtgtgaactgtttgacgctcagatgttggtgcttctgggaagtcctcatccactttctgaaggagactggtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacatctggaggcatcatggcaccctatatatgcttcattagagcccacgtcaggttgcattttttcaagtagtgattagggtatatgttgcccatgaaactgagctccttgaaaacaggaaagaatagaaagggtgttgtttcccccgtgcctggcacaaggctgggcacacagcatgtgctcgttaaatgtgtgagtgagtgggttgtgaaacaatcagcctcacagatggcagggcttggggaggttctggctcatcccacttaaagcccgtggcagagccagcactagaaacgaggtctccagtctcccaggccagctgcaggaagatactgggaccatggctgcctatggtgcccacccaccccagtcaccaccgagcccgtgacctttgcccatgacctcttccatcctctggccagtcctaacaggatcagtcccaaccctgaactggctgctaggatctgccccaacctgtaaagttcagtgtgcaaggaaagacatcagaagagaagatgggatgagagaacaattgagggaacaataaaaggccacaagaatgcaaagggtgacaaaaactgatccctgggtcttccgcacaccccatacaagtttgcccactgccaatcccaggtgatcatggaccttgatgtaggcaggaggagaaggcagtttgcgtggagttttagcacggtgggtgctgtatctccttttcagcaggcatggggcggtggcccagtgccttggctgcagacgtctccctgtcagtgcagaagactcaggtggacaaccaaagtcatggaagtttgggcccttcgcctggcagagagtgggaatgggcagtagagatggatgtttcccagccttctgccccactcttccacgagcacccaggcctccagctattccccagtgtcagggcatcatttttttgtaggtgggaaacattgttgtaacaagtgaaaactccagcaaggaaattcagttgtctagttaggtgtctccaaagtctaattagaggggctacaacgtatacctgtgacctgtttcttcagaagccactttggaggaaaacatcctctcaggaggactgtccaaaagaatattctgcaattctggaaatattctgtgtctgcactaacccataggggagccccccagccgcatgtggcaattggacatttgaaatatacctgaataactaatttttttttttttttcctgaaacaaggtctttctctgtcacccaggctggagtgcagtggtgtaatcccagctcactgcagcctcaacctcctgggcttaagcaatcctcccacttcagcctcccaagcagctgggactacaggcacacaccactacacccatctaatttttttatttttttgtagaaacgaggtctcactaacttgtccaggctggtctcaaattcctgagctcaggcgaccctcccactttagcttcctgaagtgctggaattgtaaagcatgagctaccatgcctggcttaaattttgtattttatcttaattaaaatggaagcagtctttagtagttcatagtccccactttagattgctcagctttggtaaacatttcttaaagtgtgtcagaagctcctacgatgtgtgttaaagatgtcaatcccttgtcctgcctgggtgttttgaaacttgctctctgtggggtggggcctgagaatctgtattgtaatggctccccgagttgtctcaatgtgccgtgcagttagagaaccactgatttaggggtctgttggcaaggttgtaaatatttcccttaaaaggcaactagtttggttctacagaaccttgtcttgtatctgatttccttttaacataatctttcatagaattttgtgattacacaagctccatgaaggtcacagatgtctcttccagatgctgtacactaatagtttagtatgtgtctggcttctttgttaaaatgtgtgtttgtctgtcttggagctgttctttaaccgtttatcctcttcctgacgaaaacatgaatgtttgttagtatataactcatgtattcattcagcatatgtttactgagcacttactatgggctaagctttgttctgggtacaaaaaatggcaacagtgcacaaaacagaacaaaatccctgcgtttttgaagctaacatcccagcaggggagatgggccataaaaaaatatgtgctgagtcgggctttgcagaaaaataaagtagagcaagagggagagagtgccagggcaaggtgaggttaccattgtatagacgtaaccagagacgtccccactgatgagatgaaagaaccaggcgttcatctggagggagcacatcccagggagaaggaacagcagtgcaaaggccctgaggctggagcccacttcctttggttgcagaacacagtggagtctggagtggaatgagcaaggggggagggtagcagaagataagctcagagagataacaggggtaaggggtgggggatcgcatggagccttgtagatcattctgagggcactggctttttttcctacatgaggtggaaagcactggggctctgtccacagttgacaataggagggaaggggctgaaagactggtgtggcagtccagggcggagatgatgaccattggacatggtggctgtgtggggctggctaagaggaaactgagcccagaagtactttgaaggtggagtcaatagggtttgctgatagatgggatttggaatgcgaaagaacaggaggcctcaaggtgaatcccagatttttggcctgagcaatgcagcaaaatagagttgcagtttattgagatggggaagactgtgggaagaacaggtctcagggtagaagtaatcagttctgctgtgggcatattgtgggggagaggcctgttattcatctgtgtagcagtataggaatggtacgagatagaagagtcaggaggttaggggatgggtccaggctggggatacagatgtggatgtcaccaggatagagatgggatttcaagcttgaaactggaggagatcccctgagaagcaagtggatggaagctgcgaacggtgcttaagggtaggagaggtgaggagcaggcactaaaggagtctgagaaggaccagccagggaggcgggaggaggccaagagcgaatgtctgagaatcccagcaggaggaagagtgatcagctctgtgaaaaggggagaaagcaagcacctaccccgagtgagcatcatatcaagccttacaacaggctgggtgcagtggttaatgcctgtattctcagcactttgagaggccaaagcaggaggatcccttgagcccaggagtttgaggttacagtgagctaattgtaccactgcactccagcaggggcagtggagcaagaccctgtctctaaaaaaataaaaaagtcttagagcctggcaaacagtgagcacccagaaattcttagttatgaacgtcattgttcttatcacgtggctgccaccccaagcttccagcagcctggttcaaagctgagtcccatggaacttgagaagttggagggcctggttgcaacttggagtatccctcactttgtgtctttctatgtgtaggaattgtttgcacagtctcattcagactctttagcccagcccaccttgtgaccaggagcagatgtcagggaagctgacttggatatcagtcgttcttctctcagcccagggagcgagccctggtggtgacctggtgccgtgaagatgacctcttgagggcaggggccaggccaggaggccttttcttattataaatgtgttttttgttattacattttaatttctcttgagaactgggtgaattatgcagaatagatacctgtatatgtgaattatgcacttcagaggaggagatgtagtaggaacaaacagacctgagtcaggcagtcagactgtccttctgctgatggtgcaaggcacggagcctctcggtgcctctgctcgttggcaagggagatggtgatgactactacactttgcaaagttgctgcaaagattagagatcatatataaaaagcacattggcataatgtctggctccttgtagatgttcagtaaattgtagttaataatatatattaaatgtaatataaaatcatacataaataattccgacaaggggagcagctagctttttgacatctggtaatgtgcaatgtgtggtctgggtcattctttccccacctattgtgattcttttctgatggatggtgccctgggtagaaggagcaggaggtacaagcgctgttgggcaggaaagggggcatgttcaggaaatgggcgtgtttcatgttcccacacttcagaccgaataatctgaggctgccccaaagaagtctctgcaggtggggcctgacagttatctaattctcccaatgctggtcactgtgacctattttcaagtacattatttgctctcaggcactcaaaaaaaggagctacctttgcctgttctatacacggtctatttctgactcatattgtcctttagttaaatggtttggttcaaaggattcctgcaaagtctgcctgttaaagtagaatttgcagttttccaaacactccatgctgtttgccatccctgggcctttgtgccgggccatctgatccaaaggcctgtttttagctcgtgtgcctggaggggaggggtgatgcttggccctgtcctcctcccaaacccagatcagggggttgcttcctctacggccccagtcgagatgaccatttgtgtggtcccgttgggtgtccactgtgcctcgactgtttcacagccctcgacggcctttgacactctgttacagccactgcctccatggctggggcaggaaaagggagcttcttatggccgtgtccccattcccacaccgtgcctgccccataaacatggagcggggaaggcaatggagtcctgatctgaagaggcgtgtggttgaacgtgcccctcagcttctcacttcagatgatgggaaggggaagcagggaggcagataatcccacagggtggcacaggccacatcactctgagggtattttgaatggcagttgagtatttttagctgtcttcctttaggctgttaggtgagagctttcctttcctggacatgcacttcggtggcttctccaggagtaggagccacaggtgtgtcctgaggagccaacagaaaccaccctggggttagcatttcattgtggataatccactggaggccacagggagttcactgtgattatgagagctgagttttccgatttagacattatcacttgggaattgcagctaagggggaaggaagaaatcttagacaattaaattaaactcgtattgtcttgtgttgatgtcatttttcttagccctacttcccatatgtgctgtgtggcttcttaaaatttattaaagcttttcttgtggtgggaagtgtgtgtgcatagcatttctgaatattttaactcttttttgcctacagtaaagatgtttttaccaccaattaatttaagacttttcccacttgataatttcctttgttctagaaacaagacactggccaggttcttctggatatggtgcacaaccacctgggtgtgactgaaaaggaatattttggtttacagcatgatgacgactccgtggactctcctgtaagtgccatttttaaaaaatgtgctgaactccttcacggtttgcttttatattttatgttttcttgtccaacagagatggctggaagcaagcaaagccatcaggaagcagttaaaaggttggtgtgatcttttcatttcagtcgaacattaggtgttagtgtatcacagcctgtttctcccctccaatcgtcagtgcctgtgacatctggtacctgtagttccgggtgtccaggagtcatgagtgagccgacttctccctgtctgacttctgagtcagcagagatgcttccagatcagccctctaggatccgccccagctgtgggaaagaaggggaagggtgagagtaggcagctcagagcgagggaacccacatttctgtattcaaggaaggaaaaggaaggaggatggccttacttagcccgatgtgagagccagggtggacaagagagacagggagatagacaaacacaaacacctcatactttccaacagcatagtcgcgttcacggaaaaccgaaccataagtaggtaatgtcaccaatataaaagattaagtcttccaaactaccgcttatctctcaggagtgaatcccagtgctgcagctaactcccagttcggtggccagtcaggccacaccatagtccaccctctgccctgatctgctctcggcctgatgttccaacattgccagcattgttcccctttatgccactcatgccccagaccaacctggctgatctgcagggcctcccagtgcctcccctcagtctgttccatctgctgggaatgcttttccctcccacttccctctgtcgaaatcctgccttttttcaaggctgctcagatctcatttcctctcctagaaactgtgggtggctccctcgacattctcttagatttaccatcacccgtgttggggttctgaatgctcttgtcctcatctgtgttagttgcctttagttccctctcagaactgcaagttccttgaggttaggacccttgttatatttctctctgcatccccaaggtgcccaacacacacaaaaagtggccagtgcatggcggagtggagaagggcaagtggatttgcgcacgcaggtgcgcatacacaggatgccccccaacacacacacgcacacctgcctcagcacccaggcaggaagaagtagacacagtggccttcgctcccgtctcactgctgcccccacagggagcccgattctcaaagttcttccctcccatgagctgcatcctctgcgttcagaagtacctgtgggagcctcagggccacttgcagacaaatacctgcctcatccaagtccccaggaatgagtccacacaaggcatgaataggtgttgtcattcattctctcattaactcctgctttcggtgaacgtatcctgagctcagactgtggcaaggtgctgggctaagccctgggaatccagtccagatcaaatttggactctcccctcaaggagcccacagccaagtgtgcagacagcccagagggttcgacattctatgataatagtaagcacacgataggggacagccagaaagaaaaagaggctatgcctgcagcgcagagatgaaaagttttagaagagggggaggggaggtgaacaagcatcccaaggcagcaggaggacattgttctcccctgatgtgcagattgtcatagcgccatccgctggtacctagacatgtggacaggtgtactcaggggcacacccccgttagggattctttgaacacacgctgcagatgaagaaagaaagcactaaagagcagggagggtagagctcaggatgatctcaggtagaggaggagatctagcaggctagtgagaaggacttgagttgcagagagcaagaaagtgctcagtgcctagatagggctggcgaatatttactgagggatgatggtgaaattgacatgaagatcttgggatcttagcagcacaatctgatcttctcctgttgccgtctctgtgagaagaaatggactaattttatccacacaagcaaattgactctagatgttgatgcataaagccgtatttgaatatgttcattgtgtgatttactagtatactaacttaatatactttacattaaaagcatgagatattttctagtttaaaaatgattttgaaatgtggtatagcagaatcaaagatctcattactctaattctggttttgtcaccagctgtgtgacctaaggcaagtcacctctaattggcttatctgtaaaatggggctaccagtagcagcgtagcccactcatagtcatggtggtgttgaaatgcaggaatgtacatgaaaatgcttgaaacttataaatggctacacaaacgcaggctattatttctttgtatattttgcataataatgccgatttaaggattttttaaattcctaatacagatgacggagtgcaatgtttaaacacagccctaagataaacgtgtgctaggaagtagatgataactcagtctgtgctgatgttgcataaatgttttactttttgaagacttggagatttctgaaacaactaacttatgtactccatgtttgaaattagcccttttataatggaaaaagctatggttgagtgaaaaaatgcatcacttatggaagagaagcaacttacatacattgactttgtcaaagggaaaatttaatttgtttttgaaaaatgttgtaggaggtttcccctgtaccctgcattttcgagtaagattttttatacctgatcccaacacactgcagcaagaacaaaccaggtaacaacatttttttaaagttttctgtttagtgtataaaaatgagtaaccactaaaaatgtactcttcattttattactatggccaaataacttcatttgggtgtaactacaccaacaatgatgatccaagtaaaaatctggggtgcacatactgacattttaatcacctaatgagttttcagtcttgggcctgcttctcttatctcctgatttgctgccattcccagcatactcccatctgccacctcctacctctcccacctccttccacctccctggcctctcctgcctgctgaacacactgtgctcaaaggacaaaaagtcattttctaccaatgtaggcaggatgtagaagacaaatttgtaaaatagtcatccacaggtcaaatagcatgatgtctctgaagagctaaaatcaaggctcttgaagataacaagacatctcttgttataagaattttctttctttttttttgttttgagacggagtctctctcttcaccctggctggagcgcagaggtgcgagcttggctcactgcaacctccgcctcccaggttcaagcgatcctcccacctcagcctcccgagtagctaggattacaggcaggtaccaccatgcctggctaattttttttttttttttttttaacggagatggggtttccatgtcgtccaggctggtctcaaactcctgacctcaagtgatctgcctgcctcagcctcccaaggtgctgggattataggcatgagtcaccaggccagctttgttataagaattttctatcagatccccagtttgcaagagttagaaaggagagcaggctggattcagcttgtcttctcagtgaatcagcaagtacaggaaatatgtgaaccagataagggaaagagggctgtgataggagttgtttacccctcagggcttggagtctctcccaaccctgggctggtactggggtttttctaggtgtgagggacagagtaattggaatggagtaggagagtgtagcacaagaaagttgttgctgttttaacacagactgcacaaacaaactttccctcccctgtggcaacgttaagcccttttattattgatccatttatttttcttagggagggaagctatagaaaaaaagcaatagatgcttagtattgaatcctgttttacattcatcgtggccaaaagacataatcaaggaggcagcattaactcagacacagagtgttgccttgttaattttttttagcagtaattacatcacattttaacttgtaatatgttgaaaggccaaatattaatctgttactgtattttgccttctttgtgcacctcctccctctactatagcagacactgggaatttgactgtattttttattactttttaagccaatgtccaaggtgtctggtatgacacatccggtgaccacacagaagcatgccctgtcctctgagttttccccataccagctctttatgctggtaaactggggataggatagaaacactcagcccagcaggttacttcataagctgacggacacagagctggtgatgaaatctataagaatgtgtttgaaatgaccctaccaaggtttcctcaggccagtactaaataacacactctgggccaggcatggtggctcatacttgtgagcttcccagcacttcaggaacccaaggcgggagggtcacttgaggccaggagtttgaaaccagcctgggccacatagcaagaccctgcctctacaaaaataaaaataaaaaagtagtcaggtgtggtggtgcatgtgtcagcatctcaggaggctaactaggaggatcacttgagcccagaagttcaaggctgcagtgagccatgatcaagccatgtactccagcctaagtgatcgactgagaccctgttgcagaaaaaaaaaaaaggctctgttgaagggatgtcttaaaaacaacataatatgtgtgtgtttacatgtatatgtgtcttttatatatattatatataatgtgtgtgattatgtatgtatgtacatgtgtacgtgtgtgtggttctaaccagtgggttttttaaaaatcacaactccaaagtaaaaatatattttgtttcagaatacagtacacatatataaattactgaagcaaacgttttataaaactatagtaagtaccaggtactctgaagttttctattctgttttatttcctttttttttttttttttttttgagacggagctcgctctgtcacccaggctggagtgcagtggcgcgctctcagctcactgtaacctcggcctcccgggttcaagcgattctcctgcctcagcctcctgagtagctaggactacaggcgtgtgccatcaagcccagctaatttttgtatctttaggagaggtggggtttcaccatgttggccaggatggtctcgatctcttgaccttgtgatctgcccgcctcggcctcccaaagtgctgggattacaggcatgagcctctgtgcccggccttacttcctttttttaaaaacttgccaactgtgacgcattaaattgattgtacaaccaactgggaggttccaaccccaagtctggacggcactgcctaaactagtgattgtcacctgcctcctgccttcccataacactagagccccaggtttgtggcatccactgggcacattagagccctccagtggccaaacttgagggagaggtttcctacggccagtgcaacctaggagtttgtctccagggcccatcctggccattggccatccacttccatacgctgtggaagagaagcccacttctctgggagctgacaaaatcttcctgctgagccttcctgtcatttgagggacatctgtggaaatgtagggcattcatgatggagagaagcctcgggcacaaatgaaggctgccttcaggtgtccgaagagtagtcatgggaaaaggggaactagatgtgcagggtcgtagaattgtggccagtgggtggaggctacagggaggcagattttagcacagaatgagtaataaacagtgtgtgtctgtctcttctaaaattcactggttgacaactgacaccccacccccaccttccatcttaagaagggtggtatcccgttgtggagtagaatgtaactatgaccttctgggatttgggcaccagatttatcttactgcaacaggagccatggtgggagccacccccataactcttatagagctggtgggccaccaggactgccagatatatatatatattttttgaaacagggtcttgctatgttgcccagactggcctcaaactcctggactcaaaggatcctccctcagcctcctgagtagctgggattataggcacataccaccacgactagctgccagatcatcttatcttggaccaggcttctaccattaattcacatgctttaaaaaaattaaaaattaaaaaaatgaaaaataaaaaaacttaaaagattttacctatattcctggaacatagttatcttaccccagctttgtagttcctgtttaaggaaattccctctgaaggaaattttagctctcaagagtcaaagaagatgtatagaggtggtatctgttagtttttgtttgtttgttaaggatctaggcagagaggtcattacatttttctgaagttgaggtcacaggtggggtacccacaagagaggtcattacatttctgaagttaggcatcccaggcatctcttctaaagaactatcctgtattctaattgttaaataaatatcttcttcattgtgagcctccacaactgctgtttctgataaatttagatcattctttgcagaattttatatactggcaatctcaaaactaggctccttcaagattcctaggaagtctcccaagctcgggttgggttccactattctagtttctttgtgtatgatgccatggggttgactcagaaactttgctcaatatatgacaaggcagcatttggtgagtggtgatctccacgtttatcttctcatttatatccctaggaagacatactgattagctgagcttgtcaatgaaagcccgggttcaccattggattatctataactctcctttctctttttttctctcagtagcattgtaggaggagagaacacttaattctggttgaatgtcagcttggataaacatagaaacaaactagaaagaactgatgatgttctcctaggtggaaaagatggagattccaataccaaataggtgtgaatcagcaaatgtatgttatactgtctctcaaggccaggtgttcaatacattgtgggtagttaattataatcaaagtaataatattagagttacgacatggatcctaagctttttagccattaaacatataagaaatttgtagcatagtgagtttttttataacatgatcatccaggttaaaataagacacaattgacctcacatatcctatctgagctccgattttgtcatctgtaaaaatggagatagtggtacctaccttacagagttatgaggctgagataagagggaaagttacaaagtagtaccatgtacaaagcccggaactgtgcaaataggaggttgtaatactgtttgaagcattcccatctcaaaaagccagttccttggcctttataaatttgaaggaataatgaaactgatttgtttcaattgtgaaaattatttctctcctgcccctgtgcacttctgccctgtctatattagatttcaagaggtttcccttttgtcatcttggccagacaatggaatgtctatcccgtttgaatctgggtttaaaaaagcatgggagctagtggccaagtgtcacatgtatgccgcatccctaaatagaagtctccccagggcgcttcctgacctgcgcaatgctgccgaaggcctcctttccccgctccccaggcagaggagcaaagtcacaggctgaggggcctgccacgacttgcccacaaaacaggtctggagtttggaagttacatttgctggttgcccagagatgagtgcagaattcagcttggaggtcctggaaacttctagtttactgatgtttatgcttttgctcatgcacccacagttcctgggacacagaatgctcacctgggggtttgtaccccagccaagaaggtgtcttcacagactcccctccttttagcaacttcatgcagatggagcttgggtggatggatcctggcacagtgttcagaacagtggccctgccagtgtgtgggcgccgcttgtgcagagcccctgtgggttctggtcctcaagggcaggggcgctcactgacagcggaacccatagtaccagcccatctttggtgggctgtttccaccccattcatccctgctcagctcttcataggacagcctgtgctggcagaaaattgcccccaccagtcaagacgtagggcatcaacatgagccatcagtaatgacagggcagctttgcagagcgtaaggtagcacctgataccttggaccaaaaccgtatttttatgtatctttcacatgtacagctcttgtctttgactcatcaaactttcttttttttttttttttgcttatttcagtttgagtatgaattaatgaaaacaattgtttcataggcacttgtatttcttacaactgaagatggatatttgcgaaggaaggtaatgagaattttacatttttcttttcctgttagactagcaaaattcctggttttaatctaatgagtgtttatttctggtaacaatatcaaatctaaacagagtggatgtgcaaagcatcctgtacagcattaggctttggacatctgtttttattatacctcagtcttggctgagagaggctaaggattgataactttgtttcatgttatttcagttttattacaaaggatgcagctatctttctggtaaagacctgagaaattttaaagggaggaggggacccagaatgtacaatgggcttcattcaggaaggcagatcaggcctaatttgggtccacttttgagccccttagtacccacggatgactcattttctctctgggaggctttttgctcatttgcctgtgattcagtgcttcttgtgttaccaagaccatctcagtagctagaagggagaggaaattccaagccgatggtccctgagctacctccttttcttgacttagggaagaaactgcagcaggtaaactggtgggaagagcacagcttattcccagtctcttcaccgcacccccaacccctgtgagtttagccctggagaggagggtcttcagaggttaccagcgtgctgtaccatgagggagctggagtctcactggggaaatgagacagtatcccatgaagcaattaggaaacaattagaaccaatatgggcagtagagacaacagttgtcataagacttgaggagctcctgctggtgtgagctagaaaagtctttatagattgctaggatgagccagaattgggttgggtagagaagtgaggaggtggatttccctgggcagtgagaagacaccccacccccgacagtcccacttggaaaccacatgctgagagcttacaggagaatagagagggctgttcgtgtcctacgtaggcgggcatcttacatctagcaggcagaagagaactgttgaaggtttttaagcaggaaggatgtggcaagagccatatccacaaagatagtatcattgtgcacaagggaagactggcagaggccaggggcggttcagtctggatggaagggaatggacagccttcaaggaagctattgtagcatccaggccagagacctgggggcatggcagtgaagtttgtggagagaggaggtggatagttagaagcaagagacaccttgaggaaaggatttccagagctgttgactattgagcactcatagaattatagaattctcatcacttagctcatcctgccattcaaggtaggaatgagtcacttccccagcacaatctacaggtcttcaggcttctgcttgatcacccccagtgagggggagctcaccctttcatgaggcagcatttttacattttagggtaactcaaggttgaaattaccgacccctctcctgggtccaggctgtccttagcagctgcagaaacccattctttccttctcttctgcacacttagtcttttccacagatagtttgcagtcacctttttatgagacaggcaccgaactacgctggtcaaataaggccagggccttgcctcctcaggaacttctagtctaattctccaaataatgggttgtcttcagtttttcttctccaaacaaaatgccccttgttatttccatgtgaatcagggcaaatctgttaaggccacatcctggcttagatctgtggcccttgtcaagtcctcaccacctctctgaggagagggtctctgctaccaaacgcttctcagatgtggatttgtgtatttgtaactgtgggtcttttgacaggcccagtggaacatatggagcacttttcctaggtgtcaaattgtcccgacttgtttgagccgtccatggtagccggcactcaaggtgtcatctccttctttccaagatggttgatctcatccaagcccttcactcagcaggtgaagaccctgaagcccaaggtgaaagaaagggatgtgtttaggaacatgcggccaagttgagagcagaacagaggcttctggtgttccctagtatgtatttggaacagtttttggaatgtttttctttctggtttcttcataggattgtttcttccatctagagggaacctcctcagcctcttttctaagttgttccccaaatcccattcacctcctctttctccagcaaggacactggcgtagatttaatcaaaccccatcttgttaggagagcaaatagctgatactcatcctgtttctgcctatcctccccacgagctctctagatttccagatgaacaaacagaggtgagatccctggacctcatctgtaaccttggggagattatttgcaagtcccagcaggaacacagcatcacttgaggaacaatgggggcccctcagatagggaaagtcgacttcatatgcagctgcagaaccagcacacagtgcagtggacaggaagcggaacccctggagggccgcattgtcagaaaggcggagtggttcacatcttgggtacttcacgggctgccatagaaactgtgttccccacttcccactggggtgctgggaagaatttttaaagtcccagtggctcccagtgttgctgttaaggattcctccgtttatcagagacctccccacccttcaagcccttcttcctgccctcccctaacctgttctgcccagcagtgacccctgctccaggtctgctggtgagctcctgggcaggccgtggagtctgcagttgaatgcagaaaagaaaagggagcaatcagaggattcaaaatgtgcctaagacagaggtggagtcattggcagaaacagggcacctgggaaagcagtgagtttaagaggaaaggagaacaaggccaacccaagtccatgattactagtgaatggcacgaagactgagagacagatcactgaactctgtagatcttcaggagggcaaatagataaaggaatcctaagtcatcgtaattagttaatttaattaaggaattgcaggttttaaaattgaaaatacctttctacttgtccctcctaagaggatgttactattttagaaagagggtaatctagaaccaaagggtcattagaactcaggaatttagttagagagccctatgatgagtctcaggtctttactagaaagatttaaaggctgcccattgatctcagagtacaatttttttacttttttttcccctcttagagataagagcctgacccttcttgagcagccaaaacactggccagcattagtcctttagtttcatggtatttgtgatggatattattttaaacatgaaaaggttttatttttaaaaaattttagtgtattacatttgcctttactgtttatgtgcagcataaagttgcttttgttacaattcatgttgttttgtaatggttgatcaaagcaaagaaagacatgtgttactacgcatgatctgtcaatgtttaaggctgttgttggttcttgtgactttgctaatatgtttttctcctgacaggttaacctgccctcttaactcagcagtggttctagcgtcctatgccgtacaatgtaagtcacaaagggagcatttcacggatggacaggttgttctgatcagtgtgtggagaaagtcactggttcctcctgcttgaccaagtccctcttccccaggaatcctgctgggcagcatatctctggctgtccagatatgtgtttctactcagactggcactctcctgtagcatggggatgttagattaaggaaggtggttaaggggaaaggaatgaatgaactgtggtgtgaaattttctccaagggagcccatcagacagcagacagctgttgcacattgcattttccagaaactttgctcaggcatttgatctgatcttcatacaaatcccagtgggacaaatatttgtatcagtcatcccttatacacatggaaacctagacccagctaggttaagaaatttgctaggagtcacccctgctgcttggttggtgctactctaaaacactactgggatcttaggaatttcttttcagagttgcagtatagctaatggattgtatattgatctataccagtgctattcaatagaaatataatgtgaatcatatatgtaacttaagttttctagtacactcattaaaaaaggtaaaacgaaacaggaggttttttatgttttatttaatgcaatatattgaaaatattagcattttaacttaatgtacaaagttattagcaagatattttacattttttttatactaagtctttgaaaatcagtctggattttacactgacggtacatctcaatttggactaaccgcacgtcgctagtggctaccatattggatagaaagtccagatggaattttcttgaaggctggtttaaactggagtaggaatccgctcattcaatcagcaaaactttatcgagggtatattcccttccaagtcctgtgggtagatgctgggtaggcacaatgaaaagaacgtatagccagatgagagcaaaatgtcactttatagtagctagctttgtggtggcagtacagttcatcagcatagtactcaggtagagccatttgcagctccagacctaagaaatctcctctaccagaagcccaaaccatcttggcctattaccctgttgacctactgtgtgatagatagataaggcagcaagatgatcaggtctgagagcaggcactggctgaactacacaccctgctctggtctcagaacaggcaaaatagcaagagaaggctgacggactcctgaggtggccctaggtctgcctatttccctaccaggaaagaacagaaatgaaggaggtgaagagcaaggtggctgggcctgcagcttacccacccacctgcatggaaccaggaggtggagggcaggggacatcaaagatgaccctattcacgagtaagacgagtaccagagttagtctctccatcgatacctgcatcgcctcctccttagtgggaaactcaaaacaggcgaatgggcctgggtggatttgaaccttcccttctccctacaatatacctgggacaggcccggccatttcacatccatatgggaagtggcatggtcaccagtttgtattcttatgatctgtagaccttgtgaactctgtgtctgccaggccaatcagctgaggagactgagcctccccatgtctcagagcaagtttggtgttcacagcctgagcttcaggtttatgaggcaggaacactaactagaatataggcatattcaatttaaatcctggcatccctggccaggtgtggtggctcacgcatgtaatcccagtattttgggaggctgagacgggaggatcccttgaaccccagagtctgagaccagcctgggtattatagtaggaccctgtctctacaaaaactgaagaattatctgggcatggtggtgtgcatctgtagtcctagtactttctaaggctgaggcaggaggatcacttgatcccaggaggtcgagactggcatgggcaacactatgaagccccatctctacaaaaaatagaaaaattagctgggtgtggtggtgcggtgcctgtagtcccagctactagggagactgagggggtagtatctgttgagccccagaggttgaggctgcagtgagccataatcatgccattgcactccagcctttgtgacagagtgataccctgtctcaaaaaaaaaaaaaaaaaatctgatgtctccggtggccagttatgtgggattgcctctcctaatcttggttttctcacctgtaaaactgaggtgagtgatttaagacagctctcaatatggctaccttggttcaaattaagcaataatgtgaaggtgatctgtaactaaaaattctttattgttggaccatccctggctgagtcattgagaactggactggagccatatacctaggtcttgccttttccacttgtacctgcccgactttgagcttctccagacctcagtttcattacctgacccatgaggataataagtgtctccttcaagggttgtagtgaagatgaaatgagtgactgtatgtaaaactattagaatagtgcatggcacgtgtcaagtgttagctcttactgtattttcatgtctgcccagaagaaagctgtcagggaattgcctgttgtaaacagtaaattctatttagagtaaaatttaaaaagcaaataaagaattctatcgcaggcttcagtagtcaggttcccttctgcaaagaactgatagaatgggggctaaagaagttgtgggcacctaaaaagtacaaactggcttcagtagaaatagtcacattactgtcatgctaatagaatcatggcttatcaggcaagcagttttaagtataagcttttatccctccaccctcaataaatatatatattgcagagcatacatttctttaagattaatacttgtgccaggcacggtggttcacgcctgtattctcagcgctttgggaggctgaggcaggcggattgcgtgagcccaggagtttgagaccagcctgggcaacatggtgaaaccctgtctctacaaaatatacaaaaattagccaggtgtggtggtacacccctgtagttcaagttactggggaggctgaggtgagaggattatttgagccctggaggtcaaggctgcagtgagccataattgcaccactgtgctccagcctgggcaacagagtgagactctgtctcaaaaaaaaaattaattattgtatatgaaattactggatcaaaaggtacacctacattttatgatatattttgctaaattcttccaagaggggcatctgatataagtcctcactgtgaccagctaaccaaaagcacattttcttattacataaaaaataaagtccggcatagtggtttgcacctgtaatcccagctacttgagatgctgaggtggaaggattgcttgaccccaggaattagagactgcagtgagccatgatcatgccactgcacaccagcctgagcaacagagcaaccccatctcttaaaaaaaaaaaagtgatcttcaggtaaagtacccaaaaatatacaatgatggaaaattgttaatggcctgccaaggctttatgaggctcaaagaataaagtatattttttggaatatatgtttattccagaatgttccctgcacctgtgccacatagaggtctgtaccagcctcagggtgcacagatggataaaacacactgctctccccaaggagtctacagcctgtagggaggcagatgtggatgatactagcagtggagatggccaccaggggtgcacttcatcctgcttagggagaggggagagcatctgggaaaacgtcctaggaatgacccctgagaaccgcctctaagatcaggttggagttgaatgaatagcaggtaaaagtctttccaagtacaacagccgggcagcttgaaatgctgtactttggaacctgggatataccctctctttgctgcaaaacataaaatattatcaaccagaagaaagcatggaacttaaaatgacaaggtatttcccacataagcacttccttttttgtttgctataattagcttttgcatgtgttgctttctcacagataggaaaatggattacttaggagtttggagcatatagtatagtaagtaggtaagagcagggactatggtcagagtctagcctccaaattagcagctgagcaacagtggcagacccctttgggtctgtttccttatgtgtttagtggggataaaaagcattgcctatatcacagggttaccatgagtaacaagtgggatgacatcattgaaatcgatgtgaaaccgcccagtgttttgcaaatgtttatcactgtttaactttgtttccccctagtggttagcacagagctttgcacagagtggccgcttaggatttaaagggaaaaccaccccacagggaggctcattggttgtgttcgaagctcagaacatttgtcagcaacttgcctaaagagagaaccttgctgttcatgtttgcagaatgataccagggatgggactgttaactggtatgatggataaccttattgggatccaggaggatctccatgagctaatgaaaccaacagagtaaaggttcataggactccaccttgaggatcaggaaaagtcatttacagcatttggttggcctttggggacatgattgctgccatcaaatggccagcagcggctcacaggcctggcaggcaggctggtggggtggtaggagcactaactggggttcagatcacctgggttctgatcttgaccctgtcccaaaggtgtcttttcctttccagaccgcaatttcttcactcttaacatgagagctttgaaggaagtgattctaatgctttctagcaatttcctcattgggcatgctgtgtcagggcatttaaatgatttcctgtgaacgcaccatgtgcgcttaaccctgcacaaactcaccagccacatagccttgacatttctttccacagcttggccacatttggctggccttaacagcctctggtctaaccttgaccaagtctgcatgcattggtcacttggctctctgcccttttccccttccagaactgaaatttgcatcagcctctgtacagatcagttctgagcacccaaatttctgagcacctactgtgtgtcatgcctggtgctgggggccctaaaggtgagtctgacccactcccagcacttgaggcacagtgtaggaaggaaacagatcccttcgttatggtgtggatctcaaaagagcagccctgtgttgtgagggcagttaggtgaacaaggctgaatgaaacataacctttgcatcttccctttttttttttttcttttttgagacagagtctggctgtgtcacccaggctggagtacagtggctcagtctcggttcactgcaacctctgccttccaggttcaagcgattctcatgcctcagcctcccaagtagctgggattacaggcatgcaccatcatacctggctaatttttgtatttatactagagatggggtttcaccatgttggctaggctggtctcaaacctctgaccgcaggtgatccacccgccttggcctcccaaagtgctgggattacaggcgtgagctaccatgcccggctgcattgccctttcaacttcatggtgaaattcacccaagcagctacctgtctcacccacttcccttctgagattggccacaaagtatcaccatatctttcccatactctgcccttgtaacagagaaggagttatttgatttggaaatctttggtgttgaattgagagtcctcaggaggctcctggcattgcagcgagctacaggaagaaattcattaaaatatttggaaagatcaggactaattttttttttaaagatgaagtagaagcttttttttgttttgtttgtcaagaaaatggaatacgagatcggttgccccattagaggtagagattatctcctcaattctgtttttagacaaatgggaaaacttgtggagaagggaaatggatgtcctcaggtcccataagcctggtcctttgctcttcacctggtgccatcctttttcccagtttcctcaatggtccagacacccaaatggtttgagtccttgaggcagccatggacacttgtacaggttgagcactgcacaactctcaagaatgcccatcacatcataggcatcaacaattcaattcacattggcagacaacagtcaagggtctcaagggagcagtaccattttgcccaggggctagtctggaagtcacccttccttttccctctgcacctgcaggtccctaatgtgattcccctgatagccccagaatctctcttcatatcttctgactccccttagaatgtgtctttctccctaggaactttgctgttgcctgagccctgaccattcagccccactcccacccaccttttgtccctgtggcctctgagcacatcctggtcccctttcttccacacctccctgaatcccaggggatgggtcaggatgtggagagtggtcaggtcggcatggcctcccttctgcctacacccagtttttagagcagattggtccagtgttatggtaaccttggggtatggcagagaaagcctgcaccgtgtgtggcatatggattgtggcatttcccccagtgggttctctttatccagtggcatgagtgcaaactgctgtgctgaccacagtgtatggaagaggtgtgggattagaacagggcctaggttcaaacaccgtctcctaattttctccctctgtgtccttggggagaatgagaatttgattggatcatgtgtgatagtatcttagcctatagtgaaggctcagataagtgtggaatctggagctagtgagaagcttcagttcatgtggtgtagaacttaccagaagagtatttctaattaatgttattctgatgatgctgtagatgcttataaatgcaaaccatattaaaaaggcaaaactaattatgattttccccttcttctgtcttgatagctcattttggagactataattcttccatacatcatccaggctatctttccgatagtcactttatacccgatcaaaatgaggactttttaacaaaagtcgaatctctgcatgagcagcacaggtgaggggggctggggtggcctactttggggacttgggttgggtattttcagacatcatatccctttgtgtttgatgcagcctctttcttttgtgcatgaatcctctttcaagatgtcgggggtttttgaacctttgagctggtatggtggcagatatatttggcataactagcatttctgtaaagtgtaaaatccagtaagagtttagggtgatagctgctgcgtccttttcaggatgtcattgaaatcagtaaattcctgaaggaaatgcccattttgaaatctgattgccccaccaatggactgtaccaaggtaaacctcttagcagtttaccacatttaataaaacaagctgttccttcaggtcttgttaaacagacagacagatggacgtacagtgctgaccagtctcctgtgttcagttcatgaaaagtgccctatgtccaagtggggagcatgagtcttctgcagttgcccctgcgtatttgttgcgagcctcagctccaacacatatgcccaattctggctgctcttccccttccttgttttacttaaagctacagcagcagctgtgcagtccaggtcaaataaaggccaccctgaccaagaaggccagctctcaaggggctgctctcttcttgggaaagccataaaaacaaaggccaggcaaccaagtgtcctttctaagaaggcattgccaaacctctctcccagaattactcccagggcagaagtcaatctcctaaaatagtacggggccagtggcgtttgaaagtttgaggccactgccaaaagaagagataaaggcagagagacctaaagattccctactaattagcaacttggaataattagggcagggattctgaaaggtaacagtcttctccgtctgaatattgtgagcccactaaaggggaagtattatttaatttaaaaacaagagggtctagagggagtcacattcaatggataagaataaaaacttgctttagtagaatttagcattagattgctgaagattgataacataaggcatttaataaccttacagaaatggtatcaaatgttctagattttttaaaattggagttaatgccctctctttattggatgaactctgctttttgtcttttcttccgtagtgggctaaaacaatcagaagcagaatcctgctatatcaacatagcgcggaccctcgacttctatggagtagaactgcacagtggtagggtatgtattcttgttatgtcttggctcaaacattatgtttttattttaatctctgagagtttgaaaaattctttgatgaaactatttctttttcattataacaggactttttaaaagatatttggaaggtttattaagtaatgctgaattttttgttggtcatttgtccaattgcttttttttaatgtttgcttttgtacttgaagacttttcccttttgaagggttaggggactagaaactagtaatttttgtaagaccattttatattatggttttaaaaggcaaaaaataggtataaattcatttttcaggtgacggtttaaggggccaagatttctactacttaatctcaagtgttgctcaaattggagatagttactcatatatgatagtttttttaaaaagattatggtgatataattgttaaaatcaataaatatttgaaattagttgtggctactttagtaggatttactaacatctgtcatctgtcaagcaatttctatgcaccagtggattatttcctgcggtaataccatgagttccatatgttatcattaaccccattttacagatggagaaactgatactcagggacataaccgaggtcacacagcacacaagttgtagcttcagcacatgacccctcactgtctaattagcatctgacctttgatcagtggcatacgttttctacctgtgattggtccacatcatatccaaaaggaagcaaaaattaattgagcacctactatatactagcctttatccagatgctttcatatgagaccataaggtctcaccttgtgatcatagaaaccttgtgaaatcgacattctagttattcccgttttatagatgagaaaaccgaggctcatagagattgagtaaatgatcagattttaaatctatgtattttcatagtttatagaaacactttcatttatttttgtttcacttcggtcccttgacagtcctgtgaggtaggcaagttgtgatataggaaataaggaaggaaaatggtgttagatcttacaaaatatcagctttgggacttgaccattcatttttattccatttgcaaataatattttatcttagatagaatgtttcagagaactttaattgtcggtgaagtagggctttatatctgcctgagttgagctgtgctgtcccaccccaagaactgtcagtgaaatgaccctcaagggctgtgaggccagatgatatctgcgtggcaaagacccccacagtatcagagggggttggtcatactaggctgttctacgtgaactaaaaacccctaaatctccatagcttcatatcataaggtttatctttcagtaattcaaagcttgcattgagtctaggagtcttccagggcagccctccaccccatccatcgcaataactcagcagtcgaggctgcttccatgtcatggccatctttccatgtgacctccatgtttgtcacaagggaacaggaagctgcagggttacacaccagctcttaaatgcttcagcccaaaagagacatacattcctcctgctcagagcacagtggccagaactagtcaccgagttctgccctctgcaaggggagctgggaaatgtggggttgggcctgggaattgaatagacagtaacttcctatgctgcaggggttgaggtgcatactgaaagaccacaggattaggagatttgagacctggtctttggcccacccaaaccattcatttgtttccttgttcactcaattttgatttcctttgctaatttgctctgtcacacctgcttcatactccctctgttgtgatctcaagtatcatatttaaatgcaattctacccttcatcaagcaaatttggttttgttataagcatgtgatttctgttgggtactgatagtgaatactgcctggactttccacagtatcagcactgttttgtttgtcccgtttctctaactccatgttcacattgtggttcacaaagggtttgtcccacggcaaaggggaatggacgtttcttatgtcttccacgtgccaaactctcttctagaagctccatatgccaagcccccttctaggttttcatctctcatttcagccagataaaaacgcttcgaggtgggttctgtcatctttattgtacaagaagaaaaattgagcctcaggagcccaacattatatagctagtaggtgccagactgaaggttcacactcagttgtgactgactcaaaccatgccccctctttataattactagtatctgggtcaagcatagtggctcacgcctttaaccccagcactttgggaggccgaggcaggaggatcccttaagcccaggagttcaagaccagcctaggcaacatagtgtgaccccatctctacaaaaatatgaaaaattagctgggcgtggtggcacatgcctgtagtcccagctacttgggaactgaggctgtaggatcacttgagcccaggaggttgaggctgcagtgagccacgtgtgcaccactgcactccagcctaggcaacatagtgtgaccccatctctacaaaaatatgaaaaattagctgggcgtggtggcacatgcctgtagtcccagctacttgggaactgaggctgtaggatcacttgagcccaggaggttgaggctgcagtgagccacgtgtgcaccactgcactccagcctgggcatcaaagcaagaccctgtctctcagagaaaaaccaaacacacaaaaaccaagtatctgattgggaaaacaagaaggtaaatgactcaagaggaggaactattttatttttaaattttatttgtactcaccttgttctcaaacttgtagcggctgtgtcttctgtatcctcactgtccacagcaatgcccagcacttaggcatgcataaatgttggatacactggatttagaagcaacgctttttttttttttttttttttttttttaaacagagtctccctctgctgcctaggctggagcatggtggcacaatcacggctcactgcagcctcaaacagcctcaacttcccaggcttaagcagtcctcccacctcagcctcctgagtggctgggactacaggcgtatgctaccacacccacctaattttttgtattgttttgtagagacagagtttcgccatgttgcccaggttggcctcaaactcctgggctcaagggatccaccctccttggcctcgtaaagtgctgggattataggcgtgagccacctcacccagccaacatttatttcttaagtagatttagagtcagcagttctacatgtatacattttcatcatcatttcaaaatagctaaagcctttacagtaatggaaattgagatttgcaaaaagctttgcaaaggggtgaggcctttctgatttagtgctgattgttgaaaatttaaagcttgagtgttcatgtaaatgattccgtggaatgagtgggcttatttggtaactttctagaccagtggcacccacatgttgcttgacaggctgtgttcactttagaagaatttggtactcagtacttcgatcttaagtatccgttaagtggggctttttgcctgttttcagtagcattttcccatttggagcctatacatatgactatttataacagcgtgggtgctttaaagtcaccagagggcataagcatgactgtaacatgctgtggatctgagatcttcctttttacaggatctgcacaatttagacctaatgattggaattgcttccgcgggtgttgctgtgtaccgaaaatacatttgcacaagtttctatccttggtaagtgcaaacagttctcattattttctgaatcatgctttaaaaatatgcctaacaaaagtaatgttacctcccattctaaatgtttatttctaaagaaaagatagagagtgcctcccgagttttactctgacctctaaatttggtccagatttggtacttaggaaaatttgagtttagttttcattagcattcccttcccccaactcaccctgtggtttgggatactctggaaacctggtggataaaatggcacaggcaggccttggcattaaggaatttttcctgggcagtacattggtcagaattcagagaagagctttctctgggcaggaaccatcgtttcatttctgttcctcggttattaactgaacctttaccaagtgtccagctctgttctaaactctaaagggacccaaagacgtgtacaactgagtgcttgccctctgagctcacaggcctggtgggaagagacctgtaggccagcctgtcccgcattactcgtgagtggaactgaattttggagagaagtttgagtttaatgtgccaggcaacagggagctttcttaggggaaacaccaccaaaataataccatctacataatggtaacgtgatggtgcaaggaatgggggtagcacgcattgccaggaaggtacaggagagtgagtgccatagacggcaggagatgcagatggaaaaggacaaacggggaaaaaacacggagttttggcaaaacagtggcagcaaggaaggaagttagggaatggggataagagaagatttggtgccaggtatgtgccacacagagtttgacctttgacatctaaatctgctccccaacttgggagcatagaatttcattacctgaaacacaaagatgttcatcacagcattatttataacaggaaaaaacctgcaagtaacttaagtaaaactatggagtattatataataatatatataatattaatgagttagtaatataatactctattgttatataatataccctatattatataatagaataatatatattacacataaatatataattatatataacaaaattatcgttattaatagcagtaattcttattgcatgcttactgtgtccaagtcctattactgtgtattttctttgatttatctcctttaaactccaaataggcactatataggttattatccccagtttcacggaggaggaaacagaggtacaaagaagttaagtaagaacctgtccagagtgacacagctaataatcagagtagttgaaactcacatcagagtctagctccagagcctggacttttgtttcaacactaaaagtggtatttgtaggaaaacgcttaagtagcatacatacttaatagacgctgttcagttaagtttcaatatatctattttccaaaaccaaaaaatgtgacgacagccctgttcaatttgacactgaaatcagtgtaacagatagcaggatcttctctccatctttcattcacctcatctcttttagaagcccctcagaggaagcaagaaactccagcctgcttggtgggctggggcgtgcccaggcagctctctggcccactcaggactaagatcaggctaagcagagggcacaatgggcatacggctcatttttctgcacccagcccctccagatgccgggggcttcctccaggtgccacaggcctaaagccccttgggtccagcctaactgtgaccaaacctcctaagggcccacagacaagggctggaccctcacattgtggagaagatgtgggtcccacaaggtcactgcaggagagagaagtgggagacttggtcaggagaagcaggtttgtgaacagaagcctttttggcagagcctgcagggactctccaacccccaggctcacccacagtcctgctgaagcctccctcacccttcaacatcaagatggctcctgtcgaggcctggcccctgcctccagtgtaaacctcagagaccagcggggagaccagcaccagatggtgaccccagggtgacaagggaggtgcatgggcaagtgcccaggaggggcaggacataagaagggccctaagcatgcagggtaaggcactcaccaggatctgaacaccagctgagctttggcccaaggaaaattctagagaagtggcagggtgtataggtccagagacaagagagaacccagctagtgagtcaggaggagtgggacaggccaggctggagctggccatgggcatgaggagcagcaggagaggggccaggtcatggagggcttcacgggccataggagcctataggctcagttcttagtgctcttgtgagactctaggcattcctgcatgcagtgctcacagttacagtgatttacttccatgcatcattctttatgtggttcctgtctccctcactggattataagcctctggatggcagtggctccatgtcctcttccctctgtccccagggcctggcatagaactttgtacatcctaggctctcagtgcattttttttttcttataaatgagtgaagggcagtagggagccccgctgaggccccaagcctggaaacgacaagagttcatgtctgtgcataatcagatttgacagctcagggagagagctgtcaggtggggaaattggggtcagcctgggaaggcgatgctgagctggagccctaggaaccacaggaggcctgccaggccctcctacccctgtatatgaagccaggggtggggggagtaagaggtccacagatacccatgggccaaacaaggcaaggtaagaactcaaaaggggagttgattctcctgactcgttctgcagaacaggaatttttgcatctgccagttggcacaggagaatcgtgaggagactcccccgacttcagggagatggcagagcagtaacacacactaggaagagtatctccagaaggggtgagcccagacactcttctcatccttagactattaacctgtagtcaccccaaaaaatttacttcacagttacatctaccaacagatcgttgaaaatagatgtgtattaggtaatatctaatatgtaatagaggtatattgctgatccatctgggggatgtcccatgaatagttcaagtttcgttttacctacacagcctctccattctagaatgttctaccaaggtctttgtatgatcctagagaatagtaaaattccttcatttccccaaagtatttcagaagtaaagattccagcagagaaatatgcaccctttgtatggattacagaagttttgcataaatgaatgatagtcagcccttggtgtacttgggggattggttccaagaccacttgtagttaccgaaatctacacagacttgtcacacagttggctccgcaaaactcgtgtatttgaaaagccagccctttgtatatgtgggtttcgcatcctgcaaatactgttttccatccatgtttggttaaaaagaatcccccagatagtggaccccacatagttcaaacctttgttaatcaagggtcaactgtaaatttattttaaaagttatgtttttaattaaaggaacaagcattgcaggcctactgtgtgacaaggtagggacttgacattcctactctgcttgaatcctcacaaggccgctctctgagaagggcagtgttttcaccactgttgggaagacttcatagtggagagcttaggagcacaggcttcagagtcagctgagaccggggtgcaggtcctggctccaggaatttctagttgaatgatcttgagcactttggtgatgtctctgagcctcagtttcctcatctgaaaactgggtataacaatatgtacttttcaggattgttgcagggcttcgttgaggggatgtttataaagctcttagtagcagcctagtatctaaaaaatgttcagttaatggtgactaaattctgttatcttgcaaatgttaagtaggctacttgacacgtggctgttaagtaatggagctggggttcggaccaggtctgtcctctttcagctgctccatgctgctctcagctgtcttccccatgtatataccagctcacgcagagctgcagtgccacaaaagcagcttatagcaaagagagcgcatggcctatgtttcttgttatttaaaagctacatcataatccagtggcccttacgcagtgctcagcttcagtcagctacttggtattagcctgcggcagtggggctgccatcatttctacagagaagtaaactctaggcagccaagagcccccactcatcaggatcatggagtaaaggacatgcattgagaggcatcagcttcaacctggccgatccctgatgtgctttgtttgtgttttgttttattttttgaagggtgaacattctcaaaatttctttcaaaaggaaaaagttcttcatacatcagcgacagaaacaggtgagtagttatgtctttgcttgctttgtttcgtgcatatgtatgtgtgtggttagagacagggtctcgctatgttgcccaaactgagctcaggggatcctcctgcctcagcctcccaagtagctgggactagaaacatgcaccactttgccccatttcttgtgtttttaagttacttcagcttttagttctttaagggttgaaggctgtttgctatgtatgtatcagggaagaaagagcatgccattgtggagccagagtctggaggatccagtgattgtctgtataattctgcttagctggttggaggattaacttgctttggagtcagagacagtggtttcagatcctggctcttccacttaccagctagccaggttacttaacgttccctagcccaagttaccttgtttccagaaattctataatgcccacttcttagggaattgtgaagattaaataaaagaggattggtcaaagcacttggcagagagcccaccacaaagtaacagtgaatgtcagcaaggtcagttccctcccatgatgtgttgaaactgcacgatggcttggtaggtgtatatatctcataagcaaagtccatagcactgtgataactccatttgctcatccatacagagatgtagaacttagaggagaggaaactgaggctcccacagctagtgagtcaggggagctggaattttaaccagatcattacgaatccgagacacctgctctttccacagcactacacccttatctttttatgctgcatgattttcacttactgtcactgtgtcaatttcccaatttttcaaaggtaatatatgcttaaaatggcctcacagagccgtgaactcttaggaatgaggacacaaaagctcagagcagctaggactggaatctggatctcctgacccctcagtgcaagattcagggtggcacaaaaatgtataagacggcaatttaacatgaaaacagaaaacctaaactcatgcagaatgcaggcaaagcaaatgattaaaatgattattacatatgagcactggattcaactctgtgctttgtggaaagcaaatagagaaaaacccaaagggttataaacttgctgttgtctgatagatgaaagagtattccttcaggagagagatgttcccagagttaaaatttaaaaggagtgtatcagacggtttttatctgattgctccaaatgtatccagcctagaaatgtaaatagatttgaaataaaagcattcatgaagaagcgcagatgatgataaagaatagattctggtcatctctattaccatgttcataaagacggttaacaaatcgtgctcttgaatattccggtacactggtttgtggccacggcattttgaaaccagttttctgctgtctgttgcatcttacctcatttcaccaatgtgggttaaatgcttacaagtccctgctcctatgtctgtgtgggtgaaatcttgactgtttttcctcccaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtgagtgtgctgtaaagactgtgtccacactaggctgagatgtaaatgcatcctggtcatcagtgaatagaggacattgttaggcagaggaggaaacccatagcccaggggctccaggcattggatctctgaaccataactaaaagtctcccggggtcagcagtgtctaagggatatctcatgttcccagcatttctctcccctcaactctgctgaactcagcacttccaagcagtcagaatggcagctgtaccctgcaccatgacataataaaggaaatggagccatggttctgtgtgtctcctggtgccagcatactgggctatcccagtctgatgccactatgccagcctctcccacagaactttaattccataagatgctctataaaaatgaatgaaggaatagaaaaacatttccagagtcaagtgactttgggatatattgcctataataattacaaaataacagtagtaatcacagttgataattactgagcatttactttgtgctgggcacataattatatttgactcttacaactctcctatgagataggtactattagccacaggaatgatattcaaaatatttaatgactagtacaggaaaagaaatggatgtaaatttatatatatttatgtataaatatatataatatataaatttttaaattctaatttagattaaaatttattctctaaataaaatgatgtacagtaaaagaaatggatgtacattgatatatataattcatatatacattttaaaattctaattaagataaatttattctctaaatgaaataaccatgcagtttgtatttttgttttctttgttctaagactaccctctaagtataagaggtagcataaattgtcaatttattcttataatttcttttttctttctttcttttcttttttttttttttttgagatggagtcttactctgtcacccagcctggagtgtagtggtgccatcttggctcactgcaacctccgcctcccaggttcaatcgattctcttgcctcagcctcccgagtagctaggattacaggagcacaccaccacgcctggctaatttttgtatttttagtagagacagggtttcaccatggttggccagcctggtctcgaattcctgacctcaggtgatccacccaccttggcctcccaaagttctgggattacaggcatgagccaccgtgcccagcctattctctcttttttgttttgttttgttttgagacgaagtctcactctgtcgcccaggctagagtgatctcggctcactgcaacctctgtctcctgggttcaagtaattctcctacctcagcctcccaagtagctgggattacaggtgcccaccaccacgcccagctgatttttgcatttttagtagagacagggtttcaccacattgggcaggctgctctcgaactcctgacctcaggtgatctgcctgcctcggcctcccaaagtgttggggttacaggcatgagccaccgtgccaggccatattttctaaatcatttgttggtttttcaaaattgttttcgtgatttgttgttgatgtggctattactaactaaatgagacccgtgtctgagccattatctttctgataggtggaactgcatcagactgttccagttactttcctaatacattgataatcattagggaacttgtaaactgaataagtagctaatttctgttagtatcagtgatactatttgtggtgctaaatgctatctctcagcttctgatgaaccaagagtgaatatattaagtttttagctcttataatactgtttagtatttgtatacattcagtagatctactgttgagcaagccatgaaaataacttactggattatatcattgacttaggttgggcctgatcctcaggccagatgagagaaggaatggggaggcaactgaaaccatgccctctgttgctgagctgcctgggttcaaatcctgcctctgtcacttgagctttaatttgttgcttctatttcttcatctgcaaagctttgtcatctgcatgcatccaatgccagcagggctgggttctggtcttgtattgtggcacaagaaaatacccctattttggtgactgaaagcaacacccattctgttatatctcatgactttgtgagtcaggaatcctagaagggcttggccagaggcctcttctgctctgtgtggtgtagatagggatttctcagtgaatgtggccagaggatccaagataacttctcttgcatacctggtgtcttgatggaatggttggaaggctggactcacctggactccttagcatccccatctggatactccaggagggtggttgaatttcttacatggacactcagggttccaggagcgaaaggcagaaccgttcagccttcttaagggtgagacctggcactggcacagcgactctgttgctgaaagcagtcacaagccaacccagatgcaagactcaaagaacttgcagtcatctttaatctgccacaggggatcatttgggttgggaggatggcttgggaggacaagtcagcagttcttttactacctgtgccagcttcagcatactggtgaatttcaagtctcattacctccattttacagatgaggacactgaggcttagaagggtcacatgacttgcccagcccctagagatacagatacacatctgcttattgggccttctgaaaggttccacataaaaagaaatttgttgggttattttccaagcttatgggacaatggaacacttttttttcagagagtccctattaataacccatgacacattaaaccttggagttgggcagtttgctccccttgttttgatcctgtgctcttcatcactggcagtgtggtttctgatgtaggcctgcctcagaggaaagagtctcccagtgatgctgttgtgagcattttgatcagggtgacaacagcatttcttaatgtgaattagtacatgatgtgctacagggcgattcatattgtttatgttcttttgtttgttctttgttctgttttgtttttgttggttggttgatgtcatgtcacaaggaaatgtgtagaatgttttcataagacattaaatcctagtttaaaatttagagatgccagaaccaaagttgtcaccctttaacagggtgacaggcttcatgctctattctctcaaataattcattctctgaggggtctagatagctaagatttaaattctctaggtataaataaaattcaaaagtaaccttcagggtagcacatttcaaagaacgtagcctgaaactctgtataattttttgtttttggagacagagtcttactgtgttccccagactggagtgcagtggtgcgatcttggctcgctgcaacctctgtctcggggattcagggggttctcatgcctcagcctcccaagtagctggaattataggcatgcgccactatacctggctaattttttgtatttttagtagaggtagggttttgccatgttggccaggctggtcttgaactcctgacctcaagtgatccacccgcctcagcctcccaaaatgctgggattgcaggcatgagccactgtgcccagtttgaaactactttctaagcgcattttcagattctctctcaaagatttaccagtgatttatagtgacagctcctgccagctaggatgatgaagagcacctgaaaaaatggttaatatttttacttaggccagtgtgaataaaataagaattccttgaaatcactggagctgtatttctgtgtgatcctggaattccttctaatctggttaggtttggttatattctggaaacagctttgttgcttgagtagtgaggacaagaaaggattttcacccgaagagaagaaatcacataaggaaattccaggacagacaggaatcgcttttgagctgtctccctctactccccataaccttggcattaacctgccgtccttcagacaagaagcatgtgtagactgtttcacacatgcagtaatttctttcctgttgaacgtcagtgtagaaagtgaacctgcatctggtttttcaggtcggtaaataaccaatattgcaaaaaggtgattggcgggatggtgtggaacccagccatgcggagatccttatcagtggagcacttagaaaccaagagtctgccttctcgttcccctcccattactcccaactggtatgtcctccttttttttttttttgtactacccaacagtagacactttatctcttttaaaaataaaaactcaacttataaactcctaaagatagatgacctacaatttgcattttaggctcttggcagaagtaactgttttcatgaagtacacaagtctagctaaatgttttccatcgtgtataatgctgagatgctctttttaaaaaaacttattcaatctaaatagtttgggaaactcgagcctgctgaaaggcctcctttggaatcacagcacacattagcatattaaacactctgagacgtccaataataaaaaagtacggttagctttacttaattcatgttttccattaatatcccacaaaataaactttagggaaaactaacgcaggtacgtgatgtaaatgatgtaaggatgtatgaccttcagcagcagaagcaaatgcacatcagtaagtagcaggccaacttaagaggatggactcagcttaaaaagaaataggtggtcgtttggtaaagtgagaagggcactgggtttgtagcagaaagacctaaactcaggttttggcccttctgttaattaacaagtttctttacctctgtagcctcagtttccccatatctaaaaagatgataaaaactaccgcaaatgaaataataatgtacaagtacgtagtaagcttttaaaagagtcaggtggaattatcattatcttattataatggtcctcaaagacatcacaccatttttgtgaatacctccaaaaaggctaggggccagaggggaaacctagcagggaatcattgcccccagctccacactggagtaagagtgcgtggctgtaaatacctgatccaggatctgctaagcctaagagaaactgggagacaggcagacagaggagatgctgtgctgggcctgctagggaaggaccccttcactgggggcctaatgctctgggaagggacagtgatagtatttagtgttagaaatcatgacgtaactgaatagatttgcttcttggtttccaacatttagatacctcattctaaagaggtaaatttatgctataacacagcagcttaatttatctgaaaatctcatcggcagcaatgccaggggcccagagagcccaggactggatccaggggaacagcggggttggatgttgccacactcgtggcccggagctcctgtggctatttataggtcctctcctgaggagtcacaagagcctttttacttctgctttggacacagcattattgattatccaggcccagggggattgcaaatcatggaggccctgacagtcctgaggagaaatggctaacaaagaaagggaagatggaaaaactgtgagggaaaatagaacttagaaagcttggcagcttgggatcccccgctgcaggagctgacgcccaggtgccacactggatgccctgagaacacggcctcattggattcattctcaggagcaggtaagtacagccgaggcccagagaggtgacgtgccttgcccaaggtcacatgcctactgccactgttggaggacagtccagtgtttatatgcccatctaatgcatataaacgtgtttaataagggatatatcttaaaaagcaaacattttctcttggatcaagtgaaattcacatgaagggatgtcgttgaaataaggttggagttttgctgagaaatgtagtttggcttctaacccttttgtttgcattgttcaaattaatcagaaaaattatctgaatagcagtccatatggcctatttatgttttgagagcttgagtcctcctggaagaataacttacccttaagtcaatacccgtcacttcccaaagggcataaacccatctaattctgcctgtttatacagctgaggctactgttttgggagccaccacttgactgagagtgttagggatttgtgtcacccttggtgccttctgctggggtagtaatgagttaaccggctctgaatgtcagcctccgccaaggaaggcatccttagaaaggtcaggacacgaggttcactggtgtctaataaaatttttaagtggaatttgctttgaacactttgcactcaacgtttttcccacccaggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagtaagaaactcgtgttgttttatttctgggtatttgctttttggctgttgcggaatttgctcaggtccaggttgccatttgagaggaaccaagagctggtgcctgcagccagctcccacaggtgccttctgccaggataagaacataaatcagactctaccttttcacccggaagacggtctatgtgcctggggtctagagcttgtacttctttttgtccacgacaaagacttcctagtcactaagtacttgttagtctcttgaattagtctcctctccagctcacaagcaaagcccagtttaatcattccctgttctggaggtacagactctagggccatgctaactctgatttctctagattattaaagttttaccatcacatgatttcaaatcattggaaatatgcttgcttctaaaagccttctccgaacaacagggttctgaggggttttgttttcaattaatagttagtataaagaaacaaacgttagaacatctctaattttctttgagaaattttttgttaaatttttatgtcctacctcccccaccccgcttttttaacgtgacagagttccctcatagctcaaggacagaaaaaatgtctgtcctgaaagatggttgagtgcttttgttattcaataggatatatttaacccatttgtttccctttttgccttggttaccagggagttcagaactgcacattaggctcaattgtattcacttccctcagcccagatttcttgtataggaccttctcttcctcatttgcctttgttatatgggtcttttttttcttattttaatggattcatagttacatatctgtacgttttggggtaaactcgcaaatcatttttttaagtaggtaagacatagattataaattaggttaaagcatgatagtaaaggatcaactgttaggaaatcaaccatagtcattgggtatctattctgttaagccccatactatttctaaaatatagtaagataatggcccccctaacagctgaggattagcaagcaggcacgttagttaatctgtaaattttttaccactgtagctattaggctgaaagcatcaaatgcaccctgattggactccaggcatttgcaggtgaattgcaaatctccttcccatttgtatgtgaggctgctacctctcctctgtccttgcccacagcaaacatggtttccagtttatctgtgttcttaacacctctggttaaataatccctgtggtcattctttccttgtgacctgagcttggatgatgcttttgctaaatgattgctatctcttgttccaacttgcagcctgctgcccctttgtcagggctacagtggatgattgtgagttcctttgtgtgactttgtagcttttcaaaccacaagcacatctagaaatacaaagcaggagtgcaggcatgcgtgactagagccgttttgagtctgcagtgggggctctgcggctttggcaaaaggagaaaacggtttagggaagcgttggagggctctgggaagcccactcacacctgctgcgtcagagcttcctgtggtggtttgcagtcccatcacagaattgtacagcatctaaaccttccctgtccagtacagcagccaccagccccagttgtctattcagatttaaattaattaaaataataaaaatgtaggcattcagttcctcagtcacatgagcctcatttgaattgcttgacagccacacaggagtgttggcctccatcttggacagcacagatacagcccattcccatcactgcagaaagtgttgtcagcagcactcatctagactaacacgtttattccatcgttcatttaaagggtgaacccctagaatatctacaagcgaaaagtgcatttttcacacagaattcatgtgggagtaggtttggaatcatcaccttgcttgcagtctgggcgctccacaccactcacccagctgctcatctgtggcatggggcaggtggatagcctctgagtgccctcacagcccagcaccctctgtctctttatgcaatcagtgccaggtggggagggatgcattctgtccaatgacatgcaggcactttagagggcttgcattcattcccaagtccagcggcacactttatacatccttggctggtcattgaggggaacaccggagcaaatcagagaagttgtttcaggagcctccaggccagctgggcaaatagcacattatcagcctacgctgccacactccagggctctgtcactttggtgaaaggaaaaggggggcttagggaacagtacgtgccctacatcagattttcctcctgtggtctgcagtcccatcacagagcatctagaccttcatagtccaatacagcagccaccagctccataggactatttacattccagttcattaaaattaaataagatttaaaattcactccttcaagcactgtttgatgtaagtgatttctggccctgcttgttcctatacattgcacaatgagtcttcttgaaacccctccttgagaccttgtaaagtgtgtcatcttggggctctttttatcttgcagctaaatgttaagaatagcaaataacagtggttcaaaggcaggcttccttgtggggttttaccaggtgcactgacaatagacatgtcagggggtcaagttagtgactgtgctctgcaagtgggatgaacagccagaaaagcagcccccaccacctctgttaggtgggagacctcttcctgccggtgggaagccactttgtgctgggtcttcagaggaggctggccctcctgagggtctgggaacccccattgctccaggtaagaagtacagactggtctgtacctggtgagagaaaaaaagaaaaaaaaaaaaacctgttggttagtttctgtgagtatttgcaaaatgtttacaaaatatttgacatgttttatacagcagatttgtgttaagaggcaaaaagaagcattctgtcagagaaatcggatgaataatatcacagacagtgaggagggttccttttaagaagaagaattaagtgcgatgttctgtactcgtttaaaaaagaagaaagagagaaagaaaaagagcggttagatttggctgtaaacccagagtggcgcagctcaggctgcctgagtgccatcttagcggatgagtcacttgctggtttgttccgtatttatagcagcacagcaaagtttatgattatagttatgaatccttggcagtttgctttgtgcccaagtaggctgcactcttttgttgctcccaaggttctatcagccattgtgtgttcctttccctgcttccgaatgaagaccaaattctgcagagaagtaagtttctttcatggcagaaatgaaaaagctaccactctccacccagataaaagggagagaatgttccctaaagaaagagacatgcagaacagaaactgggggaaacacattgtagagcagtttagagttgtattagaaaaactttctggttgctattttatcacagttgtcttgatgggtcaccagcatgacaccctccgagtggatggggcttcatgcctgcataacttcttcgctgtttgcctctttccttagagcctgccttcttccatgggatttggggcagccattgttttttatttcaaaaattctgtgctggccagccatagtggctcatacctataatcccagtactttgggaggccatgctggtcagattgcttgatcccaggagttcaaaaccagcctgggcaacatggcaaaaccccatttctacaaaaaaatgcaaaaattaggcgggcacgatgttgtctgcgtgttgtcctggctgctcgggaggttgagatgagagaatcacttgagcccaggaggtcgaggctgcagtgagctgtggtcgcacccctgcactccaggctgggcattggagtgagaccctgtcaaaaaaaaaaaaaagaaacaaaaaaacaaaaaacaaaaaacttctgttcattggaaggaacctgggggatccccttcttcagctttggcggcagtgtaggaattcccccagccctgagagccctgcgagcaatggagagtcccctacagtgcagctgtgtgctctgtcgttagacagcccaggtgcccactgttcttcccaagctgtgctggaagcctccttgacgctgacccagcatcaaggttcctgccttgaactctcaggacaacacagatggtgtctgttcccagttccacctgccagccttggttactgttccttaagatagacaattccaatgtagtcactttccacccatcaccctcgtaaccaccattctccaagtgcaaatgagccttctagagggtggcactagatctgaatgtggaggaaggatctgcataccattctacatgtccccctcggaggacaccaggcagggacagggttttgttcagagtgtttgtgtcccttttccttgaaccttgccttcttgtttgagtccacttgcgtgtagatgtctctcagatacctgaaacccaatatgatccaatctcagctcctcatgttggtgtccagcccatggctgttcctgtgtcttggtaaggggggccattgtttcagtacttcccagtttgcacctatttgaaacatcagtcgtccctcactcctccttttctttcactgtccctatgccatttctcatcgtgttgattctacctcccagacatctcttacatttgactcctccaccatccccactgcactgcccccatgcagccaccatcgtctcttgcacagtctagctcagtcatatccaaatcgttcccctgtctttggtgtcacctccttccacaccatgcttcacaagaatagcaaatttatcattctgaaatacacatccaagaatgtcacttcctgcttaaataccttttctctgctttttcagcatttcctgcctttacctgtgctactgcttttgtttgtgtgtttgttattatcagtgttttgccagaatgccttttttcccacttgactacctgttcaaactcctattaattcatctttcaaactcaagctcaagtgcacctgctccaggaagcctctcctggccttacacagtaccctagacatctgagcatctccactgtaacatgataatattattacttggttaattgtatttcttctcctttggacagtgaattctttgagggcagggatagtgccctattcacctctccttccttaaaacctgacatggttatttggcatttaatagacattcagtgactatttggatggatggatggatggatggatggatggatggatggatggatggatggttggatggacggacggatggacggatggacggacggacggacggacagacggacaaatggttagatgaaactagatggggccccgagatacaaactcctaagttttcacaatgggatgccccctctgccacttccacatcatgtgtccatatcacatgagcaacatcacaccatatttatctgtaccccaagaactcaaacatatttactttgacaagtttggtaactgtcacctgtgagcaggactatgtggtaggtgcccctgcagggcatctgtcaatgagaaattctcctcagagaattcagggatgaattgaccgaggtttagcaagtgctttcttgccagtgaggtgtctgatatctataggggaagcctagacagattcatgatctgttgttccagcaggaaagactgtgagctcataaagcaccatacctgaaccatatcccctctgccactttgatcttgtgcccttggcatttattacagccccagatgagctgtttcctgtggtgactgtctccacatcataaaaatgtgtattggaagacagtcttctttctgttactcaaggacccttatgtgaggagccatgtgggaaatttctccaggaattttattcagaagaaactgtgccctctgggtgaactggtatgagttcctctagcgccgtgctattccagctgtggccacaggccagcagctgcagcacctgagagctggtcggaatgcagaatctcagacccacacaggcctgccgaatcatactctgcattcagcaggaccccagctggttcctgtgcacagcacattctcagaagctctgatcttgcagatgagaaccatttaactcgccttcactttgcacctgagcttccagattcctgagtaaattccttgctcttttagagtaactcacccaatcacctcgggtgatcctcttggtaccttgccaagaggctttattcttcattcactcagcatttcagttgagtactccctgtgtgcctggtcctgtgttccgagtactaggagaggaacagaaagagcactagggtctcctgaccttgagaagctcccaaaacagggcccctgttccatcacaccacaatttgagagcaggactttgcctcctttcacaggcggcggggcggggaggtctttaattttctagggtttagggagagcttcgtgcgggagtgtctctttcttgggagtgtttctttctgatgcctgctgcctttacagttcagaagcatgtgttttctggagggtgaatacttgtttgtctgcctgatggtcagtctgtgtctcacatttctctgtctctgcccctttctccctaagaaccaggatgtggtcagtcccacactggctcttccatggtgtcttccccgtcctgcctcagggacaaacctcttctgctccttcctcccccttgtcattggctccatcccatcctcaccatcttcttgcatccctcatcctgcccctttcttcactccacttgtggaattcatggggcaactcccctgcgctcctcagccgcactgcattctgcccagcgacagaggaggcactagggctttggtgccttcacccctggccaccctgtgctgtggccagctgccacttactcattgcatctcctcatttgatgtcctcttcctcgtctgtctgtccatcttgcacactgaacagaatatcaccgcgccctacagagcacctgtgtacacagttgagcaggccaaaaatcagccatttgttgaaataaatgactaagagtaacccctccaaccctgcttagaaaataggttagggcaggccgggcacggtggctcatgcctgtaatcccagcactttgggaggccgaggcgggcagatcacaaggtcaagagatcgagaccatcctgactaacatggtgaaaccccatctctactaaaaatacaaaaaaaaaaaaaattagccaggcattggtggcaggtgcttgtagtcccagctacatgggagactgaggcaggagaatggtgtgaacctggcaggtggagcttgagcttgcaatgagctgagactgtgccactgcactccagcctgggcgacagggcaagactctgtctcaaaaaaaaaaaaaaataggttagggcataaaatgacttggaatatagtattagtactagcagcaatagtaatagtagtagtactgttgtcatttagtaccatgggctagtttagacagaccattgagttttaaatcaaaaaagaaaaatagggctggggatggtggctcacacctgtaatcccagcgcttagggaggccagtgcaggaggattgcttgagaccatgagttctagaccagcctaggcagcatagtgagaccctgtgtctacaaaaaatttttaaaaggctgggcatggtggctcacacctgtaatcccagcactttgggaggccgaggcaggtggatcacgaggtcaagagatcgagactatcttggccaacatggtgaaaccctgtctctactaaaaatataaaaaattagccgggtgtggtggcgggcacctgtagtcccagttactcaggaggctgaggttggagaatcatttgaacccgggaggcggaggttgcagtgagccgagattgcaccactgcattccagcctagcaacagagcgagactttgactcaaaaaaaaaaaaaaattaaaattagttggacatggcgaatgcctgtggtcccagctactcaagagaccaagataggaagatctcttgagtcaggaaatcgaggctgcagtgagctgtggtcatgtaatggcactccagcctgggcaacagagctttaccctacctcaaaagaaaaaaaaatggattgggggggtgcagggagggagagagagggagacagaggtagagacagagacagagacagacagaacgagaactggaaataccattttaacttgttttgtaactgccaagcagttgccctttctgccactgggtgatgctcttgtaaacagtgaaacccagcaaagatgccgtatttggggggaattttgtaaagcttccttttacgtaagtgaaagtcatgctttttcaatctgaaaacttgtatacaacttcaattccaaaatactctgtctctgaaatgccttcccatccataacaccctacccccaaccagccacttggacaccataaggccagactcttgtcctactgtatcgctgtgtttctccattggtctgtcactgaatattttattcaaatagattgtgattatgaatcattctgtgtgactatgatacagattttatatttaaattaggctcatttaaactcactaggagaaagagaagcaccaatttcataaaaaatccatggataagggcttgaaatgaaggtcaagaaagaggcagtagcagctgtcttttgtctgggtttcactgaatgacttggtctctgcgcttctcccctcacttcactttggatgaggttagggtggggcagagtcttagaatgtaggagagccccatagtcatcagctctgtaaggtgtctgtgctgggcctgtggctccggaaggggctggtgtgggtgatgcagagactcaagggtcctgtcctgtacagtgacagcagggatggttaatccctgtgactctgaggggttagaaataggggtcttggaagtgggctctgcatggtctggagagggaagaaaggcttaggacgcacatcggtcaggtttctgtctgctaagccgggggaaagccatgtgaccctgggcaagttactcagcctctcctgacctcagcttcttcatctgtgaactgggagttagaacaaatgaccacaaagttctgttccgttttcatcatctgtaactctctaagacagcgctgtccagcaggacttcctgccgtggtgaaatgttctctgactgcactgtctcatacgggagccactggccgcatatggctagtgagcatgtgaagtatggctggtttcttgtcttaatttatttaaatttaagtagccacatataactagtggctaccatactagacagtgcagctccacgatacagaagaaactatattcgatagaggaaaatgtaacaagatctcagcgtggcagttcatggatgtcacaggcaaatcatgccaactaggaataatataaattctcctgaacgcacaacaacaacagtcctgtttcctttgaggaggcaagagtcctatgaagcagaaccatccgcagaagtgagacagaaggaaaaaagctttcagaagggatgggctgtgcatctgcatgagcttgcctggcagagcctggttcagtaatgaaaccaccagaggagctggacacatttccctgtcacccttctaaagcagcggggaagggagcaaagttttcagcagtttccagatccaccctgcctcctatcccttttccccaaaaccatgtgacagtgtctaggccagatgcggtcaggggtggtcagtgggccctgggtgtactcaaatcccgctgacaacctatgcagctgaggttccagggaaacatacagcccccagctgccaggcccctacagtcagtagtgtttgctctaataaaatattaacccagttattaatatctcctccttccccatgatgaaggagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaaggtgagcgagcgcaggcagccgggtgatccacacacccagggcttcccggcctcttgtgggcagctgagtagctctaactaaatgaaaatatcttatcaccaactgctggagagagatgtgatgcaaatgaccactttcaaaccgttttccagaatgataatggtgacagctacttagtcttgatccgtatcacaccagatgaagatggaaaatttggatttaatcttaaggtatgttgtgtatttataaaggaagttttgtgctgggaagcaatctttcaatgagtttttaatttgcattacaaatgtgctgcattcctgagctacataaggaagttggttcaaccctcagaattgagagttgggggttttttttgtttttgtttggtttgagatatttggggttttttttgtttttttttaaaaactcactttatcgcccaaacctagagtgcagtggcacgatcgcagctcactgcagcgctgacctccccaggctcaggtgatcctcccacctcagctgggactatagggatgcaccaccatacccagctaatttttttcatattttttgtagagatggggtttcaccatgttgtccaagctggtctcaaacacctggcaatctactcactttggcctcccaaagtgccgggattacaggcgtgaaccaccgcacccagcctagaattgagaggttttttttaatgtggccttaacagctgccgaaggccaagtgcctgctctgtgcctggcattggctatccactagattcatagcaccttcttaagttctgataacaagtggtaaggtcagtatttttaaacccattttgcaaatgaatactgaggttcccagaaatgagggcacacagttggcaaacagatctacccacttcaggaatgctattaagagaacccctcagcattgctaaagctgataagagaaaaacaattcaagttcaacctgcagggccaccactctcctccaggcacctttaagcaggatctgcaaactaaacccacaggccaaatcccatctgtttctgtaactagtttttttggtaacagccacagccatttgtttactggtgggttaatgactgcagagttgagcagttgaatcagagccctcactcccacaaagcctctctggccctttacagaaaacgtttactcatccctactctaggacaaagtgagggcaggtggtcgcctaccccccagctgccatcatgcacagcctcatctgccccagcagctgtgttgaggaccagcgctcacaggccagatgcgctcacagggtgtgcccccttcccaggcctcgctcgcctctgctgaaagcccctatatatatatatataaagcccatatatatatatattaaagcccatatatatatataaagcccatatatatatatatatatatattttttttttttttttaattattataagttctagggtacatgtgcacaacgtgcaggtttgttctagcagcactcgaagacatgctgtggagtccctctctgggggcatctgcgtttttaaggaggagcttctctctgagtgtatctgttagttcatggactgtggggatggcagagggaggcttctgaacagagtcctggtcagcccgctggatccagaggggtcaggaatttgttccatatttctgaaatgacgtgtgattcgaatcagtcatagtgaagtttgaagcctccctgtaccaaagactcacatttattggtacctccatgttgttgatgctgtgagctactcgtttttttgtttgtttgtttgtttaacttaaaaaactttgttttgtttttattttaaaatgtttacagggaggagtggatcaaaagatgcctcttgtggtatcaaggataaacccagagtcacctgtaagtaaatacattccatgttattcctcgtgtttgtttgtttccccctaattctaacaggtttctgtttctgagtcctgtttctttttttgccagagcaaagaatgtgcttagatatacatcaccatgttttctataaccttgcggctcagtgtggtctttgaagccatagcacccatgttacctgggacctcattagaaatgcagcatctctggcctcagcttaggcctgctgaaccggaatctgcatttttaacaagagccttgagtggttagtgtgcattcaattttgagaagtccttttcaagagaaggaaacttaggcagtctgctgttctgctcactctaagtgggcacgtgggccctgtgcctcttctcaccatctttccaccagtgccccttttgtcatctgtgtaggcctcctaagaagagcatttgctttgtttttctttcaaatttattttattgtttttaggccaggcatagtggctcacacctgtaatcccagcactttgggaggccgaggagggtgaatcacttgaggccaggagtttgagaccaacctgcctggccaacagggtgaaacccatctctacaaaaaatacaaaaattatctgggtgtggtggcacacaggtgtgatcccagctactcaggaggctgaggcaggagaattccttgaacccaggaggcagaggttgcagtgagctgagatcacgccgctgtactccagcctgagcgacagagtgagactctgtctcaaaaataaaataaatttattttattgtttttaaaataatatcaagtaattttttcgtttaatttttttattgtgcatactcaaggtgtacaacatgatgtcttgttatacatatagtactgcagtcaaacaaattaacatgttcatcactttccatagttaacctatttttcttttttaagagacagggtctcgctcttgctctgtcacccaggctggaatgcagtggtatgatcactgcagcctcaaactaggctcaagcgatcctcctgcctctgcctcccaagtcgctgagaccacaggtgtgtcccacctcacctggctccatagttaccttttaatcatctgcttttttaaagcagtaggagtcactgtgcctccttacagtgaaccacgttgggattttactctgaggtagtccttaagctcttgtcatttaacttttgttactgtttacagtttctgtaaattcagaaggctttctttcctgtgctgttcaattcattgcttctctccataatggtttttgcctctgttgtgaagcttacaaaagctttcacctttgcaagacagataaatactcacctctagctggcaaatcatttcctaacagtacatctaggaaacaaaaggctggaaatggtatagttatattataataagtgaaggttgactaccacggagaaatggcttcagcaatttttatatccttattctgaaatgtttcataacttatattctgagcagtacttctttatatcttacaaccatctaccatgtccacatagcagtggatgcattatacaaataatgacagtactacccgagggagagaaggcaaacttgatcatggtcccaggtgtctgggagcagagcgagtcagcgttcttcccccaaggactgtgttatggtaacaggagaaactcgcttttccccaccacccaggcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagaggtaatggccacctggggggaggagccatagggaagctgtcctagccaagctgcgcctgctccagccctttatctgctcttgaaaatgttgagtttgtagccaacatttgaaaatcaagaatcttcaggtaataaccgaatgtttggcttctcacttgaaaaatgtgaagatctgcccccaggaggcctgtccccatgtggccagtcttctggggggagacagcgcccctgcagcccctttatacaggacatgagcccccagctcccagttcctcccaggcccagcgcagcccacatcacgcactctctaagtggcatgactctgcagacatttgcattttcagccccttcttaaaggatctggtgatattttattcgtgcgtgtttgattttgtcggggaggcagtgaggagagcagggtctgactgtctcgggtgattcctcactctgcctctgcgggctgggggaccttgcaggggttacataaccagtctgtggttcagctggctcaggtgtggaggaggacagcagtggtcccgacttcacagggttgctgtgaagattaaatggcacttggggccaggcacagtggctcacacctgtaatcccagcactttggaaggccaaggtgggtgtatcacttgaggtcaggagttcaagaccagcttgaccaacatggtaaaacctcatctctgctaaaaatacaatagccaggcatggtgccatgtgggtatagtcccagctactcaggaggctgaggcaggagaatcgcttgaacccaggaagtggatgttgcagtgagctaagactgtgccactacactccagcctgggtgacagagtgagactccatctcaatcattcaatcaatcaatggcacttagactggaaagtacctgcattgctgcctgatgggagcagaggtttgaaggacagcctctactgagcatcacactgttgtctttatagttgttgttataaaataatacgtcaagttccttgaacaccgtgcacagctgtaaaatactgaaagtaaatgaaggttgtgtctgcaaagccctgcgtctctgcctgcctcacacgtttggctgacactccatactgctgtgctcctgcctcggctctgctcccactgcaactctcagtccagagccaccaggaccagctctgaccccacctcctccgtgaggccttaccagatctctccggttccccacctgtgcaaggttgggagttgtgggggggtggtcctagctttgctttcacctgtattgaatttaacatgaagggaaaacgtgcactaaagaggtaaggctgaagcacagaagagatgctaggactacgatatttacgtgggagcctcccacatagaaacggccctgagttagggattgagctctcaggaatgatggtgtcacaggaaaagcttgggacctcaccctcatgcctgaggaaatgcccattttagggaagtaaatgaaaaaacctgagaaagaaaggggagtcgggatgggtagaagaataacccggtcagaaagagcaagcagaaacaatatgcttttttaaataacattctttctcttttctttacctttgacaaaagcctctgagtgttaaacaccattatttaaaactaaccaggaagattagtatgtcattttatgtaattaacacatattgaatcattcacctagaagtagtatctttggtgaaaatgattaccatgtagcttaatcatttaataagatgttttgaaccatctgcattcaggtgtcataggtgtgatttgtttgagggagacggataaacctgagtattgctacacaagtcagatgcactgtcttgtacgttacagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgaggtaagaccctctggaggctgaatcccactgccatgtcgcctattgggctgcccctgcctctgagcagtggaggaaatgaggcagagacacaagcccttgtttccttggtcgagatgattgtgtgtttcacaaaccaaaagcagtcaactgagtctctgaggactgacagggcgaggcctgtgcttgtcgtggataacagggcacagcaggcagcccccttctcaggctcggagcagcaagcagggatcagggtggccaccctcgctgaactctgtctcaccctcttattctagtaacatttggtagtcatggagaaacatgccagaaactgaggaggagggactctgagtgtatttaactgccaacacaaaagctcaaaactcccagcagtggaaggcagtggagaggtggctgtgggtgaaggaaccagctctctgaccacccccagccatgtgctggaatttggagcaattagtgttatcccatgagggcatagtgtctcgccctcccaagttgcccagaaccctataaacacaagtaagaaaccaaactcaaacccccatcttccccaggggaacctgtgattcataggattcaggctgttgacaaaggtacacacagacattttttataaaacaaaagggaaccaaaggaaactcagcttttaagccagttttactgatcactaacagaattaaaatagaatgtgttcatcttccaaatttattttcttatttttattttttaaatatgttgttgtcgttgtttaaaatagagacagggtctcactgtgttgcccaggccagtcatgaactcctggtcccacgccgtcctcccgcctcggtcttccaaaacgctgaaattacaggtgtgagccaccacacccagcccatctcccaaatttatttaaaagtagaagaaaacagagtaattcctgtaataaaagaaataacaccaaaaagcataaaataggtcaacaaaagaaaatagatcatcattagaaataacaacagtctgggttcataaattcaggaagagagtcacatgggactcaagaacagaaatcaacaatgcattatttattagaaaaccacataaaggaaaaagaagcaaaactcggacatttgtgaaatgtgtgtgactgcagagtaattgaggaaggcatgagtaataggaatgtttaaaatgaaggaatgcaaagcagagagctttgagtgaaagattgattttatgatgcatgtgaaaacacattaaagcaatgtgcattgaacagcagtagaaagcaaaaatccacaagccaaaaagtaaaggtgactgacttccccgccaaaacaatcaacagggaattaattaattaatatatttatttatttagagacagggcgtctgtcacccaggttggagtgcagtggtgccatcttggctcacttcagcctctacctctcaagctcaagtgatcctcccacctcagcctcctgagtagctgggactacaggcatgcaccaccactcctggctaatttgttttttattattcttttgtagagatgcagttttgccatgttgcccaggctggtctcaaactcctgggctgaagcaagccacctgcctcagccccccaaagtgctaggattacaggcatgagccactgcacccagccatttaaaatttttaattaatcatcttgacacaatataaaacaaaaattatgtacttatgcaaatgaagtctggataaaagggtagtaactataattacttgaatagaactaatagatatattactgagtattctacaaagggaaatagccctttttttcagtggcctacaggaggctgttcacacttttggttaaaaagaagaaaatgtaggctgggtgcagtggctcacacctataatcccagcacttaaggaggctgaggcgagtggatcacctgaggtcaggagttcaagaccagcctggccaacatggtgaaaccctgtctctattaaaaatacaaaaatcagccaggcggggtggcaggcacctgtaatcctagctacttgggaggctgaggcaggggaatcacttgaacccaggaggcggaggttgcggtgagacaagatcagcctaggtgacagagcaagactccatctcacaaaaaataaaaataaaaaaaaaaggaaatgtagaggttatcttctctggccttgcctttcaaaaaagttcacattttgagcagtaaaactcattcatattttcacacactccaaaatcgaaacaaggaagaacttaagagccagtcacagtgcataccggttttttggtattagagaggacaggaaaggcagtgagaagtcgtttgtttgttgatttagcgagtgtgtcttgggtatttcccctggatcaggaacctgatgagggaaggagaggggagtttctggccccaaggagtttacagtctaattttagtgtattttaggaggtacatcatgtgtcccagaaacagctgaagaccaagacagggtaagatgttattatacagaatatatgttctgcagcaactggaggtgaggggactccaggagatccctggagtgagatgtgtgggattaataaaggggtgattaggattaagtgtgtggggggagcatattccaggaaaatctcagcccaaatgcagacaaagctcatggggtatcacgtagcataaagagacaggcctacctgggtggacagcgcagtgcagatcctgggcaatgcctctaggtgaccaccgtccttcagccctgcgagaactggttccagtttatcagatagtccacaaggaggcgctgtgggctctcactgaggaaaagccaaaggctggtgttttcggtgttcatgaaacctccttcacgcaggtggctccaatttgaggtgtgttttacatatgggaatcccacaggtgatttcccttgaaaagtgttcaactttttaaaaagttttcaaagacattagagataaatacccaccctgtcccctacctgtgtttctcagagggtgaccctccgaccacttgtatggagatcacctggggagtttattaaatcaaggccccgcccacagctactggattggcagcaccaggatgggacctagatactgatacttttaacaagatcagcacctgttttgatgcacacgctgttccagaggagaggaggtgaagacccaaccggaaccactgctgtgcatccgaggctttgtctttggagggtatggtgggatgatagcataagaaaaggagaacgtatacattttagggttgcgttttagcatgtacacgtttccttcatttttgtctatacagttcctcaagtaggatatttaagtaggaaacccttctttttaataaaatcatttgcagaattccaaaatacagaacagatgaaagcaggtctgctctgtgacctgtgatggaaccagtagggtcctcaaagcccagcctcttcagtcttccttcactggcccccagggagccctaggctaaacagaccatcatgtgaaaaccactgttacaggtgcgagaatggtgttttacagagcagccagaggagaggcatagaaaaggaaaccagataaaatgagaaactagtaggaaaggaaagctttcatgagcacttactatgtgccacaggctttaaaggatatcaccttaggtaattctcacaagagccctatatagatgctgtcattatcccagttgtaggcatgagggaacacagtcttggacaggttaagtgacctcttccaggtctcacagtaaatgtcaaaggctgattggaacccaggctggccaactcaaggggtggttcttagccactctgaaataacctttgaaaactacaaaatgctgttgatgtatgagagttgttattagaataatagaacatctgagctagaaaatatctgagaggctgtctccctacacggagccagacagattttaaatcctggctctaccctcacttcctgtgtggccttaggcacgtcccctaacctctgtggcctctgtttgcccatatataaattgggtatcttgtgagttcatttaagagttagatgagataaatacttaatgtgttgtctggtatgtggtcaaagtgccataaaaagtaatagctgttattatttataaataaagggaggctccaagagtctgtagaacatgcccaatgtctgcctaagaggtggtcacaggccggacatgagggctcatgcctctaatcccagtactttgggaggccaaaacagggggatcacttgaggccaggagtttgagaccaacctgggcaacataacaagacctcatctctactaaacataaaaaaattagccagccatggtggcacacacctgtggtcccagctactcgggagattgaggtgagaggatcacttgagcctgggaagttgaggctgcagtgagccgtgttggctccaatgcattccagccaggataacagctaaaaaaaaaaaaaaaaaaaggtaactgtgttgtgctgggtttggagctctgggtcgtctagtcctggtgttccagttctctaccttctccagtgtggttggcaggtgggcgtcctggctgatgggggtgtacactggacaggagtaggaagaggaaggggctattccccagcagggcccactgcaggtgtccacaccacccactccatggcacgaaagacctgccctggggtagccttaattcccttctgcgagagctggtttctatcagtgcttgctttggagcatttttttttttttcataaagggaattccctttatgaaaaaaaagtccctcctgtggctttcagtaaacaatcacaagtgtgttccagaaagcatttggtcccagctgtcataaaatcacacttaataattagcatttctagagcactttggaacctagcaagtgtggtgcacatatgttgtctctgttaactctcacaacagtactgtgaaatcgatatggccagcatgatgaggatcacccttttacagatggagaaaacgaaaatcagagaggctgagggacttgcccagtggcacacaactagtcagagatagagccacaattagaatatatgttaaatatctaggctaggcatagttgctcatgcttgtaataccaacactttgggaggctgaggcgggacgattgctctagcctcggaggttgaggcttcagtgagccatggtcataccaccgtactccagcctgggctgcaacagagcaagaccttgtctcaaaaaaataaataaaattttaacttattgtcggcaactcgccattgctgagtgtacccagccctcactctatcctccaacattagccattccctttggtagccacactgtatgacctacatcaatgggagcagtttggtggtatttttgattggccccaaactgcctaaatactctttgtgtagccaaggtagggtgttcctctttctcttatgtaaaggagcagaattggggttcacactgaccccaaaattaccacttccaggaagctcttgtttttgtttgttcctaagaaaaacttggagattaatctacatgttccctgagttgaagtgtccatttaagcaaaggacaggatctgcatttggtatagactttcctggataaaagctaagtgatgatgctaacctgtcctttatttgagaaccagcttcccagcaacaaaggatcccagtgtccattttcatccagtgaccaggtgactcacagcttccctacctccttgcccactgttagttaagagctcgaaaatgaggaacaccacaagagaatgcctgcatcccccagttgatggattacagcagtggctacaaaagaccaccaaaggtcatgtcaaactcagatacccggcccctccacttcagcatccaccatcttcaccaaaaccagaaaccatctttgttcttctggcccctgtttttactttacttactcctacattgcccattatagaagatagccattaatgtcaaaacaagtgactcactggctcctgtgataattataaaaggtgcatttggaagggcagaggtagctgaaaactttataagaggtttaaattgacacctgtagaaattaatgagagcaattgtatcttcaagattagaaccctttagaccgagtctcattctgtggcccaggcaggagtgcagcagtgtgtgatcttggctcactgcagcctctgcctcccacgttcaagtgattcaagtgattctcgtgccttggcttcctcagtagctaggattacaggcatgcgccaccatgcccagctaatttttgtattttaagtagagatggggtttcaccatgttggccaagttagtctagaagtcctggcctcaagggatctgcccaccttggccccacaaagtgctgggattacaggcatcagccaccatgcccggcccaaaagattgcatttttaaaaacggttttccaaatagtttgttgtttttgtttgtttgtttgttttttaaggaaagaaaacatcatcagtataatgtgtatctgggatacacggagcaaactgggggctttggaatgaccgtgtgtgcagcctttacatttcaagtgccagcgacccacctaaaggaagtgctgccataacttattgttgtgtgtctgtctgaaagggcccctgcaagaatacttgttaggtttgccagcagtagaatctgcatctgggactgtgcctggaaaggggcactatggaaggtcccaaaattactagcaacgatttcaattcagcaaacctttctgggaaggtaggtagaggctccaagaccccgctagatggtttctcttgccctctggctgggtcagatacaaaggaaaagcgatgtcctagtgtgggtgagctacccgtgagtagtgaactgttaatttgtctaccaagtggtactaaaacaacctcttggggtgggctctttgggaaaaatgggttaccctcagcttagttatagggcactatgtctaagaaagctgaaattgctttgaaattctcttgggcatgctttattcacatggttggcactcatttttgaaagcagcagatcccattattccttgactctacaaatttttattgagcacctactatgtgccaggcacaatgctggtctggggtttgtggtagtgaacaaatgagattcctgtccccataaagataatgccgtagtggctgatacagcaaacagccattttgaaacttggttccttggagtcgactctgggtttttgtggagggcatgaaaggcaatctgcttctggcctttgctgtctccttacccatggtttccttgattcccggtcccccttttttttcctgtccttttccctttttcttcccccttcttgggttctcagccttcaggaattcccctttttctgttcatagagttgacggagtgcttgcttccacttgctgggccttgccagcatccgctggttagagccagttgggggtgtgaagctctcacctgagggatgtgagtaggctgcacacctttggttgagtgaggagattagagtcacctgatgccttctctaatattatagtaggtgacttgttctaagaagaaatatttaagccaaaaaaccatccattgcacccctaccacattggagagcatctgctcccaccattcaaattttttgtctttggaggccagagctggtgatactgatactgtaatttcaatacagttgttccttagcaacccctcttagccgaactttttataatttaccgttagcttcagagcttcttataactatactctgatagaatgagaacaaagcattttaggacataaaaattaataatttttcataaaattcagtggttttgtcattttgtatccctgtgaccctgcctctcagcctcctggtgactcccattctaggacagaatctaagggacctgcagccaggagctgttgtctccctcacactccttcagcccaggaataaccaaagcaaattgttgtttttccgatgaattggaaaatgaaaaaaaagtgaaggttctcttaaaagccatgtctcatactctggccaatatcacaaagccttaactcattccgttccatccctgacccttccagaaagacatacctgtgattcctacactcactttccactctgtccctccgccttctcagagcagtgtttcataaccagactgccaagcagcccacagggcctggagaagagtcgataaattttaggaacttgaggccaggcgcagtggctcacggctgtaatcccagcaccttgggaggccaagacgggtggcttgcttgagtgcagaagttcaagaccagcttaggcaacatggtgaaaaccagtctgtactaaaaatactaaaattagctgggcatggtggcgcacgcctgtatacagattccagctacacgggaggctgaggcaggagaatcactttaacccaggaggtggaggttgcagtgagccgagatcacaccattgcattccagcctaggtaacagagtaagattctgtctcaaaaaaaaaaaaaaaaaaaataggaacttgaaaaaaaatatatacatatatatagagagagagagacacacacacagacagacacacacagacagggtcttcctctgtctcccaggatggagtgcagtggcacaatattggctcactgcaacctccacctcccaggctcaagcaatcctcccacctcagcctcccaagtagctgtgactacagacatgtgccaccacacttggctaatttttatatttttagtagagatggggtttcaccatgttacacagcctggtctcaaactcctgagcttaagctatccgcccacctcagcctcccaaagtgctgggattacaggcatgagccactgtgcccagccgaaaaccaactctcaacacttaggaaactaaatgtttaaattctgtttctactaagttgcttcagtcctattcagtgttagcctttgcagacataaatatgagtgtgttgtcaaactttccaaaggccaaaacaaccttaactttgatttgtccacctagctttttgtaaaaattttgtgctttttaattttataaatagatttcttttgttgtatttctttttctcactttagtcatttgaatttaaaaataacaattctcattgacataattcagataattcagaaataaccaaagtaaaatagtctcctgactcctatccccttcagtttcttccctccacttttttttttttttttaaattgagatggagtctcgctctgttgcccagcctggagtgcagtggcgcgatctcggctcactgcaagctctgcctccctggttcacgccattctcctgcctcagcctcccgagtagctgggactacaggcgcctgctgccacgcccagctaatttttttgtatttttagtagagacggggtttcaccatgttagcctggatggtctcaatctcctgacctcgtgatctgcccgcctcagcctcccaaagtgctgggattacaggcgtgagctgccacacccggccagtttcttcctctttgttataatttacaaacaacaattttttatgtatccttccatacttgttccagtgctcattgcagatatatcatatacacatgtatacacacacaagattgtgtctttacacattatatacactgtgtgtgttgctactatatgatcatcattgtataaattattcattgtataatttgtataaatttacaagttataaatttgtataaaattgtataaataaaaatacaaaaattagccggatgtggtggcacatgcctgtagtcccaactactcaggaggctgaggcatgagaaccacttgagccttggaggcagaggttgcagtgagctgagatcgcaccactgcagcccagcctgggcaacgtgtctcaaaaaaaaaaaaaaaaatgtaaacactgccataacactttttaatatatgatttatcttagtaggattaatcttagtactttacaaatttatcaacagatcattactgctgagatacatttaaagtcttatggtaattaaagcctttttctgtagctgtgcttttctgctagaccacctcaagttgattttatttacactttcattgtttgaaaaaaaatctctttttcccaccaggttagctttactatgttcacttaattgtatattcacttaattgttgattatattcacttaatcagttagaactaaaatgccgtttaggtaaatttaacttaggtgcccgccttctgccagagtcaacccaaaacctctaataaatcattagtttattcctaaaatgaactcacagagtttattagagactgcagttatttaagaagttgttcagctgcctgatggttatgaactgaaactgtaaaggtggtgagtagctgagctcttggagtgtttggaaattctagacatttggcaaatgtataagatacagcaccattattatgacccaaactctctatgttaattatcttctggggagttctgtgtaatttatttatttagtaagagaaaaaacagactaacagaagccagtttacaaaacaatacaatttgcaaaaacatagagggaaaaatcctttttaccctccctattcaaactgcaaacacatctttattaaggatgttggccacaatttggtgaatttatcatacatccctgtagggcaacttggttatatgtatcgaaactcaaaaatcctagcactttcagaggccgaggtgtgtggatcacctgaggtcaggagttcaagaccagcctggccaacatgatgaaaccctgtctctactaaaaatacaaaaattaagcaggtgtggtgatggatacctataatcccagctactcaggaggctgaggcaggagaatcgcttgaaccccaggggatggaggttacagtgagccgagatcgcaccacttcactccagcctgggtgaaagagtgaagctccatctcaaaaaaaaaaaaaaaaaaagacaaaaaaaaccattaaaaatattatttggtatagtaattctcttcttagaagtttgagtaaaaaaaatttcaaaacagcctaatgaaaaagtaagataaaagttaatacaaattatagtaaactagattattgaaccattaaagatcatatgtgtaaataatagttaatgacatggggaaatagatactatataataagtaggagaaagcagcttgaaaattagggtagttatttcccagaatactccattagatgctgagattttccacggccaaattagcttgagatatgtttagctgatcagaatttaacaaatgtatgcattatgcattgcaggacttgtcctgttagagattcatagaacataaaataaatgttttccaaatgtcttgactttgaaactttttctaaggaatacttactatcttcttttaggacacttaggttgagtagaacatagcataagaagtgccaatatagccgggtgcagtgactcacgcctgtaatcccagcactttgggaggtccaggcgggcagatcagttgaggtcaggagtttgagaccagcctggccagcatgagaaaaccctgtctctactaaaaatacaaaaattagccaggcatggtgatgcacacctgtagtcccagctactcggaaggctgaggcacgagaatcgcttgaacctgggaggtggacgttacagtgagccgagatcacgtcactgcactccagcctgggcaacaaagagagaccctgtctcaggaagagaaaaaaaaagtgccagtatgttgttcaatctcattttttgcttttaaaaacatagtatataaatgtattatgcgtttacatatatgtgcttctgttcatttgtgttcatgtaggcacagaaaaaataagctggagaaaatatacaaaaagcacatctcagagttgtgaaattgctgataatttttttctttatattagtctgaatttcccaaattttccgcaaaaaaaaaaaatcacttccaacactgaaaaaactgtgtttttaaattcccatagagttaataaaaaccactggtgagaaaggattaaagggaaaaagcagtcatatagaaaagaaaacataagccttggagtcagatctgagttcttgtttgtgatctcgaacaaagcattgaacttgcaaaataagaatacaattaatatctcttacagggctgttgtgaaaatcacatcagataccatacaaatatgtctaatacatgactttagatatgcaaagattgtgttgtttgagatttttcgtagtgattacatgtgtagggaagtacctctgtaaatgaaatgtactatatattgggataaatgtttttcctgtggaaatagactcctgaaatgatgaatgaaatgctctcgttcttaaaggaagggtgtggttcactacattgaactgaagggaaatgattctagactaatttagatgatttccatttaattttgagccagaattcttcccccccccccccacatctagttgcttttagctcttgtcaaatagttgtcataaagacaaggtttcacttaccatgctccattacctgagacccagacccttcctatggcattttttcaaattaaaaaaaaaaattattaaagagtttagtcagtttctcatggaactgtagaatttcttattgggaagattttcttttagtatataacacataatcactttaaaatgttaagattttggtactgtgaatgataaagtatgttttcacactttcttcatctgatttttgcaatgcttgcttttttctctatttctcacatagcaactctacagaaaaaagccaggtttggccatcacgtttgcaaagctgcctcaaaatttggacaaaaaccgatataaagatgtgctgccttgtgagtatccggcatgaatgcctccttcccccctacactgagataatgtttccctttttaaaacagattgtctggtattctggaacgattttcagtgtgtctgtaaacaccaccgtctttattgcagccatttcagactcggaacagttggggaatagtgtttatgctaatgaggcagagctgcagatggggctgggaactgaactctggtttacttggtatgataaaaataatgctcggaataatcggtaaatttttctcttccccgcagatgacaccacccgggtattattgcagggaaatgaagattatattaatgcaagttacgtgaacgtaagttaggaatctggatgatgcttaagagcacattcaccactgtcgcaacgatgatgagggcctgtgtggggctttgcagttgacacagtgctttcccgttcaccaccgcatttcagcaccacaacagccatgggagggcaggcagaatagtctcattttacagaggagaaaactaaggttcggagagttaaaataatttgaaaagtcacaaagctaacagaagatgggaccagacttgttctgtgtttctaattcaatcgtccacatgcccctgtactgagtggcttccattcaggtgtttgtttttgccagtgatgaaactgtctatttctctccatgtaatgagtgtcatcctgccttaaaaaaaaaatgagaaaaataaaacctcctctgtacatataagccaaaaagaaaaagtggaatgtttcacatgttatgggaaaagcacttattttctctctaaaaacgcatcttgggcaacttacttggcctctctagacttccattccttcttttttattttattttattattattatactttaagttttagggtacatgtgcacaatgtgcaggttagttacatatgtatacatgtgccatgctggtatgctgcacccattaactcgtcatttagcattaggtatatctcctaatgctatctgaacctggggtcagactttctgtagccaaccagatagtaatatgtgatctttgcatttgaaatgtaaccacttaaaaagattaaaagccgctcttagtttgcaaggtggcacacagatttggccttcaggcgatacgtggtctgccaactcctaaatagacagatgatttctcagattaagttctcaagttatagcaaagtgtcaagaaatgccctaataaaaactggtctcatcagtgattccacctgttccaaagcatctatgggattcattgaccctcacttcaacattcccggtgtcttaaaagcagagcatcagaaacattaggggcagcaataccataaagaccagtcttttcatataatcccaggactgaggaagccatttatccaagcaccagccgaaccatgaattagaagccttcctttaccttgctcacctgagagtgagtgaatcccagtgccagcccaaagctcagcaggttctgagtgttctttcgtcaaaaggactcagtccagagggcaaaaaggaaacatggagcaggaatatttctacctgaaacattcatttcaaaacatttcaacatttaatgtcaagattgaccaacttcatgatacaagcattggaagccatgcagaaggcaaagtgcaacaagaattggtggtgtaaacctgtaaggtttatgctttaaataaacgtaaatagattttgatagaaaaccctgcatagggaaagacttaggggtaggattggtacatacggctgaaaatgcagatagccaatattgattatatttaggatagagcaatgaaagtcatttaaactcttctgccatctcacagatagatttctgatttttgcctactgagtaccacacacttttatcttaaagatctaatactggtggttgtcagatatttttcaagaagttttagaaataacttgtttgattttccttattggctgtgaattgataaagagataatttttctggtgcaatatcaattagcaagtagaatagtttaaaatccagttccctgtgcaccctggggcagcaacagattctaatactttaccaatttcttaccagatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcgggtaagtagcttgatttctaattcagatgtgtgcagtgtcacaccctactctgtgtaacatgaatctcagcgctgagaagggtcttcagcgtctcctggtccagcccgtatgtgaccctaagtctcctctacagagcaaccaatagacacccctagtgacgggaggctcagccctcctcctccccagtcccagcttggatccattacaacaagccagaaggcacttcccctagccttacttcatgtgccccaacacccctgcagtgacgtggccttgcccattcaggacaagtgctggtcctgaaagagcagtgtgtgtgccaggttaacagtggcctttgtaaaaaggagaaattacatcactgtgccattttccatagaatccatttgggcagctcagcgctgtccctgtcttgtctgtctgcccttctcttccctgtaaagttgactctgccttttcagcaggaaggtcattcttctcctcagagaaaagggagcccccaccgcccagcaatggtctcttgtcttagggctgataaccctaagggttggttgccctggatagcagcccccttctttccctcattctgctttttccagcttgggagaaaaggccctttctgtgatccaggagacctcagcttcctccagccactcctatggctgctgtccgccagctccgtgctgctgacagcccctcttttttgttgatgtccactctgcacctgagctcatttgaggtctccattgtgacctggagggtttgtttcccagccctttctttctcactgaagctattccagctgctttgtcagtttcctgcattagagattcccatctcctctgaggtctagcattcccttcactatctctggccctggaacttaacctcccctgtttatccattggtagaaacctgttcttctgaaatccagggtgcatgtttcctccctcttctgttgcaaactcttggatgacaggatgacctcagccctttatcctgaaggccctaacccgtccacatcaccacccaccagttcttccagattaggagtccatcactccaggcagcagctttgcgcctttctctgagagatgaaattttcagcatctcccatttgttttctcctataccatgcatttagtagagtgggactcccagcaggtgtgcagctggctggagtccacccccgctccccagcctcgctgtgctactctcaggtctgcaagtgcagagagagccttctttgaagcctcatatccccagcggtcagtaggacacttccccacgagatacttgatttctccctttttaaattcccacccaaaatgtttttctttgtgctctcccttgaggctcatgggtttcttcttagaaacattgcaattgaataagttattctccctcactttccatcagagatgtttcttttggagagaaatatcattttttgctactacacgtgaataatgcaggtactcttcctggcccactggcggtcagaggcaggggctttggggtcagaggaggcgtttgagttctggcaccaccgctttccactgtttaaccttgcacagggctctaagcctcagttgcctcatcactagaaaggaggtggtaatgcctgtcttttgggattgttttgagaattaagaatgagctaccctggactggctgcctcatccagtagtgggtgctccacgtggcatagtgagtcaggatcctggcctccttgtctcacagggccagaggcagataggtttgctgctctgggcaacattaggggcccctgggttgccatgaggatcatgtgaggtgacaggaagaggtttgaggcagcacaaagctctataatcccccttgctcttgttatctgttaaacacactgtttggtgaaatgcacacttaggcaacgaggctcttcggcagagaactgatctctgagtcaggcttcatcaggccctctggttggttcagcaaatggatctaggcactgattccttccacctcctgaacccagacccatctgctcatttgttgataggacacatctacctgagtgtcctcacatacaaggtgcctgaagctgaagctgtcagccatgcacctgcacccaggtggtacacgccctgagctcaccagtctggccagtggcacccatctgcccagtcacccgagccaggaacctggaatcggtcttacccctcccttctcttcacttcccacatccactcaccacggtctgccgctgccagtctcccctctctgtcccccaaaccctcaccttctctcagagcttttgcatttctcttccaggagcagcagcagcagcctccttagtggcttcctggcctagaggctcccccagcccccgtcttgtccatcccttggcacagctttcagcgatacctttccagagggttgcctggtcctgtcatttccctgctcaaaccctctggtggcttctcaggtgcaccacgtaaagtctcaccttgagactggtaccttctgtgcaggtgtattgtactgtctgtcgttccctgggtacatcatgtgcctctttacctcttgaccatgtgtgtcccattccctctgcctgaatgatccatccttgccttgccaacctgatgaagaccctcgtccttcaatactgagatctccatcccctctctccaggacattacctcctcctcctgtgtgagccgcctgtgtctctgacttccctctttcttttcttttcaccacattcccccaacaccgattcgagagcaccttgaggacagtgccacatcgtgtctcattcatctctgcatcctcagggatgtttattaactaagtgaacaagaaagcaagcttttcaccatgaagccttctaaatttggcccatgactcccactaaaccctatctggtccatcttcctgagatagtgctctctctccttctttggcatgttatccatcgttagaatcctgttcttctgaaatccagggtgcatatttcctcccttttcctccctctcctgttacaaacccttggatgaccagatgacccgagccctttatccctaagttcctatctcatcttcatcactgcccaccagttcttctggattaggagtcggtcactccaagtgagcagatttatccctttctctgagagctgaaattttcagtatgtcccatttgtgttcacccatatcatgcatttagtagagcaggactcacagcaggcgtatggcttgtcttccacccagcttgtggcttgtttcctctggtccagaaagacacatcctttcagaaaccatctccctggtcagctttcccttcctgaagcctcttctcgaaaccacacctggggactggaaatgagaaacaggccccactcaggcttgtgaatctctgaggacagagcattctgagttctggcagcatctgcccagggtctcgtccccagcagcatgttgccagcctcctagcttcagtgatcttcgttgtccattgacaacttctccagaagtgcttcttctcttatatgctcagctttgcatatgttactgtttaatttaaccacagccctaagaaggtgcattttcttgtcattccagagtattaccagcctggctaagggttcacaggcctgttgagacattccagctctgccccagttcctctctctgtgatctgacacacactgattcattctctgagcctcagtttactcatatgcaaaacagagacaatcatagtacctacctcatagggttgttttgaagccaaggtaaagccatgttcatgaaaggcaccattcagtgcttagcatctaccgttctgaagatatgaagcttcagaatcatcgcccctcgctgcagcagcattaatgtggagactgagacccaaagaagttaagtaatttgcccgagatcactaaccaaatatgtttagtagaatttattaaccagggttgaaactcaggatctccacagacttgttctttccactacaccaccagtttttccagatccaaattgaactgcaatctgtatttggtcagaggtaaagagagagtctagtactgctcagattcactgtggaataaggggagtctctctggcagtacagatattggtagttctgccttgcatgggttgatctcatcagagaatatcttctctgcaattaccctgtgggcaggaccattgggagcctacaggacagggatttatccttcctatgcagatgaggaggtgagagagggcttgtgtctgtcaactctgccttgggccctacagcccttaacctgtcatgtctaagcaaagtcacagaatggctactaaccaaaattacccatgtttaaggtttccaagtaaattcttaactccagctttccagcggcatagtttagtttcaagtattcactgtgacatttgaaagtaagaatagagaggctgtttcccaacaaattacatatgtcttatggttataccacttttccaccatgaacaaatgtattttttacttaagttgctataaccacatataggctcaggggaaaatgcttgtttaatgacttaggatttaactgacagaaggatctatgatgggatggacagcctagccctgaagtttgcttagaagccagaggcaggtgctaagatggcttacaggacaagttgcaggttttagaagcagggatagaaactggggagggtggtgggatcagcccgtctgtgcggacagcacagccatattgagagacactggggtgccataggaagagtgctggactgcatcactgtgacctcatggccttgggcaagtcacttaatcccgagtagccctggattccttgtctgctgtgtgggatatcacctctttagggcgtcacctaagaaagccttcaagggcttcagagacgctgctccagtgagaaaggtattcatctcgatttgtgagtcccttaatctgggtttttgtggaaactcatcactgttactcaagctggtatgtaacccatgacagcaacagaagtcatggccacccccgcctgccccctacagtggctaagtactgcacacccacgccggccgcctcaccagcgttgaggcaggagccacctccatcttcccggtggaaaacatgaaaatcagagaggttaagcaactgtttcgacatcatctggctgacaaatggaggaggaaaggatcccagcggagttgtgtatgacaccagatgtgtgcccttaactgctgtgcctggaggcctccccctcaaaagggtggggagaatggtggaggaggggtgcaggaggaggggccgttggaggtggggaggggcctgaggggctggggtctgggagggtagagaggttgctcacaggctaaggtcctgcatctgaggccactggtgctcttccagcgagtggcccctggtgatgaagacgctgcgtcctcctcctccaggctgcagcctggggctgagcggagacctgtggcctagtccctggcaggctgcccccaccccgccctgagaaacagctgatggacttggctgagtttgttttctcccatcagtgctctcgggtgtgcatgagaggatgcctaacccgtccacctgtccagggttaactgcttgcaggaacaccccacagacggggctcactcactctcggtggtttcttacagaccaaatgtcaccagtactggccagatccccccgacgtcatgaaccacggcggctttcacatccagtgtcagtcagaggactgcaccatcgcctatgtgtcccgagaaatgctggtcacaaacacccaggtgagccgcagcctgaggggcacggtggaggggcaggtgctgaatcagcggccactgtcatcccaggtggtcacgcttctaggtgtgcactctgtttgcacctggcaagcgtgtcagtaagtgcgcaagactgcccatcaaagagccagggcccagagttcacagtggccctagtcacaacaggcacgaggtgcaaacagcccagtgtccatcgatggaggaatggataaacagcacgtggtctgtccatacaatggaatatgattcagcctttaaaaggaaggagattctgacccctgctacaacactggggaaccttgagcatattatcctaagtgaaataagccagacatagaaagacacatactgtaggattcaacttctgtgaagtgcctagagtcgtccaattcatagagacagaaagtagaacggtggttgccaagggcttggggaaggaggagaaaggacatctatggacattttgccatatggcataatgggtgcagggtttatgtttgcgggatattttaaagttctggaaataggtagtgctgatggctctacaacattgcgagtattctcaatgccgctgaactgtacatttaaatgtggttacagtggtaagcctcatgttagtatattttgccacagttgaaaaaaaaaaaaaaaaacagtcagcatgtgtggcctctaatggcaagtaccatagcagcaaatggaggagatcactgggcagaggagatcactgggcagaagtgatcaaggaaggcagccctgcaggacaggcccacagctgagcctgagaggggatggggatctttggggaaggaggggaggaattgctaggggccacagcagggctgtgcgcagagggagaaagcatcaggagacagggccaccctgtgtctgggttggggctgggtcctcatgctcaccacctggatgggctcaccaaggccactgcatctcccacagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcaggtatggcgcttgctgttttgttaggtttggaatcctttccctgtcggaaaaggcctggagacaattggcaggcgccagacccaccctacatcccacaaagtcgtgtgcccttacaaacctctgttgactgtggttcttcaccatttcaaaagttttttggaattttatgaaatcctaactttgtgaatgtagcacagaactgaagaagaaaatcccctcacacaccctttctcctgtccttctgtcagctgaccttcgtcataggtgtgagtgagaaagggaataggtttggcacttcacagtggccctctttccactgcctgctagcccccagtctcagatgtgtgaggacaggctgtctcagcctgtttgagagcacgccgtgagtgtgcgttttgtcttctcgaaggccaagggaggaaagcccctttggagtcagcggggaactgctcgctgggccatgcagaaaggctactcagacaaatcccaagtctgtcttctctcccctctccagtgctggaataggtcgaaccggtgtgttggtcactatggaaacagccatgtgcctaactgagaggaacctgcccatttacccactggatattgtccgaaaaatgcgagaccagcgcgccatgatggtgcagacatcagtgagtagaaatccagtaattacggtggctggcactttctgagcacttacaccaggcaggcctgagagaagggctttgtgagtcaacagactgcagctcagggggactgaatcacttgcccaaggtcacagagcttgtcagtggctacagcccacacccatctcacctctgagctctgctgcctctgtggtttatttcctgccagcccgtctgtcagggagcagccctggttgcattctgtatcgttgaacaatcatttgtccattatcctcccccgcaccgacccacctagacctgggtactccttttggctcagtggatgttgcatatgaccctactttgagctctgttccacccgtgtggtgcctgagtacctgctgtgtnnnnnnnnnnnnnnnnnnnnccacaacttggaggaatgttccaaacccgcggacgccctaagtatcttctgtgtcctccacgggcagggccagaggtccaaaataagggttcatgggcaacaatcctttctgtctcaagaggaactctaggggataactcttggggatttcccctggaactgcaagcggggcagtgaagcggtgtggaaagagcatgattaaggtcccaccacaaatggaacaacctttgcataagtcctgaacctctctccaagcttcagcttccctgtgcaaaatggggaccatcccacattcattcattcattcatttgacaaagaagggtgcagagacaggcttgtatctagtaggagaactggattagtctatgctaagtgtcagcagcggtgagggaagttcagggctgtctgagaacatggtggaagagtatctaaagcaggatttggaaagtctaggaaggcttcctggagaagtgtcttctctggtaaaaacccccagggtacatgaggagttagcaaagaaaggagcaggaactatatgttccaaccagctctgtctcttcacaggctgtggacaaagtttataagatttccctaataaatttttaagctttggtagttttatattagtttgtacccagaaaatcttgttaagagaaaaaaaatcagcttatgttattagggccattctctgccctgttttttggtatggaagacctcgtggctggttaaaaagaaaaaagtccatcatcctggtagattttcccagctggaagctgggcacggtggctcacgcctataatcccagcacttcagcaggctaaggaaggtggatcacttgagatcagtagttcaagaccagcctggctaacatagtgaaaccccgtctctaatgaaaatacaaaaattagccaggcatggtggcatgtgcctatagtcccagctacttgggaggctgaggcaggagaatcgcttgaacccaggaggtggaggttgcagtgagccaagattacgccactgcactccagcctgagtgacagaacaggactctgtcttgaaaactagatagatagatagatagatagatagatagatagatagatagatagatagattttcctagctggagaagctcagtctaaatgcttttatcccccctgtatactttgctacaatatgtttcttaggtatttgctaagataaataactgtatcctgcagagcatctttcagtggctctgctttgtaaaacacaatccagactccttaccccaacacaaggtgcccacaaccaggtcccagcccacctgtgcagcccctcctcctccacatgcctaggtgttgagtccaggagcaggctccctgaccccgtttctcaaaatgggctcttactgaggcttccacacttccacttacaagaagggctgtcccgcagggacttttgctccttcccacctcccccagaccgccagtttctccctctgtcatgtctccatgacactttgcccacccctctctgggagtgccccctccccgcatcatataggaactagggcttcacaggtgtacctggcctgtggcccagagttggcgctcagggaatatttacaaatgctgcaaaagacccaccggtacagggtgtggtaggcagcatttcctggagctacaggacttgacagcatttttttcttttccagagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgcacataaatgaagccattttgatattcagcaaattcggtgccaattgaatagtttgctggtagcaagacggatgaagacctatatgggagattctttatctctagagctagcatatttacttgcatactttgtttcttttccacatggatattttactgctaaatggcagaggtgggagggagatgtcacacagtaccataaccccatattgaaaacaagaaaccaccagaaagtttgcagctaaggggcaggggattcagttcctacgcccactcagcactaactacttgcgggcctggttgcttagaagctctacctctctttcattatctgtaaaatagaaacaatacttaggactttagttggaacatgaggattgaataagatcacgctattcatgtgactttttatcggctagaacagcaacagacactgctgtgggtgagttacttagaaaagtttagttatcagtgattagcccaaaaacacatcagtcaaaaatagaatccactggatttttgtctctctttttagagacagggtctcactgtcgcccaggctggagtacagtggcatgatcat

SEQ ID NO: 15336 - DNA, 74353 bp, Human
caaaaacctctccacacctcctaaaccacccttcaagcaagaaaaagggaaagattttggcattttgaaaacttgaaataaggatggttagaccccgtgccagccacactgatgggaaactctcctttgacgtctcatccctgcctctaacagacagggagagtgacgtccaacattgttctcaacatcagaaaaacctcaccccaagaaaaatacatggtattttcgaagtgcttactgtaaaaggagcagggtgcgctgacttcgccaaggaatgggaaggaaatgaagcgctgaggtgggaattagtacacgcttcctctggggaaaagacatctgctcctggcactcctcaaaggaggtgatgcagagctctcccttgacgctgtgctgcttccctaatccattctccaggctgggtgatgggacctcttcctgcaggggagagcctgccctggctcccagggtcaacaagggcagcagcccccggcttggaagcctccctcctgcccctccttacacacgaaggggcagaagggctctgggcacaagcagtactttggtagaaaatcagaaggccctcttacatccccgggggcgccatgaagggacttggctgctgccagcccctcgccaaactcctctgagtggtccaggggataaggccgacacgcccctcccattcactggggtgtggtttccagcacttaggacattccatgtagcttctccaacaggactcctcctccccacactcaaacccaaaggaccctttcataaaccagatgatcatttctggaaagttacatttcttaatttcaggaattgttccaattcgtgcaaagaaaataaaaggtaattatctaattccagtaaaacttaatggggcccttcccacccctggctaatggttggtgtgaaatgtaatttgacttaaactgtctaaggctgtgaaagtgtacaatattcggaagggtggggggcattaccccttgtgggagccatatttttctagaaggcattttgatcaagacaggcctcccgcggttattgatcttagggtcattgagagtccaagaactggggagatgaaggccacccggcgtcagcaccgcgagggcggacggaaggcgggcgctgagtctcccattggggttctagccgagggttccagccaggattgcgtgatctgggggcagctcggagagctctcccgacccagtatcgggtctataaatggagataaagatcagcacctggagggagtggtttctcgagggctgagagcctcgcccacaaactgtagtcagcatcttcactgaagttggcctgtcttggatatttcttctctcctccccttcccccacctcccctcctaattcatcaactgctgaaacatctgcctggctgaaaccgccttctcgccgcgcgctgggggctgtccccaggtgttggtctttgtgtcgagaaaactttgcgaggaggcgagggagctggacaaagagcgggcgagggagggcgtttgccagcctgaggggtgcgccgggcggtgcgcgcacttccctgggctcagctccgtacccggtcgctcgcggtggccagagcccagtctctctaggccaggagtggcgtccggctgcatccccgcgccctcgggagctgaataaagccaggcgggagaagcaaaggctagcgcctggacgctggagttggtgggaggaggcgagcagaggcgcggagcaaagctgtcaaactgcgcgcggagccgggcgcggggcgggggaagggagaggagggagggaggggcaggcgggagccgggagggagcgagcgggctcgccgcgcctgagcaacccctgcctgtcgctgccgctgccgctgccgctgccgccgccggcccggactcgtccggagcgcagggtgtctgcccagctgcgcggcgcgcggaggctccggcgtccgccgtgcgccctccggcccctgctcctcgcgccggcccgcttgggtcctggcgggcgcgaacccaccatgcagctgcagttccggagctggatgctggccgcgctcacgctgctcgtggtcttcctcatcttcgcagacatctcagagatcgaagaagaaatcgggtaaatagctgctcccaggcccgtgccacgagccctggcgggatctctccctccttctgtactctccaccctccgaccccctttgtgtgcgccgcgccccgctgtagctccgctggagagatggggacggtttggcagaaggtggcggcgacaggggcccgggacggtttggggagaggagggtgggggcgcggctgctgtggggtgtccccgggcggggttcacgggaagcccccagctggcccgcgtcgggaagcggactcgcccaccctgcccccctgcctggcgtgtccaagcgcagtgtcgccggggtcgagggagggcgccggggagtgtctcgggcgggcggaggggccgagagtggagggaggcaggagtttctttgtctccagcacggccgctttctcgccttggcaaagtgggcagggggcgcgcagggatctctgagctgggggaggggttcctcgggccggagcggagggcggggttctgcatgggctactgggaagcggaatgtcccctgcacacacagacaggcacacgcgcctcccgccggcccgggagcccggcgtaggagctggcaccactagagaagggctcgcatagctggactgagaccccccgccctcgcctggctttggacgttcagccaagccacggcaaccccggcgaccctgggttcctgtgcgctcgcagcgcggagacggagacatttcgggaaagtctgtaccgccgcccggtgggcttctgggccctcaggcgggcgatctggcgctttttttctcccgacctcgccagaggtagggtgggaccgcgagcccggatcctcccggctccggacttcctggagtgcgcacttgaggcgcgggacgcaccggctgtgtgtcccaggggctgagactcgcgccccgccccgcagccttcggctcgccgggccgggcccctctccggaacctccaaagggcggtagacgacaggtggggaggcagccggggttctgaggaggcccgaggagagcttcctggccctgggcaaggggaaggtgaggtctcaaagagggcagaaggtctcttcttctgtgggatttgtgctctgccaggcgctcttctcgagtcccgcgccgcgtgcgcccctcctttgtcccatttgttacttcatttgttatctgtgctagttgagggtccgccacactgtcagtccctcaaatgggagatgccagtcctgggcccaggcgggatgccgaggccccaaggacaaaaacttgtgacaagtgccgcttcctgctctcattttctccctgcccctgcccatctccctggaattccttctgtgaactccgctgggcttccagaacccctctccctgcctctttctcctctcattctcggtttccccaagagctctgaaaactttcacaaatgctgcgcagttaatacacaacgtgccaccaattcccacgcagagataaacatgctacttttcatagctgctcgcctcagaaacgtggattggaaaggaaatcgggcaagtcacgtcttggggtaatggaagatgcggtgaggagggccttcctctaggctctccggcttctgattccggatgtgggcactgcccggctcagatcacttgctgacctttgcccatgtgagagggaaggcccggcgctgcccattgtcctgttataaaaacataagtgctgtgcttatccaggcacccctaggtcagccattcactgaattcttaccaaataccttccacatgctgggaacttttaatttttaaaatgcaatcaggagatcactttgcacataatgttgcactttcttgccaaatgcacggtgaagcctacgctccccacatcaggttgttcccatatatgtacgcaccccggggacttgtctcacttgagtgctccctgcttctttttatcctgtctctgctgggccaatcctaggaaaaaacggtcaaacaagtacgatgtgtcacctcctgtggcatcttccttccctctcttgcctctcgtcccaggctgaccactggcttgaccagtcctgaccaggcctaagacaccctctctcccaggctgatgtagctgccttaggtcaacactgcatatgcctttcgactgggatgggcactcttgccccacccacggtcagccccacacatgtttaatccagaggaatggaggcatattttgggattcaccatggctggaggagtaaacacatgggcagagcatgggaatcccaacagcaccttctgtctgcttacaagtgaggggtttctttttgtttgtttgtttttgtttttttttttgtcttttctttttttctttttcttttttttgagacggagtctcattctgtcgcccaggatggagtgcagtggcacaatctcggctcactgcaacctccgcctcccgggttcaagcaattctcctgtttcagcctcccgagtagctgggattacaggcacctgccaccacaccaggctaatttttgtatttttattagagacggggtttcaccatgttggccaggctggtctcaatcacctcaggggatctgcccacctcagcctcccaaagtgctgggattacaggcgtgagccacccctcccggcacaagtgaggttttaacactaaattcattcttggaattaccccaactttgggcagctgggctcagtgcccaataagagccttggcacagtggccagtgaggggcgtcaagagggctccgccttcctcaccatatgccttcctggagacctcgaatcatactcaggcacaagaggcttttgcaccagccctgcccctccatccccaactcactccggacctgtgctagggaggattacagatgatctgcgcgtgtcggcccctgggagaaagcgatggctctgtaaaaggatggctgtttctggaaagtaatgaacagtgggaccctgtgatctgttggaaggaaggaaagatagaaggaacctcttttgggggtaactttttcaaggattaaggaattttaaaaagtgaaagaagaaagtgaattacatgtgtattatctggagggataaaactgagatttacttttctgaagcttttgattctcttttttttataaaatgaggcttttaatgtggtggtctcagaggtcctgtcctgcctgaaaagttatacatcatgaattgaggggcagggctttctttgaggggagttttctgagacacacatctcttttccttagtgattattttccaaagttccatttctgactctcttgctctcattgagctggagctgactaagaaaacaaaatgtagaaagataagttctctgcaaagcacctagagagtcctgcctggtagccaaggagtgaattcaaattctaagtcagaaattgggtggggctttggtaaaataggccctgatcaattcatgcacactcccaagttttagatccaattcgaccaagttgtaagctaaaatcttctgattgtttcttggcctttaatcttgagtgtaacttccactaggggattgtgaggcgtagctgtcttgcccatcatggtgtccatggaactgggcacacaaggcattcaataaacatctgttggataaatattttcctgagtctggcacagtgatgggcacacacagcatccttgggcaaagttgaaactcagagctggccgggaacggtggctcacgcctgtaatcccaacactttgggaggccgaggcaggtagatcacctgaggtcaggagttcgagaccagactggccaacatggtgaaactccatctctactaaaagtacaaaaattagccaggcatggtggcgggtgcctgtaataccagctactcgggaggctgaggcaggagaatggcttgaaacctgggaggaagaggttgcagtgagccaagatcacgccattgcactccagcctgggcgacagagcgagactccatctcaaaaaaagaaaaaagaaaagaaaaagaaagaaagaaactcactgagccttgggacaagaagagagcatagggctctccctgtagaaacctttcctttttatcagctagggtgaatttgacactgagaaataacatcactaatctgagatcacagcctggctggttaagggcagagcaggcttgcacaggtctcctcttttgtaacccaatgtcctaatcctcatattagttcctctacccataaaggaattacagaaatcttgttaaagagaagttgagtgactagtaaagataacaatagcaattatgacaacggtgaagatgatgatcacggttagcatttactgagtgcttcctaagagctaagagctactccaagtgctttatagatgttaacacattccagcctcatggcaatccagtggtcacctgccagtggcactgtttgtagagctctgtgagccagatgctaggctaactgctttgaaacacatttgctggatcctcaccagaaccctctaaggtaggtaccatttctatccccatttattgatgaagaaaccgaggcctggagaggttgtataccctgctgataaacttgtgataaagcagctctgtggaaggccgaaacccatgcatgctcttgaccattgtgctagactgccctgtcctctgagttattttttttaccctgagctaataatgttaacgaatatatctgaagaccaactcatccccagtggttcttctaaaggcccagagttttcctgagagcctggtctggccttagtagtttctccatcagtcatttagaaagacagaaggtgaatgaggaggaccagaggaggactctgagcacatctccccaaaatgtccctctagtccagctaagttcagtgccatgctggaggacagaatggcattaaccccaacctgttacacaaggtcacctgccataggtatgagcattccagactctgaggtggagcctggggctaaagtgacaggaggaaggaaagctcctattccattgcaaacctgattctgatgtcaatcaaaagggcctgcctcgatactacgtgctgtatatttgggcatctaggtgtccggagcaggggagatagtaaagatatttaacaactgctccctctccagcaccaacctgttagaatggacatctgacccatcagaactgatgccatccagtacaccacggccaggggtcctagtgcacctcagccaaacaccaggccctgtctgggaaaacactagacaaggagaggctagctctgatcatcagccatgacgagatctgtgagcaggcagcaactactgccaacagccaagagtgaggtgaggtgaatcgtttagtggacgagtgcacgtggatgggaaagaaaatgaccttgagcagttgcagtccaggcactctgtaagaagtacacgtttgctcaacacgatgcatttttttttaaaaagcccattcttctccctagtactggtgtacttcactgaagtataagcatgattggaagataaaataggagagaaagatctggttttaactcacttgctccaagtccttattgccaactgttccaaacatcacatttaaattgtaaatagataccatcttagaaaccaattcaccactcagagcctctttccccctgtaaggcagggttgctaggttttaaacatgttttaggttttacaaattggaaatgttgtagattgcaaattataaatacttcttcgagaggggattctagaaaggctcccattgcttttagcagggcatacaaagcaacacatcatctggtcttttgcctctgtctgtagccggcctgggctccagccatttttgtattgcttacaggttccccaaaatgtcctaggatttcatacctctgtgcctttgcacatcccgctcctgctctgtggaatgccctccttgcgcacacaccatccttcctgctgttgccctgctcctcccaggcccttcctttctctcactgctctgtcttcttccaggctaagatctggtatctcctagaccccgtccccttccgagacatctgcattggttgcccctcctgtgtgcaccctagcaccccatcatgcagcaccccatggacatgcatttcacaattatattttatttatcctttatctccagcccctggtgatacgtatatggtttagtaaatgaagcctattaaatattttttgaaggaacaaactctgaccgaggatatgccaaaaataagcattcagcctctctgctcccaaaagtacatactattctaacaacaattaaacaccctctgcttgatctggaagccccctgcttttcctgtgtatctagcgtggagggtgcatcccagtgaagagcacagtctggctatgacgttattcaccattgcggaatgtttggggccaatggaaataaaagctgctttctaatttgtaaaagcagaggacccagtggtgtttgccccctgccagtttaggtaaaaaccaaagatctagagcccagatgccaagcctctgccggctgttggttctccagagagccctttccagccctccactgcccacagtgctgctgaggctgccccctcctgcctggaaggacagccggccccgtctaccttaatccccttcagggcttccatagtggcgttgagagcagaccaggaacgcagggccagctgtttccgtgcaagggctggtccccaggtaggatgctggaaactgagtgttagagacgttgacagtaagaaatgtgaggtcaggtcgggatgtgtcatctcaaagattttcctcatgaagcaccttctagtggtgtttttatttgaaaacactggtcaaaccagtgaatcctcatgacgggtcaagacttggggcagctgtgtggatcctagataaggtccggagcctcatctctctcagctgtctcaagcagagatgagttagagacagttgggaggatacagtggaaacggccgggggagggacaggaacatgaaagccaccagctgggtgagtcaggtggctatctcctgccagggcgtggggacaagctcatcttccggagaggcactgtggggtgagacaccgtcgcctgtggccggccggctgaccgcccctgggcttgcttaccatctctccagagccaaggctggtccttaagcgttgagattagtcactctcttgggtggcatctgggctggttttaaattctctttagtctcctgcaatttatcacccagctaggaagctgcccggtgtcctgacgggacctgtgtgtcccatgttttctcagctttggctgtcactgacttcgcgacgatggcaaggaggaaacggctccaactggggagagcagcggccccgacacgacatgtgtctgtattacacgttggcagtcgaggttcctcctgacactttcaagcacttgggatcccgattcactcccctgggaaatccagcatccagcctcgctgtgtgggtgtgcctttgacttcccaaactgctctgcaagcatgaagctctcagctctgtccaagggtttcccagtgccttttttttttattattgaaggaatgcggagggactcagctttgcttcctggaccttttttaaggttcagggaaacaattcctcctcctcctcctccagcttcttagttgatggccaaaggatgaaagaacccctaggtcagtggttcccaaatagtgagccacagaggagtggtgatctgaaaggagccagaaaaaaaaaaaaaagtgcaatgtagccatgattattaatagtttcaagttgccagctgccattgcctgaaaagaactcttctatattctgagataatgttcctttttcctttgggatactaagatgtcctttcttttatgaaagggagtgatggtagctatgaaattctcccttggctgaagagggtggtaacctcatgagtccccacccccagtgttttggaaatactatgggtccttgaaatctgattgtctggggtctggatccacaaggtattctgaaaagctcatttcaggaagtagcctcactcctcacatattttcttccccatggaggctgatgccagcagagaataacaacaaagtcatattttgtctgtgtctgctggggtccaaatgattttctaaacactttagctgtattcacacctgtaatcctcccaacagtctgaggaggtctatgttattattatctcccttttacagattagtgaactgaggcccagagcagttaaataacacagctagtaaggtgcagagctgggattcaaacccaggctcccaggaacaaggataattctccaaaaaacgatgtcttaaatgacatccagtggggaagagatgcgtgcttgtattttcaaggaataagccttggaaacacaaaggtctgtgggagagagaaccctgggatgtagcgatgctgaaggaaacttaggggatagcatgttggagcccaggccataatgggacatggcagccaaaagatcagtacaatttagggttgccagttccaaaacaccttaatgcggaatgacggccaggggcacaccgctccgcctctgcctccccacatttcctctcctctcacaccagcttccccgcacggagtctcatcagaatggctccggagcatggcatttgtttgaccatctcattaccagagagagagagagagagagagacacactgagagagaagagaaaaacaacacaaatgatcaaggcctggaggaattttcttctaggggaagacagaagagttggtgctgtcagcttccccaggtcagtggagcctgacaaggaagggaaggagggagggagtgagtgacggagggagggagcccttcggggaggggccaggcttaatgcaaggagatagcacatcccaaggagccccctttcctacggtaaccacattctgctgagagctcacatgtatcacctcactcaaccttcccaagcaccctgttagtccatttgcagatgaggaaatggagactcagagaggtctcgggacttgctaaggtcacacagctagtaaacatggagctgggattccacccaggtttgcctgactccatggtccatctggtcttagccacttttttatactgaggttacctggctgctcacccccattcctcatgcctcctgccctgggcctcctacactttatcccgttttctgtaccatgcagagagtttgcacaaagatgctggaaacttttgagacgatagaatagactcatcatgtcagatagcttcgcgaacacaatggcatctgtcaccatcgggcacaacacttcagcggaggctctggaagaggcagacatacctggactctacctggggaggtgtgagcacttgttattgagcttccccagttctaattttgaaaatcggctgcacgcggaggagtgatacccagggttaattcacgccttcttggtaactgccagagtagcttaataatgaaggcgggaggcataagatgtctggagaaagtgaattagtaaattgatagggcaggtgactttagtttgctattttcctacaagcagtaaaggccctcctactgcatctcttgaggttcccacaatttgggatttgactttaggtggactcaggatgatgcccaaattgtatgctaatcaaaacatttagttcccaggagaagcaaagagaagggcaagagagaaactccccgtggtgttctgtcttggcccgggcagggagcctcttaggccggctggacacaaaggcagcaacgtgctgacagacggcatcccaaagaaagacctgtgatggcccagccttggtagtaaagccagttaaggctccacaggcccttccccaacctgccagaactgcccaccataccatagctctaacctccagcagaatgccagaatggctcacttaggtattcatcatacatctctccctgctgccaacctggggccttacgtttatctgtaaggactgacaagttcttgccagagctggattcatggcatataattcaggacattgggccagacctttggagcaactgagagctactcttggaagattaaggctccagtcttcagtggaacacttattacctgtgtgagttcaggcaaatgacctcacctttctgagtctcagtttcctaatctgtataatggggttaatgatacccaacttacagtgttctgaggattaaataaaacacaaatggtgggaatgtaaaatggtacagctactatggaaaacagtatgacggttcctcaaaaaatttaacgtagaattaccatatggtccagcaattccacttctgggtgtatattcaaaagaattgaaagcaggggccaggtgtggtggctcacacctgtaatctcaacactttgggaggccgaggtgggtggattacctgaggtcaggagtttgagaccagcctggccaacatggtgaaaccctgtctttactaaaaatacaaaaaaaaaaaaaaaaaaattagctgggtgtagtgctgcatgcctgtagtcccagctactcggaggctgagacaggagaataggttgaacccgggaggcggaggttgcagtgagcctagatcatgccactgcactccagcctgggtgacagagcaagactccatctcaaaaaaaaaaaaaaaaattggaaacagggactcaaacagatatttgtacacccatgttcatagtaaccttattcacggtagctaaaaggtggaagcaacccaggtatccgtcaatgagtgaatggataaacaaaatatggtagatgctgggcgtggtggctcacccctgtaatcccagctcttagggaggcacaggcaggaggatagcttgagcccaggagtttggacatgcctgggcaatatagcaagaccctgttcttaaaaattttttttaaaaaggtatatccatacaatggaatattattcaatcttaaaaaggaaggaaattctgacacaagctataagatgggtgaactttgagaacattatgctgagtggaataagccagtggccaaagcacaaatactgtatggttctacgtacatgaggcatctggaatggtcaaattgatggagacagaaagtagaatggcggttgccagggtctggggaaggagaaggggaatttgtttaatgggtataaagtttcagttttgcaagatgaaaagagttcagcagacggatggtaatgatagctgcagaataatatgaatgtcttaatgctactgaaccgaacacttaaaaatagctaagatggtaaattgcatgttatgtgtattttcccacaattgaaacacacacgcgcgcaagcagccagaagagtgcctggcaggtgctcgggacacactgacttattttaagagcacagttgtgattttcaacaaagcaacatcaatgtgggtattacttaattttaaaaataatacaggaccaaaaagcagatacaggggaaatggagggagaaaaggggggaggtgtggctatagacacagaattagaaaaatacaaatcatcactttgttgtatgtttggatacacaagctggaggtggcccaaatacccaacatctgggatttaggattgtggaaagtgcaagcatacttttgtgtggccactctgaattcttgttggctgccctgcccatctaagtttagtggaggggcccataaggttttgccaaagcctaagttgcaaggagggcccagagtgatgggggagagaggccaagacagtccagaccccctccctcccagacgcagcttccagaagtccctttctttatcacctgcctacgggtggcctctaaactgtttctggctcaagggtgaacctgaaaagaaaagagtccgagatactgatcccaagatttggctcctgctgagctgggaagaggtagggcacagctgtctcttcccttttaggctctctataataccacaggaaggagcaagtgaggtggattccaggaggcttgagatgccaaagccagttctcagacttgagagagcatcacaatcacctcgaggatttgttaaaaacagaacgctggacacctcctggagtttctgtttccacaggcctggggcagggcctgagaatttgcatctctaacaggttccaggtgatgctgacactgctggcccatttcaggaccacactttgagaaccagtgagctagagccttgtcactcggtgtggtcctcagaccagcaacatggacatcatctggatgtttggtagaaatgtagtgtctcaggccctcctccaaaccctagacctgccgaatctgaatccgctcagtaacaagcccccaggtgaagtgtatgcacactttgctgggggaatgattggtttccctgccttctacagagcgcctgccctaagcagtgaccttggcccatcacaccaggggtagcctgtcagtgtagctccactgcccatcacagagtcagcctagagggacctccaaatggatatcagaaaaatgaataatgattcttggccaggcacagtggctcatgcctgtaatcccagcactttgggaggcagaggtgagtagatcacttgagcccaggagttcgagaccagtctgggcaacatggcgaaacccatctctacaaaaatacaaaaattagctgggcgtggtggtgtgcgcctgtaatctcagctactcaggaggctgaagcaggaggatcacttgaacctgggaggcggaggttgcagtgagtcaagatgtcaccattacactccagcctgggcatcaagaatgaaaccctgtctcaaaaaaaaaaaaaagaaaagaaaaaaaaaaacactacaaagaaaaatgaataatgattcttattacagccactggttggattcctgagtgtatgccaggagctttttatacattgtttcacacatttattataaaacccctgcaacacccattttacggacaagtaaactgagactcagatagagtgactgcttaggaaacagaaaaagaacttaaactgtgtggcgatctagctggctgttttccaaggtgccaggggtttagcctttagccattagcatatttctcttcctttgtcctcccaaatgaggcctgaggcataagatgaggagagcagagatcttaaccgagggttgaagtgatttattacataagtccaaggaggatacagtgtgtccagaaacaggcttgacccggtgctggagcacttgaaggaaatttctagagaaactggacagcaaagcgctcatcagctgtgtcattaagccctccaatgagcttggctgggatgcgatctttcacacagcacagggccccacttcacagttggcgtatgcagtcacagttccctagagttctgggggttcctgagtggatctggtggcctgcccagcctgcggtccagttccaaactgcactctcagttataaaaagcaggggaatggagagggaaggcctctaggggtgatggaaggcaagtctaggggagccttttaaaaccaatctgctcttccagataaagaaagtctccaagcaggctggaagccaagaatttaattgtatttatttttgctattaccttctatttagggcaagggatattggtattctatctatggtagtggtataaagattccttttgtgataaattcatttaagtttttaagtgagtcaatttaaaggaaagtattaagtcaataaagtctagttagcaaaacgcatgaaggtagacccggaaaatgtttgaagtttatgcaatgacatcccagcctttcttctccccgatagtcattatctgccctggatggcagcaaactcatgactactccttgcaaaacttctctccagagtgactgagttaatccttcagaaagtacctacttacagaaaccatttataactgtgtctggaaacggcccagcacacaacaaaagaatccttgaataaaacaaccttatgaatgattcaaacagtgtccaacaaccctcctccaagagagggtggtcccaccgagaggggaggatgccttaggcccaagaagacctttcacccctgcaacaccactagattagaccctcatctcaccatcctctgaagctccctacctctctctggcacatctccccacaccatgtttgttgcatggtttcttgcctgcttgttagcttgtagctccttgaaggctaggaccgtttcagatgtgtgccccgttgtacttccagctcctgctacagtgcctggtggaaagtaggtgctcttttggagaaagaagggaaggaaggagggaagggatgaaggggagggagtaagttccttgagggaggctgagataggccccagttactgatattctaggatcacttacatatttctctctatggccaaaggagaaaaaaatgtggtaggggctatattagctccctgtgcaattgtctgatttgaaatccactgagttccattttttttatttatttatttatttatttatttatttatttatttatttattgagatggagtctcactctgtcgcccaggctggagtacaatggcgtgatctcagctcactgcaacctccacctcctgggttcaagcaattctcctgcctcagcctcctgaatagctgggattacaggtgtgcgccaccatgcccggctaatttttgtattttgggtagaggcggggtttcaccatgttggtcaggctggtcttgagttcctgacctcatgatccgcccgccttggcctcccaaaatgctgggattacaggcatgagctaccatgcccagctgagtaccgtcttatttagagaagacacccactttcatttttgcccctcatttcatggggaaagaccagcccacagtttaagtaagtattcctaacaggcgaatccgcagttctatatgggctctgaggtctcgtgcacagaagccaaaggactggagggatgtgaccagatttgggaatcaggcaagctggctccaggcaggctgagatcaagctgataacaaggagattaatgagggcctgcaacctcctcagtcttgtattagggaggagggttttcaaatcaatgctggtctggctggcttaatggtacctaatcttaccttttgaagctcacgcatttgggagttgagatcaattgagataaaataaagtaaaatgtgttgactttgggatttgtggtcttcatcagagtcccattgtgtagtgttgtttttattttctgtcttggaaataggcagagattagctgccggagagggttgttctgtctggactaggtggtctatttacttttgttctgcttttttcattttccgctcgatgattcttcatgagggaagggcccatttctttcctgttcatttctgtatagcgagtgcatgacacctggtacatgctcagtaactatttctcaaatgcagcattgcagcatcaccagcacagactgtgtgccacgagccaccctgctggaaaagccaatctgctcctgattaggtgcaaaaacagcagccttataaggcactcacagtgcccctggaaaaaggcgtcaggacggtttcctggtacctggtttctgtgatggttaccatgagctttgtgcagtcattgcaaagctgtgtgtgagcaaagtgcatccgatccattttacaggtgcttacaagccctgtgctgagtgctggcgactgaaaagatgagtacagcatagggaaggtgctcatggagtttgtgatctggtgggggagcgagttgtgtaatgacgaggaatgtgtctggaggtgagagtttcggggtctgggctttggttgtggatttgccaccaccaggccattgccctaagggcaggccctaacgtctttgggcctcagttttcgcatttataaaaagtggactcaatggacctacaggtcttcacttgctctagagcaacaaaactggagagctgtctcaaggagttttcctgtgcagtggagttcagcctcactggaaatagcaaatccatttgctgctacacccctaaattccttgccctgaaattttagagcagggcaataaataggtgttggtctattttcacctaccacctgctctacattaaaaagaaaagaaagctgctatatggcaagaggaagacaagctaatatactgggtatctgctctttgccaggcactgcatttgacattttcacatctcaatggaacgtcctgataaacttgcaggacggggagcaacagcatcgtcactgctgcacccttcagtccacttagaggaccgttgtgtcacagcaggattggtgttcccgtcaaatgacatcctgtataccgagttttagaaaagcacatgagtgcacgtaacgggatgtagaaaagctattttcaagcatagttaaatgtggtgattttggaagccttcttcacttaactatgaggaaaattcattatcaccaacaaacatcttatgagagtagtatatcagcctaattgccatccctgacctcccatggtgagctgacgtgtaataaaaacaaaaataacaatagcgtgctcatagtactgctgattcctaccgtaggagctccaaagagggggttccctaccaaggactagggatgagagaaggcaggatttggggacttgaaggaagagcccaaggacttgagctggaaaaagaatgacattggtgacctagatggagagaatggccaggaccaagaaagtttcccatgtgcaaggaggagctgttctcacatttgtgacgcggctgccacagactctggcagtgcctagaggtggaggaaagtaggggaggacagagggcttggagccaggctgtcaagggctgaagaactcagacttgattctttgagggtttctttggtttaacatggggtccggagacctctaaagaatctgtgatggggttcagatccacgaaccccttgaaattgtaggcatttttctgagcagatggttcaaacatttcaaaggattcccaaagggacccacaaaagcttaagaggagccgctgtggacagttgggacccttgaagtgctttgaccaaaggtatgtgcagacgatgcatcagttgcttggagggggcaggtgccgggaagaccacccatgggagtagcattgagggtcgggcgggggtgttgaaaaggaagagggagttaggaagccatggttatgaagaagaaatgacagctctgcagcactctcgggacagtcagtaacagctgcatgaacaactgagcccactgtgggtgcaggacatcagaggggaagctgtgtgttatggtcctatagtgagtttggttttaaacatgatcattttaagaggctgagtttatctatgtggaaatgaagacaatttaaaaattattaagccaccacttactggagcaactaggggataagagggcagcagaaccacccctctttcattttataggtacagccactgaggccctgagataggaagtgacttgtccacagtcacctcaatggtgggcagctggggaccaattcgtaagagaataacaggagagaagttaggctggaggttaggctagatctgaagccctctgggggagatggcagttgaagctcttagtgtagataaaatctctaaagtagaaaagaccccagaattaagcttgggtctttgctctgatttagagaattggaaacagaaaccaaggtagcaaaggccatgcagaagggcagtgagggaagtacgaggcaaccaagaggaagaagcaaggcaagacaggcaggtgctcccggtgggagggtccttacagacgagggcctcaggccaggttgtcggcagatccccagtggcatttgagagatacctccttccttggaattgtggggtgaagcgagattccaaagagaggtctctgataaaggggccagagagggcatactggccttgccggaggtgtgaaaaggaaggagaagtgggtgaggggtggaggcaggcaggagaataatattttaaaaataaaagagtgcatctgtaaaaataactaaagaaatgagaggagggaaggaaggggggagaggttcaatgatagggtcacagtcaggtgaaaatgagaccaaatggcagaggtggggaggggaagaggagggatgaaggttcagaggagagatgaaggggtgagcagggcctggaaacatggtaaattttaaaggagggaagattgggatcctctaacccattaggctcttcttgcctttcaagttgtggcccatgcagacctctctgcctgatattcttcccacagccctttgcaaggctggttccccatcttccttcagagttctgacagatgccatctcttgaaacagcccttcctgtccactccccagtatccatgcagtctggtatgcaccaccatttgcctctgtgtttttgtttttgttttgtttgtttgtttgttttgagacagggtcttgctctgtcacccaggctggagtgcagtggtgcgatcttggctcactgcaaccactgcctcccaggttcaagcaagtctcatgcctcagcctcccaagcagctgggattacaggcgcatgccaccacacccagctaattttttgtatttttagtaggaatgggctttcaccatgtttgccagctggtatcaaactcttggcctcaagtgattcgcccacctcggcctcccaaagtgctgggattacaggcgtgagccactgcacccagcccttgcctctgttttcttctcagcattgcccagtaatgggtaggtgtttatagctctgttcctttgctggctggtggggggtgtagggtggggaggggggtgagtgtgcgtttgtttcatgtccccaaatttctattttaagcaccttcaaactggagacaatttgtctccattcccactgcaaccctagagccctgctcagtgcccgttgcagagtaggtgctccatgatgctcgaaaaagaaaggcatgttaattgaaacaaagagaagggaaggtagaactcagccataacctatcctcctctcagaaaacttttaatcagaacagtaattacattaaaatgaaaatagcatctgccagctgttgatatgttttcattaccttttttactcttcacagttcacccttctgaaggagtgaggaaactcagtctgaatattctgcgagttaaggtggagctagggaccataccgaagactgtgttctcatttgccacctcattttatttttatagtgttgtatcaaagaggtatgtttgtcaagaaaacagggaagccatgtcccatttccctcctcctcccggccagtgggtgggtagtttccgcgcatcctcactgcacacttactgaagtactgccctattccagatgtgtcccgggaagccctttgtgtgccagggtgcttgacacgtgcatgtgatctgcctaggacaaaagggttaaatctcctgtccacttgtcaggcccctgcggtcatgtggagaagtcagcagggaagaattctctctgcctttggattcttctaatccctagagagcggcagacaatcccttttcactccggccctctttcttgcagttttctataagaaattgatggcaggagtgtggggagagggtgaggctctgaggcagcccccggtgtgatgccctcaatgacaccttcagccattgccctcagggcaccgtctataggcaccagcccagaccctgggggctaataggctgtgactttcatgtcccctccaggcccagcccaaagtgggagtctgtgctgatactcagggcaatgggaaaagcaaagaggaaaggacccattgattcttctttgtacctctcttctgtgggtgttcagaacacaagccagcctccccgccttctgcacagcctgaacgtcctgatggaatctgctggaaatattcaaagcacaggcccagaactgccaagaaggaaggcataggaataaaatcacaggggacaaccccaggtccctgcacacactccccttgccctgacctggcttcgtacctctgcctctcggatctgactgggtgaagctctggcgtctgtctggagtcaggtgtagtgacccaggtacattggctgcttggccctgtcctctggcttcccttgtcagtttgttcctgtgagactacattccagttttgactcatctcaggttctgacaagcccctaccccaacctcacctttgcacctactccccaatttggagacaatctgtcagacagaggtgtattcaaatcccgcctagagctccctcctcactgtcaatcttggcatgcgatgcttaacatctctaagtcagttggaggaagaaaaatgccgaactcatagggttgggacagggatgaaaagagtaaatccacagcagggactgccatgtggcaagggcccaggcagcattaactctggtaatgattactcttctcaacatccatccatccgagcaaggttcttctcatgcttgcatccagtcacctgattctagcatcaagctggtcacatccctggggccaccatcctctctatgacccgtcaccaccccacccgtacccaccacaagctatcgtggcattagttggacgcagccatttcccatgccctaagtcaacatggctggagttaatttcttccaccctgaacacatatttgggctttcccctagccaatcaggaagtggctcacagggaggacccaagaggcagaacctctcctccgccccctttcctccccagagccctgggctcctaaaagagcatggctgggaaaagtggggacggaggtcatggctgatgcctgaagacacctggggctgttacccttccagaggccagggctggcttcctcttcctattctatctgttggtcctcagcaagcccaggaagcagcctcatcaagtgtcttaggaagcatagaactcctgaatttccttctcctaagcttttgtttctgaacattacagggagaaaatgaccatgcccctgggtgttcctcctactgcttctgcttgattttatcaataaggatctggtcagctgagactgagaagaggcaagaaactagcacctctgccatttccttagggcctgcagtcctaatgtacctggcacgggaggggtttctgagtcagggaagtttgtggagaaagtgacatgagctgaattttgctaattgataggacgagtctagggatcttaaacccaaatgcctttagggtccaggcaagtcacagatataagtgatgacgctcagtgtaagacagtagggagtagtgtgggctgtagaaaaatgtagcatatacaccccccaccccgcccccacaacaagaggacacagatacttcccaactccagcaatgactatggttcactgttaccagatcttctgactgtttagaaggagccagaaatgaggatattttataacgactagtctcttgagttttaaacagtagcctctgattttaaaaaggtcgaacatgcaagcccctgaacacatgtttaggctagatatgacccagggctggcagtgtataaactctgaagtcagcaaatgaaaaatagaacaagggattccagagagagggcacgatatttaaagacacaggcttgtgaactgagtcacgcattccagaaactgccccttggtaggaggtggatgtgtggaaaagaagatgaggctgaaggggcagttcagaaagggtctctgtgccatgctaagggatctgaacctcattctgaaagctgcaggggtcggtaagagagactgaagagtttaaaggagagagaggcatgtggcacactgcatttcggaaagctgtgtctgtgtagggagggctggcagatcagcagtctctgcacatcgcagataagacggaggcacaggagagattcatggcagagggatgagggcactggcactcaccctcaggtggacgagctcaaatctggaggctgggggacacttgaagggggggtgggggtgtggtgagggagagtggggagtgtggacatcaccctggttctgaatgaactaggggtggctgccattccctgagaggacaccgggagagacaggtggaaggggtggaggtgggtgggaggtgtgtggaggcagccaggttgtgctgtgactggagccgggagtgaggtgtccagaggcagatcagacaccgagggacaatggaagcagggtttggaaaaccggcgcgtgcaaagggcacactcacaccaaccccagcatcctgaggggctgggaaagagaaggtcaaagaaaacccggagaaagtgttgccagaggatgaaggaggcgggaagtctatggcctaaggggtacttcagggtcatgctcaggtcactgacagagcagagagaacgtgccgttggacccgctccaggagacatggggacatactgcaagggtctccctgccagggtcccgtcgggattcagtcctgcacagccccgtggattgtgggcaggccttgcccacctcctggccatgtgatcttcggatgtgcctcttgtgctgaagaaaaaaaaatgcacatgtccactccccagcaggccccgctctgaacgggcccccagcactccatccatgaaagctgcaggggcaacagcaggtgcctgttctaccacgctagcacgctccactttctctcctccactgattcttatttctccctaatggactgcactcttcaaaaccaacttacccaaggacagcttttccaaggggacttgtcaaactccacaggcagcaactggtttgttcctttccaaagggcagtagccatcaccttcaacaatactgcaactaacatccacctctgtccagtccttcttattttaatcctacagcaggaaccccaattgacagaggaggacatcaaaactgagagaggtctagggctgcaaaactagaacccatcaggaaccagaactccagtcccctctgccggtggtcccatccatcctccttccatctgacaccaaggcttcctgagtggtaaccaccatggctgctggagcagaggaagtggccgttgccttagaaccaggcaggtggggaaggggacacatcaaatacccagaagaaaagtgacttcaaagtcctccccaaattgagtgccctccagaaattctctcacgaagaggctgcagctgacattcacagggatgttgtgtctgaatgcgggtacatcaggaagggaacaaaagagagggaagaaagcctggttgaaggcaggggtctttcaagtcccctcgaggcagactcaagagcaaagcatggcacactggatgggcgttctgcttctctttaaagagcatggatttatccataccatgtgacatgaatgaaatgaggagttttcagggctgccaacctcttggttaaggttctgtgtagtatatttctcctacaatagaaaaggaaaaatgacatctgaggttaacaatgtatctgcagtgcaaggcccagtgactgtcaataatggacgctgagtaactaagcaatggcggattgcatgaattttcatataaaactgctcctatacatcgctttgagtgtctgggtcacgccttatccttatagtgtaatgtgagcggagagtctagcttgaatattttcccacttagctaacttgccatctcacaactatttgctgagtaacccttgcttcctcttaattctctggggcctcctcgacatatatttaggcaggaggtgaagggcaggacgcagggggccactttctgcaggcataggaggttgggcttcatgcagaccacaatcaaatccttgctctgctgctttgcttgctgggtggccctgggcaaatcacttaacctttttgagcctgggtgtcctatttccaaaaccaagtcagaaataagaaagttactatgggcctggcatggtggctcacgcctataatcccagcagtttgggaggctgagcccagaagatcacttgagcccaggagatcaacaccaacctgagcaacatggcaaaacccaaactctactaaaaataacaaacaaaaaaaaaatatggggcatggtggcacacgcctgtagtctcagctacttgggaggctgaggtgggagaatcagctgagcccgggaagtcgaggctatggtgagccatgatcacgccactgcactctagtctgggcgacaggagtgagaccctacctcaaaaaaaaaaaaaaaaaaaaaggcttcggtagagtgcctggcacatggaggggctcaagggaatgaagttcttaatatttttaattgatgtcttggaatctgcatccatgtctaaggaagagacaggcaagagaatttttgtcctgtctgggacaagaatgatcatttgggatggtggaggcatcactcttacagagtgaactttgattgagggggagagaagctgtttagtttgaaaatatatatgtatatattcaaacggtatagaaaaactgtagaaagtaatgctgaacaaaatcttgttgggtgtaaatacagagaaaaatcacaatttttaattgtggcacctctgccaggggaacagtaggatcaaggaggaattttatgccattttaaatgaagtcgtaaagtgttgtgaggggatgacgtaaaataaaggattttctgggccagaaggctcttaaagatgccctggggactctaacccatcccttcatttgggatcctttgtcatgtctcttagccgcagcatgtttcctccagggggtgcccaaggggacatttgcctccccactcccagagagaaggtctctccggggccacgtgtgagccaggcagaaggtgggaaccagacccagggagccccagttcacctctccaggaaggagggagtggccaccctcatccaacaccgatgcggttccagccatctgggggctgaagaatgtcattgcaaggtggccatatcagagctctcttggtacagggacaggaacacaaaccaggcaggctcagaagaagcagggggtggagtgaggaaacagagacaactagtgtagacggacctgagaaagtttgcaaagagctggcgagagagaaatcgctgaggggaatatggacttctctgaatcctgttttctacaggagagggtcatcttcggtgatttgggctcatctctccattgagtggtcctctctagaacacactgggtgtgcgggaaatacaccctcccacagcaacgcagagatgagcaggacccgcatcctgtgcctggccatggtctggggagggggtgctgaagccgaacgcatagagataatggtggctgaatatagggggcacccttctgcaggtatgtccaggacgccgaggcagggtgagaggcccaggctcgttgtatagtagggagctccaaaattgggatgggggaaccagcaaaggctctatagccatgagcaccatagagaagtagtcctctctgcccacaacttttcactaggtccagttcaaccaacagcatacatatatgtattgccctgggttttaattgctttggtttctgggattttgagtgttaaggatttcagaatgcagcattatcttagaagtctgttttttgttgttgctttgtttgtttctttgagatagagtctcgctctgtcgccaggctggagtgcagtggcgcgatctcggctcactgcaacctccgcctcctgagttcaagcgattctcctgcctcagcctccggagtagctaggattacaggcgtgcaccaccacgcccagctaattttttgtattttgattagagacggggtttcaccatgttggccaggatggtctcgatctattgacttcgtgatctgcctgccttggcctcccaaagtgctgggattacaagtatgagccactgcacccagccagaagtctgtattttaaaggctgtctcctttataagatgggtgcagatcagaggacgagtcctgcttcagttggtagtccctgtttatgaatcctttctggttggcgtttctgttcacttggatgataagttatattgtccccccgccggttataggtgacccacagtttcattatgagaaagaggaaggatcaggaacgattgcagtgagaaatgcttggcatccaggtgacttgtttacttgcattttgatgtgcagatgcctctaagtacctttatgtaaagactagggaaattggctggaacataatgaaagcccaaagttctcagggatgttttctgaagttgagcaaaggagagagccaagggtgagctggtacctttttgtacaccaataaaagctgattaacaagcaaaagtttgctggaatcgaagcaaaaagataaatccaatcaagctaatgtttaaattgaaggcagaagggatggcaagaaaagaactgagcagtcaataaggagagctcaggagtcatcataaaaagagagacacccaaaattctccccattggcccctgcaacaccctcagacgcccaataccagagatggcaactgtcatggaaacaacactatcaaggctgaaaccagcataggtctccagagctgctgtgcccagcggtgtctcagtatctatgaggttcaagagcttcagtacaaggctaagacttgctgtataggaaaagtatctcaaaggctgttgagcacctcaataaagctattccgcccgtcttggtgagcaagaagctgtgtgtgtgaaattgggggacagtaacaaactggaagaaggcatgaatttaaatctaactgggaacacatctaaattgggtgcaaagaccttactagaagtgctgcttgctgtctgtgatgttgaagctgctgcaaggagccacctatactgtcacaatgggtcctggctggcaatccaaaagtatctagccaatgccagctttcagcaaggtccatggtagttttcacagtggtaatgggccggcagtgcaggagttcatggttctccctgctagaaccgtaacctcaggaaagccgtgctttaccagaaggatgtcatcaggcagaaatatggcaaagattcctcctagtgaggacaaggggtgttttgcttttcacatcgtagagcaggaattagcaaatattggctcacaggtgaaatccagccagctccttgttattacatggcttgtcctccagccaaaaatagaaaaattcaaaagaagaataacatcagtatcaaatgatttacaataaatcaaacactgttcttactctttgcattcattagctcatgtgatctttacaatgaacccatgaagtagatactattactctatagatgagaaaacagatggaagcttctagataggttaagtaatactcaaagatcatacagataatgatttgttcagctataattacagacccagcgagtgttagctccgagcttactctcttaacgtgcttccttgtatgaaaagttccccagtgctttaaaggtagaaggtaagttcctaaagagagattcaggtatcacattctggtgtgttcacaagagggaagataacagtgtctcagagaaccaaggaaaggctttgtagaagaacgaggctacctttccgtcatgatggctggaataataactttgaatcctaattaagcaaaatcatgtgccctcccccacaaaattacattattctcattaccaggcctagtgaagttttttatgacaaaaacgtggtctcaattatgactatagcttaaattttgtcaataaattattggtagaaacttattttctctcttgttacttaagtacctgcatagtaccatctgtttttcctcttgtcccatacagcctaaaatatttacatttggcctctttggaaaaagtttgctgactcatatcctagagaatacagaacactggagctgctatggaatgtgattagaaagcctggctgtattataagtagtgaatggcatggacaatagcctctagttcttacagttcaggaaatatgaccttgatgttcaagcctccagatgtccttagcagttacatcacttctgaccagctggtaggcaggtacaagtccttcatcaaggactactcggtggtgtctactgaagatgccttggaccaggatgaccgagaaacttggcagaagctctctgctagtgcaggttatatccatgtgacagggaatcatctccctgtgcccagccggaaaggaactaccaagactacagacaaggactcgggcaactgcctcctactcaaggtgaatcagacagaccccatgatggaatctcttcaggagtgcaaagtggcccaggccgaaggatagggcgctatttcccactgtgttggggtgactgaagattcttgcattgccaaactcatggtgaggatctgtactaggtcaaccaaggctgcggccccttgcccatctaagcacttggccaagtacagccacctcctcaggtggaaaagaagatgggtagcacctttggttgttctgcagacaacaaattcaaaaagctcctagccaagtaagttctggggcaggcgagtgcctgagccagtcaagcacttgtcagctggtgggacctctactgctattctaatcatctgtgctcaagactctagacactaccactttggaggggtctttccttgctcatctctgtgatgttctgcctccttagaactgccgtatcaacttctgcatcaaatgccacatcttctgatacgtgctgtgtgtcagatgagaccttgaaaacatatgctaagtgacagaagccagacacaaaagaacaaatagtgtgtggttctacttacataaaatagctaaaataggcaaattcataaagataggaagtagatagtagttatggggaaaagatgtaaagagggagagtttttgcccaaagagtgcagagtttctctttagatgatgcaaaagttctggagacagatgatgcttgcacattatgaatgtatttaacaccacccaactgtacacttaaaaatggttaagatgggccaggcgcagtggctcatgtaatcccaggtactcaggaggctgagacaggagaatcacttaaacctgggaagtggagggtgcagtgagctgagatcacgcccctatactccagcctgggctatggagcaagactccatcttaaaaacaaatggttaagatgttgtcttagtccattttgttttgctatgacagagtatcacaggctaggcaacttagacagaacaaatttatttctcatagttccggaggctgagaagtccaagagcaaggcaccagcagggcagggcccagtctctttgcttgcaagatggcacgttgagcactgcctcctccaaaggggaggaccactgtgtcctcacgtgacagaatggcagaaaaaagtgaacccactcccaaaagtcctctttatagtggcattaacccattcatatgggcagagcccttagacctaaacacctgccattaggccccacctcctaacactgttgcattggaggttaattttcctattcgaccataaattttgaagggaacgaaacattcaagcatagcagatggtaaatttcatgttatacgtattttaccacgattttaaaaattgggattcaggggaagaattcttaaaagccttcgaccactgttgacagccctggttgtagtcatgtgactgaccccaagtcatcctgttcctcacttttctcctgtccatgtgtccttggagtttgttcctgggctgtcaacaggcataaacctcagtggctttaatgtgcaaattgaaaaaaagcattcattagtctcccaaaaatgtgaaggaagaaccatctgcaaattcatgaattgtgctttagtttcatcttctattctcaagactaatcacctgtttaagttggctctagactcttaattaaaattgtcagctcctgaaagttcattctgagcctgactctcccatgagaaactgtaaacgtgggaaattctaacacagctaggagattccaacatactggaccttaccttacctataaataactgggcttggtgtatatatcaaaatatcatgatgtaccccataaatatacacagttacgaattttcaattaaaaaattattaaaaatgaaataaaataaacaattgggcttggatgaagaggctaagcaaaaatgcagttttcaggttttgctacttgcttttcactagaatagatccagctgtgtgtggtgtgattttgttttacatttttttaacataccatttttatttactatcatcgtttactgtgtacattctactaggagagaatataatgtccatagtgtgaaaaaaagtttgacattctttttttttttttttgagacagagtcttgctctgtcacccaggctggagtgcagtggcaatctcagctcactgcaacctctgcctcctgggttccagtgattctcctgcctcagcctcttgagtagctgggactacaggcgcacgccatcacacctggctaatttttgtatttttagtacagatgggattccaccatgttggccaggctggtctcaaactcctgacctcaggtgatccacccgcctcagcctcccaaagtaaaaattgacattctaaaatgtagacctttaaagtcgtcaacctctacccttacaatggttgagaatattgcagcagggtcaaatggacagttgttattactagtattataccttattctatagagttctttatagtgtgcaaaaagtatccccatatgttttctcatttggatgatctaagcatctctgtttctacaatttcagcactctataaattatctttagcaaatgtttcttacccgatcatcttctatcaatcaaccaggcaggtatcagcagttccccatcgcaaggaatataagcttattttaataacatttgaggcaaaacctaattagaaaaaacaaatccctcatcaattcctgtgatttattctagagccaaacatctgcagcccagtttctttgaatgatggtcttccctgttctatgaacaactgagaggtgaagcagtgtcttgtacaagtgtaaataatgtgcgggaacacagcacataaactgcagggacgacttcagaagaaaacccccacttaactcttgaagcctgatttgcttcactgagtcccaatggggcaaagcactgtgcaaggctaagaaagtgaacaagacaggcttctattctgttttactgtaggttctgttattatttaggtatgtcaaggccaacagatgaagcaatgactgccacgaagaagatagtttgttatactcacatcacggggctctacacaaggagatactggggttggtctggaggcaggaggagggggaaactggtaagagcctttattgtggtttgcacaggaaagaatgggcacggtggggccagagcgggtctaggattggctagtttgagtaacttcagcaggttctgcagggtgggagctgtcgctagttgcatggtacctagcctagggtacttagggtaggggaatacctggccctacaacagggcaggggaatactggcccccagtaaatgagacagtaggggtgtggattcaagattgcaatttgacaggagcgttcccaggaagagtcgtttgctgtctctagaaatcagctaaccctgagaggggcagtttctccagcgtcagaaaagccccagatgtcaaagcattggaatacagaaaataaaagacatggttaacacgccccctcgaggacttacactttattgtggcccgcaggaggaagccgaacctggcacacaaatccccaggccttggtctctttgactgtatgaggaggagttcgaattgtgtaaatgacaagattttgtaaagcctcccatctgtgattccatgaagtaattaaatatgagaagaaggtggcaaatgctataatagaattgagtgctttgggaaaaaaggaaatggcagctgagaattgaaaattgggatggtttggaagggaggcaccgatgctgggttagggggtttgcatggaaagatgatgtggatgggcgggctggtggaaccgggggtgaggcatgggggactcctcttctgagaggcaccaggcagaaaacaagagttcaccggcaaagaaatatctccaccaaaatatcgagtgccgaggttgagaacccctgagtttgagtaagaactggcatggaaaagtgcatggatttgtagtatcccaaatcagcgagatttgagttctccaggacctggctggaagcaggaaaagagaaaggctggagccagctatttcaaggcatttggtctcctccaagcctggctctcagggactgggggtggggctgtgaggaggggaggtattgggcaaagtgtacaaagtttcagacagaagaaataagttctagaggtctgtacagcataactacagttaataatactgtattgtgtacttgaaattgctaagaaagtagatcttatatgttcttaacacaaaaaatggtaagtgtgggctgggcgtgatggctcacgcttgtaatcccagcactttgggaagccaaggcaggcagatcatctgaggtcagggggtcaggagttgatcaacctggccaacatggtgaaaccccatctctactaaaaatacaaaaattagccgggcgtgatggcaggcgcctgtaactccaactactcgggatgctgaagcaggagaattgcttgaacccaggaggtggaggttgtagtgagccgagatcaggccactgcactgtccagcctgggtgacagagcgagactccatctcaaagagaaaaagtaagtgtatgaggtgatggatatgttagttagcttcatttaattatttcacaatgtatacagatatcaaaacatcatgttacgcatagtatatatacacagtttgtttgtctattatgtcttaataaagctggtgggaggttgggcacttggcaaaaaaaaaaaaaaaaaaaagcaaagattaatgcatccctactgtctcttaagctatactccatgagcacggggactatatatatctagcttggccaaagcctgaaatataatattactcaaaatatttttgttgaatgaataagaaaaaaataacttagatatattggtatcctcatccagagccaccttagatttcatgaaagaaactgggtttgggtttgttgaggtttgcttttagtacaagccaaattttggatttttataaagttaaatctgtcgacatttttttttgtaatttcttctttttcttctaaatttaaaaagtccctcccatacactcctcagccctcatcaaagatttgatgaatatcctcttccctgttcttaccagtttcttgtgggtttctttctttaaatattcaactgttttggccaggctggctgggtgcagtagctcctccctgtaatcccagcactttgggaggccgaggtgggcagatcacctgaagccgagagtttgagattagcctgatcaacatggcaaaaccctgtctctactaaaaatacaaaaattacctgggcgtaatggcaggtgcctgtaatcccagctatttggaggctgaggcacgagaatcacttgaacccaggaggcggagtttgcagtgatgcacaatcacgccactgcactccagcctgggcaatgaagggagactcggtctcaaaaaaacaaacaaacaaacaaacaaaaattaactgtttcattctgtctttctcagagggtggtgcaggtactcctggtactcgtcgtgataatgtaagattatcttaggaattctattgataaatattcttgtgttaatggtagtgtagggtttttttaaataactttgtaatcaagacatgaaacctgatttcacagaggatattgcttagggtaagggtaagtttttaaagatgggtctgttttaaaatttaagtggataatagtgtgtgcagttgataaatatgaaaaactggtgatagggatctgaaaattactaaagtttgggaaacatttgttaaatccgtgatgttttttctgtctagagtaaggtgacactcaactgtttttctcccaactcaaccaccagatcattaaccaactattccaaactatttatagaattaactctgcttgacttaatgtctggccaagcaggtctcccctctccccaaggagggctgattttgagggttagggtccagctggtggcatgtgagcagacagtgacccacgggccatagcacatccagcaatgcccttgggacccaacccaggtgaatgtgggttacaggacaggagctgacccgacattcccggaccccaacatggaagtacaagaacactgttatcccaaggagatatttccaaggggaaatggggagggacaaaaataaatattaggcatcaaattaaaatgagaagacccaacgttactctttgtaattgagaactagatttgtagtgatgaaatctggaaccttaagggagaactaaagtgagacactgggtaggtcataataccctttctgttgtctaattatctgcctatgaaatgggtaaatatagcctgttgccaaataatgttgaaaagacaatttatctggaaaagacatgtacatataagcatgcacacacatgtgtgtgcacatacaatgtgatatatacaagtatgtgaatcctaaggaaatcagatacaaaatccagacttaaaaccagtgtgtggataggcaataactccccccgcagtgttctcatttaatgacaaggttcctttcaatacacagcttccccagtgattttcattatttatttggagtctgccaacaccttgactgaaaggctaaatggaactttaaaaactgagaaaagcacccagtacctccccacaccgcataccccatcattttttaattaataaaaataatgaatctcacatacaacttttctaaaacatgcagggcaaaaagtcgggggtactcgaggcacatgtatttatccatccaccaacctaacgtgtcagtgaagcgggatgaaaccgtgtggccagacagaatgggatttggcagaaccgaatagagtgtagggctggaaagggccttagagtgcttttacttcaaaagcctatcctacagaggaagaaacaagggatctcatgactcacatacacccttctcacttcccagtagagtgacaccacttaatactatttcttttgccaccaaagagcaaattatgatcacatttgaatggaggcactgttgagttaaccttgctgcctctgttgaatttctggtgtctcaaagttggagagaatgcaatggacaacagctcactacatgtgagtgaaagcaagagaagacagccagcaggtgctgagtcatgctagagcagatgctgagtcatgttgaattatgctatcctgtgggattcaccaggggagactaatccccagggagtttatttgccgtcttaaatgagggactcaagtgagaacctggctacttactaattggaacaatattcaagtggggagaggggcaggggaggatccaggaggtccacaccctataaaatgtttgggctgtgtctggggccaggactttgcccattctgcagagtccagaatgaggtctcttccaccctctgtagttttccaggtgggctatgggatctcctggcaattgaagagggctttgcaaagatgagctgggtttataaataatgcatttcctttgtcttgcaggaattcgggaggcagaggtacaatcagatcagctgtgaacagcttacatagcaaatctaataggtttgtaaattagattttgtgttcatttgtttttgctgtaaggcagctattaatctgcttctcttctttgctggatggtgcccttcttacttagcaaatagatctgtttcgtttcactttggctttgcatttccctaatcacttttggggggagctgtcaatggaagatcacatgaaatggcccaaggtctagaggctgcagagatggaaaatgcagatgggtaagagtcactttctggaaaacagcccacccactttgtaatgcctgggacaccaatgagcttactcaaacttgcatgtttgctgagcaatggagaccctgaagggaaccagcattttcactcaatttcattgtggtaaatggctcgtccaggaggttaagatggaaaataaagcattcgggaactttgctgagacctcttaaaatatttagggagtcaacacagtaatgttaaccctgattattgaacgtacgctccaaattctgaaagagtgtttctacttcatgtaatggtgcagaacagtcattgccaggggacagcttgatgcaggacagcgtgcaaacccaggcttgcccctggctgtggctacaccatgcttctgagtccccattctccatcaatgacaagtgccccatagctatggcctgtagtcttataagcttgagcttaaggagcggtggaaggaagtgccaagttatatgatgtaaacaaaggctactactcaaaatcagggccttgtttttctttctaaatatcctattttggtcattgtgggaataagaggtccatatgatgcagaggattgtctattatttgcccttccatatttttttagatctcttttctgtatgagacctgtgaagtacatctgtccctgaccctgcatgactgactcgagaaactgttccctctgtccctgacatcattgcttctagctctctaatgacctcttagccaccttggagctatgaatgaagcccgtgttatgccaggtgaaatgtgaatatggcagaaagaaagaaggccatgtgctcctaagtctctctctgttctattatgaaatgatgccccatttcggagaaagaagatcctgcccctgaagcccaagtcctcgtggtagcttgaggggccacagtctcatatgaatcaagtatgagaagtggaaaaaaacagtcctgggagccaggcagccctggcctcagccccagtgtttgttagccaggaccttaggcaagtgattttacccctctgagccttggcttccccatttaattagaataatactgcagtgtcttctttgaggagtgtttaaggattagaaccaccaaatgtaagaatctatctaacccaacacctgatatgttaaaggtacttatttgatgcttgttactactactgtggatatatctgtggcatgaaaagaaggtcactgggagtgaagttcaggagtcgggaggtgaagcaacttaagcctgaaatgtacctctagtgtcattttggaaatgggggaggggactggaaacaggagaacacattcattgaaaaggaatatctcaactcaccaatccaacgtgtttgtgcagcacacagcatgtaaaacctgtgaaccgaggtggaccctggagttttctaatccaccccctttattttacagataagaaggcagagtctagaaatctgaagtgacttttccaagtcccccaggtagactgcaactgagccagggttaaaatcccttaagaccatgatgggctatgcaggatgccatccaaattcaccctggaaagtggagagagaaatggaattttaccattacccacaccagcatttatctctctccctttccagcctttgccatcttgtgtccaggagaagtctggaaacctttcctggaggtttccaagcaggtctcctctccaggcatccacgggagaattcctctgcagctccttctttcctgagcctagtgccatccagtgtgccccagtctctgagaagcatcaccctagactgaacccaccttaagccatgagacaccagagcccagtcactgatttctgatgagtacatcagctagcctcttagtgcgataactcctcatcaccaacattaaagcatttctgttgtgcgtgcctactgaggtaggcttcaacaaagctggggtgaagccgctaattctgtgtcgctgaggtcagtgcccctgcctgtgttctgcatagaagttggtggtatcaaaaggatgcagcaatgccagctcctgctagagcctcatgaggtggcagccagtggggcatgccagaaacatcggtgctcctttgaaaattccagaacctcacgagatggatatctgtctcttctacaccttgtttctataaatgggcaatctgtggctcagagaagtaaagctatcgacccacagtcacacagcttatgaaatctttccactgtacccaatgcgtcttgcatgaaaacagtaaaaattccaaagggttaggtcttgtgtaccctctcggaagctcccttaagcctgcatgctaggaagagttcctctgccttactcaaaactcgtcaattctctatcctctgcgaagttacagatatttgaattcaagagaagtgatatcagccagaaggagtcagaaatattgaggaatggaggtgggtgcatgaagggaatgtgtgagacaacatgcacccctaagcgaagtccttctctacctgcaaaagtcaaactagggccaagcatggtggctcatgcctgtaatctcagcactttgggagaccgaggcaggcaaatctcctgaggtcaggagttcaagaccagcctggacaacgggcgaaaccccatctttactaaaatacaaaaattagccgggtgtggtggcattcgcctgtaatcccagctactcaggaggctgaggcaggagaattgcttgagcctgggtggtggaggttgcagtgagctgagatcatgccactgcaccccagcctgggtgacagagcccgcctctgtctccaaaaaaaaaaaaagaaaaaagtcaaagtggagcgtcaggtttagaactcactaacaggatttcatcttttttaacttggctgtttcaagataaatggagaggacacagatgtttggtttgaactctttaaagcttcagaatgtgtcatcacaaatccacttattctaactgggagaatctgctgtcagcacagacaaaaagaactttggatgtgacccacatatatctgtgtgcatccagcagcaaggcggctaactcttacactgcctttaaagatagaattgtaacctagtttatagaaacctactagcatagatttcaagcctctgaattcaagccagtcctataatacctggtgttcctgagtcagatggaaagggggtgtttacccagaatcgtgatccacccagggagtataaagccagccagttctttcattcactccaggctcccccgggatcgatttcaacctaaattcaacaatacttatttattgagcacccgctatgttagaccattagggaatataaaatgaatgtgggagatcccttgcgtacagtctcctatgagggacagacacagcacagatgactgtgtaacaaggtccatgtttcaaggagcatatctcagaattaccctcaagagagtgatggggctgccagggaggagggtgaagccacaggctacaatgacattgtcctggtatgagttcttgttttctcttttaagtttgtaagaccatcatttgatactttgttgctcatatacctgctccttgtagagtttcttatcaatagcttgaataagaaatattactcttctgacagtgactgccaggttttaccaggaaaaaaaaaatcactaggggcaggggaagaagaataagtttatcaccctccttcctgtctccaacaatgtatgtaggttataccttagggacagagtttctgcattactggaagataaatagacttccttctcttctcaggtaataactgcaattttgctcttctggagaagtttacattcaagcccgtgcaaaaacaaaactattagacttgtcgtcggcttgctaacacatcatgtctaccctctttctttttttttcccttccagagctgaagttgtaataaacggctcctcatcaccagctgttgttgacagaagtaatgaaagcatcaagcacaacatccagccagcctcgtccaaatggagacataaccagacgctctctctgaggatcaggtactggtaattacctacaggacaagaggtagacttggtcttgagcatacacgggcaaattgcttctcttcgtcatctaaagaagtcaggatagaaataaaatgtttacctcccactgaggcaggtttcatctgtaagtgatcaatcggaaataaaaacccgagacaagcctagcggcccagcctgtgtatgtggcgactggggccaggcggtggcaggaacacccgctgaggttctgggcttagaagcagcaaaccttgagtctcgggtcagcagcagagggaatctgggcagtggaggccacaggtggctgcttcttcccaggcataaagagtccttacttgttggggtctgcctgggagtcacatcccctttcagtgacagtcctccagtttgttcctggagagctgctccctctctcagcccttgggcttgtataggctgctcctccctaacaacgtgaaaatgaaaacctagagccataggggcatccggagaacccaggaactgacatgacacccgaccagaaagcagaggtctgtttagccagagagcagctctcgtcctgatctgtgcagagtgatgttttcagagcactgcagccatcatcgggtagtggcaatggggaaccgtagagaaggaattacaacttcggcattttggacacttagcttagatatagccatgattgacccagcaaatatttgtaagtataatccaactattcagttccaggcatcgtgctggggccccaggagtgctagcatgaatcagacatgctagctggggacatgaatataagcaaagacaagacagcgtggtatgacatacacatgaggtggtgctgcatcttacacatagatggaaataaacaggccatactgagcaaagagtcattcattttgtaagaggactaagaagactggccaggaaaggctggccaggagcagtgggttttgaaggataattaggagttcaccaagctgcttcccacatgcacagagtctgtgatctggtgcttgtggacagtgctgcaggagcaggaagcaggaggcaaggaataggggggtaaggttgggacgataggcaggaccagacggggaatgattgatgaccatcccaggccataccatggggagagaggagagcagccatcagcaatgtcaccacgcagagcagggagttgccccctccacaaggctcactgtcaaaatggaaatgcctctgcaccctagttcttgaagcttagttttgggacctgtgcagggctggggaattgaaaggcatgagctctggggacctagcagctgagaaaccatctgaagtagctgactccctgccaccctgcactccttacttaccgcctcttcagaggcctcctggtggccctccatccccctcacgaagccctaacaaccgccccctttgatcagggacaccgtggagtcagcaaccccaactgcattagctccctagggctgctgtaacaaattaccaacaacgcggcggcggcctaaaacaacagaaatgtattcttgcaccgctctggatgccacaattctgagcacccccttgcaggctccaagggagaacccatcctctcaccgcttccagcctctggtggccgcagaactccaacccctgcctccatcttcacgtggccctctcctctgtgcttctatcttcttctcttctgtctcctataaggacacctgtcattgtatttaaggcccacccgggtaatccaggatctaatctccagatccttaagttaattacatccgcaaagatgttcttttgacatgtggtcacattcacaggttccaggggttaggaggtgggcatatattttagagggggtcaccattctccccactacaccaccgtgaatgaaatcctcctgccagtatgagctacccatggtccccaatgtccctttctccaaccattggatagagaaatagctcccccaccccttgtgaagacgagactgtgtccttcataaagaccctgcaaacacagtcccttcagcagcaacaatgtacctttacccagagggaaaaagaatttcctccagcttcaattaatcaccaagattattcataataaaagattctgcaagtgatttggaatgatgtttaataattgatggtaatttctcctaattagttagaaattaattcactcacagaggtgtttatttatgggctttctaggggctctctttgtttttaaatgctttggggtaagtaattgcaaaggtttcagcaatttcccaactatattagtttgtcaagtcatataatccttggtaaagcacagtaaataaaaacagtgcctctgttttccatcaacagatacgaattattctacaagggtggtttcccctacatgatagcaagagaggcaggtcatcaataaggaaagacaatggatgagacgcgccgagcttaccaagtgttctagctgccccctggctgccccggaggctcttgaacctggacacacattaaagtcacccggggagcttttgagagcaatgctgagaactgggccactctcagaatcaagatttctcacatgtcagcctggaaatttgaaatacttaaaggttccccaagtgactgaatgtgcagcctactggaacgtaccataggttgtgaacatctcaaatccagcaggctttcaggcctcagtgttactatctgcgagatgggacagccatcctgcagcgtctaacatttgcaaagtgcatgaaaattctgcacctccaggactctgaaaacaaagaacagcatctttgtatctgttctagataggaatttgcagcagaatatgaaattaatttcagcttatctaggtactcaattcctttctctttatgactggaatcatttcttaaaatctcaggtgatttaaacagttctttaagtaaaacgcccagctaggattttcaggttccttggcagaaggctgtgtgtttcaggtaaagcttttctggcaaggctaagaggacacccatccctttcctgaccccactccatcctttctttgtgctttgctagatgattcgattcgagaactttctctaaatcaaagctaccccagagcctagagagctgtgcttcgttctgaaacaatgcaaaggagcccttctccgtggaactgggaggggtccatgtttacaatccccccataaacactagagagcaactagagggggcagcaaggggacgtgcaccagcttgcaggatggcaggccatcctctcggtgtctcaaaggcagaaagtgtccatacacgtcacagtatccatccccccagaaagcccctttgcaatgtgcccagagaaaccttccgtggaagaaaatgggccggtaaggagtgagaggcgcctgtcatctggctttctgctcctagacaaatttattatccttttttcaaaatctaggaagtgtgggagtagcagagaaacttagattttatacctagccattcattttcatccccgtcagaggatggccctaaatccccctaagacagtgagggtaatgtaagctcaccaaatgtctgggtgtgccccagactgtggggctttcagggacatggggctttcagtgcccgagccaggcagtcctggggaaactggggtggtgggccacccttccttctggggcccgctgtgaggagctcactccagccctaatggagtgattccacagggcagttttcacctagcaaaggaagagggtgtaaccctggcaacccccatattggccaccaccgtagttgcttctgggccacttctggccatccctggctggaacctgttctcgagggcatctgaactctcatcatactctgcgtgtttgctgggctgcagccaccgtgcagggcgaccctggataggaaaagctgggctggcaaagggcagctggcaccctggagaatttcctcacgcatgtttggttttcacaggaagcagattttaaagttcttggatgctgaaaaggacatttctgtcctaaagggaaccctgaagcctggagatattattcattacatcttcgatcgagacagcaccatgaatgtgtcccagaacctctacgagctcctccccaggacttcgccactgaagaataagcactttgggacttgtgccatcgtgggcaactcgggggtcttgctgaacagcggctgtgggcaggagattgacgcccacagcttcgtcatcaggtaacatgccccagcaggcactctggggccagagcggcgggcaggctgtgtttcagtggagcattgccagctgtcccaagagattgaaacaagaggccctggtggagttagcccctgctctcaaccatgactgctcatcagaatcacttggggagcttcgcctccaatgtccagaatgtacctcaaaccaattaaatcaatggaggagaggggaagagaggcgtggcaggggtgcgggcaacccagggagcccaggtcattctgatttacagccaaggttgagaatcactgatccacagcaaagatgggcagatgctggcctgcagcctaaagtttggttggaacacagccatgccacccgttttcatatcattgatggctgttgtctcactacaaggagagtggagtcactgggcacggttaaatcattgggtgaaattgcagagtcagaacagagagatcatatcacctgcaaagccaaaaatgtcattatctggcgctttatagaaaaagtttgctgatcccctgaggtagagcctggtacaaaaggttggtaagaaaatctcctgggctggccagttgttggttcaagtttgcaaaactctttgtaagtgtcttgggagggggtgccctactagtgactttattaccctgttctcaaaatctgggaagtgcgggagtaacagagaaacttgaattttgtacctgactataattttctctaaaatatcagctctcattttccagttgcctgggacatttgcacacaaggttgcccatggccctgccacctgacccccaacccactacagtcatggaaacaaggctttgctgtctccaggtcaaaattagggcacgcggagcctcgagtttcattccagccggctccccagccctggcagaaccgcaaacgttctcatatttctgtggggaccaactcgaggcaaagacagccttgtcctggggctttgggaagccgccctattgtagagttccctaaaccttgggacatgggaagaaaccgtgtctttactcttgcatcctctgggattgaaacgctaccacagcctggcagccagagttttgtcatcctctgccaggtctgtctgggcctggcatatccaacagctcagtccctgtttttcaaagccctttagcctaaagactggtggagggagggtgaggggaggggaaaggaagaaggaagagtggctggtctgtctgcttggaagccagagaaggagtgacgggtgggtgttaaaggtgagtgtgtgggggccaaggcctcctcccaaggggtcggatcctctccaggagtgcccagcagtatccgggggaggcgggggggtggctgtctgacctaaagccacacatgtaagccatgcctcttccattgtcacaagtcatgagtccccacagtgagctttacacatcccatgaagtcctgacccaggaattttgagaggcagattttggccacagtttccttttgggaccctttcacatagtcagcagcgcacagtccaaagctgtgccttggctctgctacccatttgtcacatgacttggagtgtatctctctgcctttctgggcctcagttttatcatctgtaaaacgggctgggtggactggctggccttgaggttctttcattatgaatacagtctgtactccagcccagtgcttctcagactttaccatggacaggagtcacctgggcctattgacatgcagagttttggggtctagggtacagccggcaactcagcatttctaacaagcaccccaggggacgccactgctggtgtgtgactgcacgtggacaggtgcagccggggtgtgctctgcctcactcctgggagtcacgtccacacccatccacacatacttggaaaatatgggtcaaaaatgccaaggagcaagttacttcaaaaagtgcagttgttctttgtcccttaggcctatgtccatggctctgaaactcccacgtgtctctggggtggacctgtggggtgttttaggacaagattatgcagccccactgggtacagacttacgtttgacatcagggatacgatacccagcagtggcactagctcctccaccccactgggactattcctctgggttcttcccatctaggagtttattccgtgccctgcacttggtaatatcctacaggccaaagccccacactaacagtaaagagagcatgatgttgcaagcattaaatgagacggcatatgtgaatacgcctgggatggtttctcccacacaacagggacactaagtgttaattccccatggactctgtctccactccacccacctcacccccaggtggtgagctcctccagagcagagtggctgtgtccatctctgggcctcccgtacaaggctgtgccaggccagaggagggcctccatgtggctttactagaatggcagacgctgtgaagctcctgatggaggtttctgtctctgccaatccaagtcttcaatccattcaccctacctcctctgtgggagaaacacaaagacacgcaagacctcaccccctctcagaaaactctgtgtggggaacacaagcttgtaagtcctggtgggacacatggcacgcaaaatgcaactatcttgcaaaacctagtgcctcctagggagtccagggcaggcttccggcagaagcggcattggagtgtggcttgcctttgaccagtaaaagtggtgaggaggaggaaacagcatgaagaggggtgtggaagcaagaaggcagatgcatggatccggcagggcactgctcgagcaagcgtcagctgcacaaagtgctgctgggaatgtctgaggggctgggcccaggagagccccacgatcctgcagtgccaggctgaggacactgtgtctatctgggatcgtgtgtgcagagtataagttcccagatgtttggggaacagaacttcactgtgcatgcacacacacacacacacacacacacacacacacacacacacacgcacttcttccatagggagaatctgatgaacaaatgcccttccatggataaaccacatcatcatcactgttatcccttaccattttttggccactttgaacgtaccaggtgctattctatgtacttcatgtttattaacttatttaattatcacagctattctgtatggagcactctgtttttatcctggctttgcagtgaggaaattgaggcagagagaggcaaatgccacacagctagtgagggctggagccaggcagtggaccaggtagttggcctccagagcctgcccaagctgcctctctcaccctgcagagtactcttcaatgtgtacctgtaggtgtggtggtttctggaagggagtgactcctctcctgcccggagccaagcccattcagaagtcactttgggaggcctggcctactgttggacaaaagagagcctagatcagattgaaccccttcctaacgcctccttctcaactaaatgaagcaattcacatctggtggggaaggaagacatctagacagtccacttagggcagagctcccccaacccagcatcctcactgaggcacagtcattggaaaagcttggacttcacagcccatccctgcctgcctcttcttgtgtctctgcaggtaaggtatggagcccttactgtgagccgagtcctatactgaatgagggctggggcctgcctgcaaggagctcacagcccctgttcccattacccacagcatcttccaggaggtggcatcccagactggccaacattgcagttgggagtatatttcctgcttcacccctcgtgagccgccagggtcaggtgccacatccccttcattctccttgcctctttcacagcccctcctgccccatggttgatcccaatccatctgaactgcatggagtccacttggccctgctctcaggacccagagcttggcctagaattggccccaggaccctcaggaaggccttggaagcctggctcagccgggtttcaaggcaataaaagtaactgagacctgagcagccccacactggctgatgtgctgcagtgacacctcagtctctgaggcctgtggcaagggctcctgaaggtgaattgacccagggcaatcctatctgcttacaatgtttagccacagtcaaagatagcaaggcctaggggcagggatgggaagacgcgatattttagggggttcagtctgaaatcacaaacaggctctttgagtcaaatatacctgatcttgactcctggtggttccctttctagctctgggcctttgagcaagttgattctcacacactgggcctccatttcctcctgtgtgacaggagggtgattaaaactgggtcacaaaaaaaaagagctgacctatgttaaaggaccagtcagtgcctggcacacaccaggggctcaaaaaatattagttttctttctgattaacccactttttctccccagttgttgaaaaaggaaagtccttgcttaaagggaggataaatggtacgttcctggatttcttcgtttgatgatgacctgtgatcccttgtcttcatgtctccagcctctatttttacactcttaactggatttctcagacttattttcactggtcaaagggcttttccaccattaaatcctctgtgccagacagcagccagacctcccctgcagtgccctctgctgccatcccagtcctaggcacaggcaggaaacccaggtgtgcacacccaggccgggtctcccacaaggaagtcatcaggttaaatagcagaggctgctcacccaggcagcctgattgtcagcatgagtttgcagtggcctcttagtttgccctccagtacccaaatccatcccctccaatccatactgcaacttcatctcattgctttctaatcgtggccaaaaattctaaaccgtccctgtcactctcctgctccagaaccctcagtggctccctattgcccccagaaccaagtccctggcacacaggtcctttgatatctcactctgcttgcctccccaagcccatctcctccacacaatatgctccagtcggaccagatcacttgcctttccctaaacacccatgctgtttctcacctctctgcccttggatgcctttcttgtgcctacagtgctctagcatggtattcctaacctgcttggctataacactacctgaagagaaagagcttgtgaaaaataggtatcgatgcttaggctcacctgctgaatcagaatctccagccgaggaacccgggaatctatatttttaacgagcgcctggggtgattcttctgacttggcaaactggagaagcactcttttcgtgtaccttgtccactaacagacttctgcttagtggtcaccacctcagggaagtccacctgacactcctccttcccataagagcgatgacaacagttagcatttatcaagctcttattatatccagtagtgttctaagtactgggcatatagcaattcttttaatccttgggagggatgctgttgtgatctctatcaaagctaaagtaatggaaggtctcaggaagcacagagaggttgagcaagtttcccagactcacacaggtagaaagtgtccaagccagtttagagcctgggagtctgccttcagatccctcactctgtcacctaatgggccagatcactcttggcaacagcatcatcatcttgtggactgaggactggcttacttgcttctttcctcctctcctagatcctgaactccagaagacaggcatttacatccacagggtctagcaaagttctaggtacacgatatgagctcagtaaacctttgtggcagaaaaaggaggagaaaggatgatgggaggggcctgtgagtgtggagagatgccctgggtctttgtttggggatgagaaagaagcaaggagaggcaaaggatgggatcgagttaaacagaggaaggggtctcagctttcccaaaaggatcatgttgcctttttctccggcaggtgcaacctggccccagtacaggagtatgcccgggatgtggggctcaagacagacctggtaaccatgaacccctcggtcatccagcgggcctttgaggacttggtcaatgccacgtggcgggagaagctgctgcaacggctgcacagcctcaatggcagcatcctgtggatccctgccttcatggcccggggcggcaaggagcgtgttgagtgggtcaacgagcttatcctgaagcaccacgtcaacgtgcgcactgcatacccctcgctgcgcctgctgcacgccgttcgcgggtgagcggcctccctacaggccagtaggaccgtcactaagtgtgggagattcttggtaggcagtatccctttcccaggtgcatttccatcccagctccaccactcatttgctggatggcctcagcaagtcacctggcctttctgagcctccattccttgagagatgagggggtttggcaagtgggtttcatctggcatgccaattttgaccaatgggtagtgcctgcctagggaactgagttgagaatgatcttgggggtggggctgtcttgaggctcaatgggaacagacgccatgaacatgggaggagagatggcggctggcaagtcacataccatcccaggtgtgtgattttcaagaaaatcaggatcagatgcacttgacttcaagtaattcaccttaatctctttaaactttagttgcctcttcagggaaatatgagtgggaatggtaacattggaggatgtgaagactaaatgagataatgtacgtgaaatgcgtagtaaaattgcggtagaaacatttaatgttatcatcaatcatcgctatctttatgtctcagtgcaatattctctaactctacagagcacatcttactgattgggctgagatcttcaaaggagcgtctcttaggatatgtttttgtccacaaggtcttctctctaagatggaggggaactttacctaggcaatatgaaagagatagggagagttaaagcaatggaatccactctctttaagaagagttttgatgtaactaattaggtaaggattttcctggttaggcctggatctctaattccaggaaagagattccaagaattaaggaaaacaaataggaaatgttgaggagggtctgaactattcctatcaagaagtccatgtcaacctggatggcattcttaaacagccccagccaaacaagtagtagttcccaatctcctccttgtttcctcccattcatgtgacctggcatagatctccctggcacttggatcagtaaattggctaggaatttactagtgcccatgatagcagccacaagaaaaatagtttaatattaatcattcattcactctcttccagttatctattgcagtaaaaatcatctcataacttagtggcttaaaaaaacaacaacatccattttatattgtttacaatttctgttggctaagaatctgagaagggctcacctggatggttcttaggtcaggtgcagtcagactggctagaagtaaaacagtggggggctgaagcagctggggttgaccatgcgtctctctctctttatgttatattagggtttctccaaatgatctctccgcatgggctagattgggcttcctcacagcatagtagccttagagtggtcagacgtgtacatggtggcccaggctctagcacaagtggcccagagaccaaggcagaagctgcatcacatttttagaccacatagtgtcacttctattatcatctactagtcacctagtcattaaattagcttagaatcaaggggagtagacatagatcctgcctctcaatgggaaagtgccaatttgtgtacatgttttaaaacttacacacattcattctgcatatatttattgagtgcttactatgcgctaggctctgttctatacactaagacacagtagtgaataaaataaagatctcagatctcattaacaattaagttttcttatagggaaagataaattacaggtaaacaaataaataagatacttttaaatggtgctatcaggaaactcttctctagaaagaagttggtttgagctaagtctcaagggacaaaacagcaccagccatgtgcagatctggggtaggaaccttccaggtggagggaaccttaagtgcaaaggccttgaggtaggagggtgtgttcaaggttcaaccaagagacaaatgtggttgaaacagagtgagcaaggagaaaggggaaggagatgatgttggtgagagaggcaggtgccagaatgcacatatgtttgtgggccatggtaaagagtttgggtttgattctaagtttgaggggcagtgaaggaggtgagggagaagacctgagttgtgtctttaaaagatccctccagcaagaatgaaagctggaatatttgttgggaagctgctgcaatagctctggcaggaaataatgatggcttaggctaggattatggcatgggatatctaagagttggtcagatttgctataaaattttgaggtaaaggcagcaggatttgccggtggattctatttaaggaccataatgggggagagaaagagaaaaatccaggatgactcttagaattagagtttgagcaaacaagcccaagcaaacaagcacaatgtggcagtgccatagtctgtgatagcagagcttagagaagcccatgcatgtttgggggcattgtggaagggagttctttcttgagcatacgaagtgtgagatgcctgttacaaatgtatatcctaccacactcctgacctcccagcttggggtcaggccctatacccaattgcccatccaaccacatggcagatcaccagggatgtgagggagcccagtgtacagactccccactgactgaggggcatcaggatgctcttcactggggacttagcataactcagtgtgaccctgggaagccctctgagccacccacaaaggattcttgtcctcatggtgactgtggtcacccaagcctgtgaccaacactggtctcattaagatgggtatcaacagggaaaacccattgcccccaagaaagcccgagagagacattcgataaggagcagccacatgtgtgtctgatggagccagaatgatccccatatggacacggggctcaatggggctacatactttatcctagaggttggtctctcaggaccatgttttcacttcatccctgtcagagtaggtctgcagtggcaaccctcatctcgtggactgtttaaatattaaatatcgttccttcctagaaggaggaaactcttgagatggttctggagtccttggggataagaggagaaacactgccctttgttaaggagagaaaatgtcccttgaatggggaatgggcaaccacctggaagaaactgatgcagccagatctatttccagctataactgactcactttcatctgtcaaaacagcattaagcaccagtaataagccctttaaacaaacaggctgttcatcctgagactgcaacatcttcagctgcaggaccaccccaggaggaaatactgcaggagattagcctcttcttttagcagggggagaagaaggggaaaaggaggcttggaatggaattctgccaatgatcctctccctccgtggggccattggactctgcagggtgctgggtctaataggacaccaatgaaaagttagggagcatgttcattagcccttgccttggtgggaccttacctggtgttcactgcaagtggaggaatgggctggggagggatgcagtacaaagtcacacgagaaaagaccaagggattgtagagaggaaggctgaggaggaatccggccaagaggcactgtggcctagcatcaaaaccatgggctttggcagtagcgacacctccaaagggtccagaccccagctccgtgactggcttggttgtatcacctgccttcccccagagccccgcagaagacacatgtaattaatcaatcgtgcctactgtgattgtggcagctgccacctgccacttggagagctacaatgtgggaaagacataagacttgtcctatggactcaagagttccagaggctggagccacaaggaggagagtgcaataggctgaatttaagacaggactctgtagtagtcagagcagtggactaagttaaaccagtcactcatgagttcttcaccttgaagtcccaataatggactgcagtttgcaaaataatcttgtttccttatgttaagatgtgttacccaataaaccccctgtttatagggtatgtgggggggggtgtgaatgaacttttattgtgataaaatatacataacataaaatttatgattttaatgatttttttctttttcaacttttattttagattcagggggtacctctgcaagtttgttacctgggtatattgcatgatgctgaggtttgtgatacaaacgatcccaccacccaggcactaaacttagtacccaacagtttttcaaccctttccccattcccttcttctccagtgtctactgttgccatctttatgtccatgaatacccaatgtttagctcccacttataagtgagaacatgtggcatttggttttctattcctgtgttaattcacttaggattacggcctctagttattagatcatcagggacacgttacttgtgaatggtattgtttatacaccatgcgtccatgatgtattccatggagaatatgtaccacaattttctttatccaatccaccacttctgggcacctagtttgattccatgtccgtgctattgtgaactagtgctgctattgaacatgccagtgcatgtgtcttttggtagaatgatttgttttcttttggatactcatccagtaatgggattgctgggtggaatagtagttctactttccttgcaaaatctccaaacagcttttcacagtggctgaactaatttacaatcccaacaatatataagcattctcttttctccacatcctcaccaacatctgttgttttttgactttttaataatagccattctgactggtataagatggtatctcgttgtggttttgatttgcatttctctgatgattcatggtgagcagcattttttcatgtatttgttggccacttatttgtcttcttttgagaagtggctgttcatgtcttttgccgattttttaatggggttgtcttttgcttgttgagttgtttaagttccctatagattctggatattagacctttgtcggatgcatagtttgtgaatattttctcccattctgtaggttgtctgcattttaagcattgttaattgtacatttcacttagaagaaattcactcttagaagaaaacttaggagaaggttttcatcaccttgtgtttggcaatggtcttttaagtatgacaccaaaagcacaggcaatgaaagaaaaaatagataaattggactacctagaaatgtaaaacatttgtgcatcaaaggacaatctatcaaggcactcatataattagagaaaagatttacaaatactatacctgataagggattaacatccaggatatgtgaagaactcttacagctcaacaacaaaaaacccaaataactcaattcgaaaatgggcaaaagacttggaatagacatttctccaaagaaaatatacaaatggccaataagtacgtggcaagatgctccgctgatcatgagggaaatacaaattaaatacatgaatgtattagtctgttttcacactgctataaagaaatcctgagattgggtaatttataaagaaaagaggtttaattggctgacagttctgcaggctcgccaggaatcatagcggcttcagcttctggggagaccttaggaagcttccagttctgacagaaggcaaagggagagtgaggcgtctcacatggcaggagcaagagagagagggaggtgctgcacacttttcaacaaccagatcttatgagaactcactcattatcatgaggacagtatccaccgcatggtgctaacccattcacaagaaactgtccctgatgatctaatcacctcccaccaggtcccacctccaacattaggggttacaaaattcaacatgagatttggtggggacacagatccaaaccatatcaatgagatatcacttcataccctctagcatggctattagtaaacacacatacacacacacagaaaataacaagtgttggtgaggatgtggagaaataggaacccttctgctttgctggtgggaatttcaaatgagaattcacttttagggcagtgaccagggatcagtataatcatttcacatctggacataagtcagctaccttgacaaagcatttcatgggcaacttggacttgacggacagtttagggaattgaaggggacaaacgttaacttgttaccttcatcttgttaccttcattttgcaaaagaggaacttgatgctcagacaagttaggtcatttgtatgaggccacccagcatctaagtggcacaaccaggaactgaactgcattctctcgctctaatgtggtgcaccaggtgcagcagaaatttgcactcatttagggacagggatggcaatgagctgagtgggccaggagctgccacactggagaagaggtgttagaagaccacggcaggcagcaacgcatcaaggctacacgtgcacacactgcagttgttcagagcctggggcagcaccttatcggggagaacaagctgaaaggtcagagctcctcagcatcccctcaaacaccagccagcacctgggcatgacacagttgtgctgaaaccccagttgaggttgcccttgcccttgaatgtgcctttggtttcgctcttctcaatttgtttggctgccccttcacaacaaaggcatttttcagaaggaaagcagacatccttgggtggtgactcagaaaggctcagaaatacagtcacacattctgcatgctgctctcgatggcttgccacaggacatgtaggaaaacagctgaggggcacatactaccatagtgaacgcttacatgccgcacgccatgccaagtagcattatctcatgtcatgagaggactactgccattatccccattttaaagataggaaaactgagcctcaaggagtaacttgcacaagatcccacggctggttagggacagatccaggtctcctccctgctcctgatcaccatccatttgcccctattacacataactaggaaatagtgatggcaccctagagaatcatgtcaggaaggccaaggccaggatgggtttgagtttatgaaaatattaagaaaaacagaaaagtctttttatgtttcaagtaagaaccaaagggctaggagcagatggcataggggctacaaagggcaaatgtgtaatgaactcctcaacccctatatctgtcttttcagcaaagatgagtcttttacttggataggggaacggggcctttgggttctttactgacagtcccactttactgctctaaagcagtggttctttacattcatggtccccagaccagcagcatcagcatcactgggaacttgttagagacgcacattctcaggcccaccccagacctggtgaatcagaaactctaggagtggggcccaccaatctgtgtctcagcagtgctccaagtaatttgcatgcacagcgttatgtttgagaaccactgctacccacaaagtcaaaaccaatgaacctcccaggggcaaacttgcggtcagaccactgagcagctggccatgatcttctccaaatcatgcagaattagagaagggaatcagggacaggcaatctctgtcccaattttctaaacaggaggaaaggatggacaatggtgagcttaatgtcaacaccaagctagagtttcaaataggttaccaatcccatggctgatgaatgcttaaagatggagaagtagaactggaagatacctgggcacactgttctgatgttcctttgtgaggcaggcagcagacaggtagaccagggattagtatagtcatttcacatctggacgtaagtcagctaccttgacaaagcaacttgacggacagtttagggaatcgaaggggacaaatgttgacttctcagaacaacctgataagatagatattattttcctctcctttctactcataaggaaattaaggctcagaaatgcaaagtaaattgcccaattggaatttacagaacatcaacatatgagtctgggggaaagggaaaattcaacccgtaacagctgggttagatggcctcccttcccacgctgagattctctcattcaacacatctgagtctctgctcgcacggtgtacttatgaaatttctgcctatctgaggcagtgagcagagaaaggggagcatgtttctgaaacccaagcagaaggcctgcccttctgtaaattgcagatgaggagaggaaggaagctgggattcaaatccacgtatataggcatcagtgatctctactatctccactgtgacctccttgtatccttgacagatagtttaaccactatgtgctgaccattgacacccaaaggatgctaattagattaatgtggaccacagagagacctctctgaaccagccacggggcttggtgtctgtccccatttttaccaataacttaaatgacagcatcagtggtctgcttagcacattcactggtgatgtgacttttgggggattctccatatttggggtctcagaattagaaccaactcaaccaaagaggaaaaagtttgacatggacaaatgcaagattctgtacttaggttcaaatcatgtatacaagtgcagagagatgaacagcaccaaccatcagtgggtgtgtggttgctcaaaaggataacatggtcttgggtcacagcaatgaatggatagcatctctgagagtcagggaggttggcgatggccttgcttttctctgcctggccagatcccacttagagaatcacatttttctttaggtgccaggccagagaggggccacagtggcagagaaatttggaagctgagaggttttgagagagaaggttccaaggaacaagagagttttatttactcagcaaatactctttaggcaccagtaggctccagccctgtgctgggggaataaaaaagtcaatagaacaaggctcctgccctccattggctcatagatttgctctgtgaggctccaggtgtagaactagggttgggggaggaagccagattccttccggacactgggaagaatattccaacaaataagatcatctgaaatgggcttggctgcctcttaagaggtggtgaattcagcatctttggagatattcaggcagcagcgaaccccccattactgaggtggtggagaggaaatccctgtcatacagagttggcagattagctcgctaatcagggctaccgtaacagcgtctcacagactgggtggcttaaccgacagaatgtattatctagcagttctgggggctggaagttcaaaactcagggttcagcgtggttggtcccatctgagggctgtgagggaaggatctgcaccaggcctctcaccttggcttgcagatcgccatcttcttgttcccatggccttctacctgtatgcctgtttccaaatcccccctctttgcaaggacatcagtcatattggattaaggcccaccctagtgacctaattttaacttcattacttccgtgaataccctccctccaaatacagtcacattccaaggtactgggggttaaaacatcaacatatgagtttgggggaaatgagaaattcaacccataacagctgggttagatggcctcccttcccactctgagattctctcattcaacacatctgagtctctgcccccacagtggacttacaaaatttctgcccatctgaggcagtgagtagggagaggggagcatgtttctgaaacccaagcagaaggcctgcccttccgctctcaccagcagctggcagggcccggcctctggtgccaacaaggcgggcttcagctgccccaacctgagcagctcacccaggggcccctggctctgctggcctgtggggtggcacggagccctggctggctgttggctaggaaggtgagcaatggagtggaaggacactgaggcaattgagtatggcctcaggcagctggtggtgaatggctctaatttaattacaacatcgaaggaggctgcgacccacagagacggtggcccctcaggcaggaaagcagccctgggtgcagacaaggcctgtgaattggtgcttaattaggcaccaggagcctaattaaggctttaggatggcactgattcagcttgcctctggccagggccagaggggccaggtcagcaaagccagccctgctgcagagacttgagggcccaaggtgagagaagagtaagcaaggtgcaaaaagatagggagagaccagcacaggttgctggtggctcctcccagacaggaccatggcaatccagagagtgtgtccctagggctggtcccttccctgtgctggtcccagtctcctccggttgacagagggtgaggtgaactatcacctttttggaagcgtgctccatgaaagagaaaaggagggacgtctgtgatattaaggcataggtggctcccggcatttgtgtgtaatggattctctctctctccaattttttttttaaatagcaatgcagatagtgaaaagacatccaaattggattaaaggatttaaagtaaaaagccaactccgctccgcaccccctgtcctcctccacagaagcaagctgttaaacctgctttctgtgtgtggatccttccaaaaataacccctttttacacctacggaacgtggtttaagtactgcaccttgttaaattctggaaagtattccctattgacacacaccacctcattctccttcacagctgactggcagtccactgtgtgtctggaccataatttatgtaagcagaagccattggcgggcattgagggtgtttccaattttttgccagtataatcaatgctacatcgatcacccttgtgctgatatctgcaaacatatgcacatctataggttttgcttttcagaagtctttgccaatttgcattgttaatttttatagttactgccaattaccctccctagaggtaggtatcgattcatatcctcacctacaattatggaaaatacctgttttctcttaacctcaccaatgggtgtattatcaacattagttatatttaccaatccaatgaaaagtggtatctgattgttgtttgaaattggattcctttgattatgaatgagattgaatataattttgtttctttggagtggcatcgattgaaactccagaatccagccagaaggcttaagcccccaagaaatggtcttgctggacctcctcctgggccacaggggacagagatgatacctgggcatgagcagtagtctcaccactcctggcggggcccgccatgtagcaggaaaaacccccagtgccatacctttctcctttcttttggtaacttgctgtctaggatggtgtgagcctgcctttcccatgtgcagtcctggcagctgcctaaaagggcttgcagtgaagctggggtcatttatctctcctgataatgtccccagaatgaacctctagcctctgcttgctgcttttcattcactgctctattaaagatttgtgaggtgcccactttatatatgtgccatgctaggatctggagttatacagaagcaggaagtcagtacatttgcttatagaatttaaaactgtagggaaggaaaagaaaagtaaacaagtaattccagtgtagcgtgataggtgcttgataggggaagaacaacataccggacacaaaaccatccagggaggtccaggaggcttcctgcaggaagtggcttcaaagccaagaccataagaagggactgctagccaggaccacataggacgtgtcatggaagaaactaagatgttcctcgtggcagtgtggctgtgcacactgggtactgggagagatgtgcaggcccagatcccaagggcctcacaagcccgatggaggctatcaggttttatgctgtggactccaggagtcactggagagttttcagtggcatgtccatatttgaggctagcctggcttacttgagcaagagtgttggcttaggcaggcagggaggcctggggatctggaattagactcagcatccccatgccttgatcagcctttcccaacagccccaaattctaagacgaagtcctcagctctccaatactgcagagatggtgtctcattctgagatatcctgcagcacaccagaggcctcaacagtgttcccaaagaaaggacagccgtgggctgtagggcccctggatcacggctgaggctgccaatgcagaggacaggagagcaggagcccgaaagttctgttcccagctttgctgctgatcgttcacaaagcatcactgagtctcccttgatgaccacctgtgaggcaatcctgctccttagggacatcatcagctttatcccacagtgcttttagcttcttggaggaagcccttttggtccccttttccaacagtgacagccactattctttccacatacccagcccaggaacccagggaaaaagacaaatgtgctttggagatgattttggcaatcctcattgattgctgtccgtgctcataaaatacggtgcttaattgtcatggcatttggggtagccaatttgaaaaataattactgccttctttgagattactttggcttctaattaaaatctcaagactgggatattaaaggtgcactgtcaatacaacgtcccggatgcacccagctaacctcatttgggaaggcaaaattaattagtttgtgttttaacacccagctgttatcctaaggaaaggaatagtcttcaagtcggccatgcacacagtctctaaattggccagagcaacggaggagagataaaggaaatcgagagtgatttgttcctgtataactcagtcagcttctattacaagctgctcgttaagtggcgctcccgtgtccctgtcagacatcgctcaggagttcttgtttacccgtggaggcagaatcggaaataagtgggtccctctgtgccactgagctctggattcattccggagcctcatttgctgttaacaccttttccagttagcaattctgggtgaaaagcctggccccagatctgagaggttgggcatttctattcctgtcccagctggccgcagttacaaagctgtgtgcactgctggcttcctcctttcttcttacctacatcttcccatttttcaattccatttgagtcaaatgtttgctgagtgcaacggaagtcaggataatcaatcctaggctatgctacagtaacacaccctgagactccagcactttagcacaacagaagtttatttctcactcactcgcaaactgtgatgtgagctggcaggggctctcttccaatcagggattcggggatctaggattcttccatcttaggctgacatcttctgaccaggagactttgaagttctccaaggcaggggaagaagaagtgggagagcctgctcttgaacaccaaccaagaaagtacacattgtctttgtcgcaggctatcgggccagaactagtcacttgaccccagcccagttaccagagatgccaggagatgtttgttgagtgctgccgtctctgcaacagtgctttggacccagcatgcactgagcaagatgcctttgaatcctactacaaaggggtgtaaggtgtggtccctgcgcttggggagaccacagtacagtttcatgttccccttctggaaagcatcccttccgtctctaaaatgaccattcacttcttccgcagtcatagttcttgaggccctcagcacagaggcagcaggaccaacgaccttcccaggagcccacagatcagcgggaaaggcaggtgtgcacaatgcataagactggagccagggaaggacactggtgcacgggtgaccacagctgcccagagacagggcaaaagtgcaaaggagtgttgatctgagccttgataggaggaggtgccatgaaacagcatagtaatgaattttcagcctgggctgctaagcacgataagagaagtagaaacaaagctgatggtaatcatctggaggtggttaacagtctgactggggagatgacagtagaacaaaggcaatatttccaggaagataggatgcacgtgcttagtttctggaggtgggaaagagagttcaccacagggatcagtggggaaaggcatctaggcgagcacccagcacgtgtggaggcccagcacacgcctgagtaacctcagaagcacctatgggccacttggacgtttcatcgctgattcgattcctctctccccctttctggtcataacattgatggcctgaaaagaaattcatttctgaaagccttcccctactaagaccttgctatcagaaaataagcaaaccattgtttatctggcctgtgttagggcttgagttcacttaggaagtaaacatcggggtgatgtttcatgcagggacaccgtggtggctcgacgatccctgggtaacgtcagcccacagctgcagccagctcattcccagcctggggagttgccatggggtgaaaaatgctcaagaaccaggagcctcagatgcctgtgttttatccaaactctgtctaaccagctgtttgagaagcttgtctcttctcaagcaagtcacactggactcccgcgttttcctttctaaaatgacagaaggggacaagttcagtctaggaggcccatgcgttcaccacacagacatggcctgtgggatcacccagtaaggcctcacatggtgttgttttgttttgtttttgagatggagtctcgctcttgtcacccagactggagggcaatggcgcagtcttgtttcactgcaacctctgcctcccaggtcaagcgattctcctgcctcagcatcctgagtagctgggattacaggtgcatgcctccacgcccaactaatttttgtatttttagtagagacggggtttcaccatgttggccaggccaactcctgacctcaggtgatccgcccgcctcagcctctcaaagtaaaattttaattagttgccaacatttaaaaatttggagaatttgcataaaaatcctgatttctaatacagaaaaaatctgaagatctgggaccaccatactcaacaacagtaagactggctacccgtcacgatgccccagtcctcaccattccccactgccttcacaacactgaggctgggtgttcgtttttcttacacatgtcccaaatcccagcttgctcagtcacgtgccctgcaaggctgctgagctaactgagctccccagtcccaatcacctttaaaactctatgactatattcctgacacttcttctttttctctaaatatatctcattcttgggtccttttggcagaaccacccaccagtcatcacaggagttcttaggcgtagctgcacatttgaattactggaggaggctgtgagaatcccagtgtctaggccacacatggtagtgagatccaggcagcttttaaagctccagatgattccagtatgtggcgtaggttgagaacttctgcattagagctgaaaatgcaatgggctagtttaggagggggtgagctccctgttatgggacgtagttaagccaaggtgcatgaatactttgcagggatctgtgagaggatctcagcatcagctgctgctcttctgagattcttctcctctttacagtcctcctgcctttgcccctcaaagcctcccaagcttagctccgttgagcgtagatgctgccgaggtggtctaggcaagggctccttatccaacaaaccccaagctcagcatcaaacatccccgagccagcaccattcctcctgcctcctacatattagctgatgactaagcaaagggccgtgtggggtagtcccaggacaatcacattagaccaaccacattcctagccacccacctatctgttgggtctgcttcatgaaggtgaaagaacaaggacttggggtcagaaggcctgaaaggaggacctggctcttccccttgccatctgagtgtgttgctcaatcctcgtgccctgtgtggagcctgggtctgaagtgtgggcctgagtcgaggacacgctgtaaagtggtaggtgagggtaagatgctgagagagggccagatctcagctgggtgatacagagggaagggaggagctgtgcagtgtggttaggaaggtttggagagagagaaaggggcatgaaatgggcctttcaaacgagacatttagcccagagctcagagcaaagtggagacatgggccagttatctaataaccctgatcacaacgcagcctcctaaaaattccaaggcatcttgggagttcttgagagtggcaccagttctgtacgtggccagtgggacaccccacccatagtctgcccctcacattcccagaacttcttggggactggtaccaccccgccccagccctctaccccaccccatagaaaattggctgtgttcccctggaatcacaaatataagaggaaaaagccccaaaaatatatatctcttctgggaagcatcctttcccattctgaaataaccatccacttcttcagccgtcatgagccatagcacagagacagcaggagagataaccttccaggaccccagagctcagtgtgtaaggcaggcatggacactgcagcccctggcgcacaggtctccatgggtgcccagagggacaaacttagcacagctcagagatgggcaaaagctcaaaggaatctcaatctgagccttggtagcaggaggcacaaggaaatagcgcagtgccatggtagctgtgggccagaccttctggggagggtgcaagtgttggtgggagctgaagctggagggtggcacgggccaggtcttgcagagtttctgaactatggaacttggattgtatgtggagcagggagagatttcggagaaatgcctggggggctactaggtggaggacagatcacggtgatgggctgccactgcagagacttctgagagagagcacagggaagaaatgacgaagatctcagtgtccacaaacacttgctcctgttatttttcaattgcactgtgtttgcagttaccagccagagccattgccctgttctgtgtctgcctttgtccctcccttgggtttccagttgaaaaattcagctgcaaggaagtttcttggcccagacaggatgaaatcagagaaagtgcgaggaaaggggtcttcgaaagacaggcttatgaaacaaccgcggttgtctaggggccacccaaggaggctcctgtcgtgcccgggagaatcgtgttcactccgattctggccacctaggaccacagccttcatcagcaatgtcgaaggggagattcaagtcaccccagccccatagtcgggatggggggtgtgagaatgaggattctcaaaatgcattttatttcatcaattgttacatgattaggtgactcactgaacttacataggttattgataatctataacctcatctgattcacaggctaacacctcctacaaacacacaaacaaaaaggatttaaggtcgacactgtgggatgttttatgggtttccttttatgagctgcaaaaggaacaattttgcaaaaataaagaagtatttgggcttctagaaaacctgtccctcccaccccaacctttcagctaaaagcactaaatcatattaaacagtttcatctttcagcaatatgtaaatgttttctctgacatgtctttacttctggcctgaatttaatgggtgtgtttgattatacagtcacatgcatctctgtggagatgtcaacagaaaccatgctggccttcactttagttagggagggcaaaccatggagtttgcttgaggacagaaagatgtgaattgtgtctggtctagagacacaatggtaagaaatttgtggtaaggaaaatgtcttcccaccaagccataagcattgccttttaagggattcagcctagggtaagtggaagcttttactagaaataaagacattagaccacacatcagcatgcgttctgagtcccagagggagaataactgtgatggaacgtaagaggatgacaaatagaatggatgttttcccactttgggagaaagttctagattttcttggaatgttgagacctggaggatatcttggagatcacctagactgtgactcatcattgcataaatgtgaaacattaggttcagcagagagatgtgacttgctcaaaggcacacagatagttggtgaccaaactgtcactaaaactcaggtcttgagttacttcccccctctgagcatgtttcttagtctgtggaatgcacatagtctcttcctcactgcattcttggctaaggtgcaccctgcacccttctctcttcacttctctttgtttcctctcgtaaccctttaacagacgacttgaggcaggaagcggggactctgtttcagaggtggatacaccaagatgtagtgagcagtctttagaagaaagagagtgggcagaacccagccttgcatggcaaaccagtgtccagggcccccagggtagtcacccttggtcagagatgggtatcagagagggggtcctgcagcagggacagcaaggaaatctgaagacgctcaggaggcaaggatggaatcaggaatgcagatccgcaaggggacgccctgtgggactcttggaaaggcagcaggcaccacacaagagccagtggtttctcagaggtcagcaaactgctgctcaagggccaagtctggccacacccatgtgtgttgtctgtggccctttcatgctacagctacacaacggtcaagtagtattgggattgttgtggcccaaaagccaaaactattgatcatctagccccttacagaaaaaggttgccagctcctgcttgagctgtccacgggcctgagttcaagtcaagtgctgcccctttctacccaggtaaccttgggcaagccacttttcacctcagagccccatttctgcatctgtacccacaacaggtttgttttgagaatttcataaactcgtgtctgtgaccgcatccaggctaaggagcagttcagttgcttcatgtgcttgtcactcctctgtggagggaaccagggatgtgtagcttgatcggtccctggagtggcagaaggcaggctgctgggcaggataaaatttttgtcttcctggaaaggatgactcacagacccatgtttcttttcttttttttttttttttttttttttccagatactggctgaccaacaaagtccacatcaaaagacccaccaccggcctcttgatgtataccctggccacacgtttctgcaaacaaatctacctctacggcttctggccctttccgctggatcagaaccagaacccagtcaagtaccactattatgacagcctcaagtatggctacacctcccaggccagcccgcataccatgcccttggagtttaaggccctcaagagcctacatgagcagggggctttgaaactgactgtcggccagtgcgatggggccacgtagggtgggcaccccatgggactcagtggctcacatttcctgccagctacaccacaggcagatgggagtcggggtggcacaaacaatagaacaagcaggctagtggttttctttgttaaagtgtaaaacagtgaccagaatatatatatctatacctgcatatatatattgacctgagtatttataactgtgtggtgttcatctagcattaggcagataggccacaggaagaaggtgtggagaacccacctgaaccagattgagactcaatccatctttgggggtggaaggacttgacatgaaaagaagccagtcccatgactttggatgacaaactgcctcctggcttggagggatctttgggctcatggatgaatggcgagccacctgttgtcagctgccccaagcctctgggatatgtggattcggagaaagctgaggcccagaggggacactcgacccagtctaaagtgggtgccattcacggaggagagggaggttggagacttcaaccgggcaaaggagcacaaggaaaccaagcagcagaggccccatcagcacagagggcctcgttccacgaacgtagagtttgactgcctaagggacagcacgaatgactcacatgtttcagacaggcctccacggctatggagagaaggctggaggagacacaatggatggttcatgttctggcttagcaagagccaccaagaactttgggtgaagcaagcagatgacaatgaagaggagtaatgttccgaatcatgtttttgaaaaatcaagacctcctgttaagggcccacttgaccctagaataaggcaggagagtgtctaaaatctagctgctttgggtgttttttaaagcaatgtgagtccactgaggaggaagagaccctgggatttcaccctctgggttagtctctgtctcaccctgttagaatgtcacgagggactgtactgtcccctctgtcaccagggaagccacaatgagagcttgaaagggtgctgtcaagataaatgtcatccttcttaaaatacatatgattgcctttttgggtgcctcacagagccccagagtgtgagacctgaaagaatgttcagcatctagctccatgtccctgcaaccactctctgtttgccttctgcattctgcactctgcggggcctttgcagccagactgctgtgtcaatgttactttcttgtcactttcctaccctgatggtcacactagcccaccccaagctccgacattgaggttttcatctctgcagggagaggttccaatgtccaccccacccccaggtacccgcctcttcccacagaagcaattttagaattttgcaaaattcttttccccttattgagattaatatttaagattaaaaaaaaaatacccaaagccaaatgcagttccaaatagtggacataatctcccagggaaatctgggctcgaggcctacaacttaggggctggaatcacaggtctcacatagagaaatagccagcttgaatttgttagtcgtattccttcacctgatgaataacagtgttttaaaacatatttgaaaggtaagtaaaaaactaccatcttgaaggtgaagggagttaagaaaagtaatcaagacctgctcctaagcatatgagaccagatgtaattaatcaatggcaatgcagaacaggaccttggctctaaattaatggttgaccggaagggattggaggcggcagaaccattaaccctacacaagaacactccagcccaaaaccgtgaggaaggtgatatatctctgcattttcccttgttgttgcttgaagtctgtgattggggatttgcgttataaaatgaatattttaaaaagcaacagccctaatagcctctgtgggaactgagtggtttcggactcctcacaggcggtggaaataattaataccatattttatacatctccagagcctttcatcttgaggatctcaaagaccgtagaagacatttaatttctaaa

SEQ ID NO: 15337 - DNA, 40219 bp, Human
  misc_feature (1)...(40219): n = A,T,C or G
tgatcctaccacctcagccttcccggtagctgggactataggtgccataaccatgcctggctaatttttttttttttttttttttgtagagacagggtttcatcatgttgcccaggctggtctcaaactcctggcctcaagcaatcctcctacctgagtctcccaaactgctgggattacaggcatgagccactgcgcctggccctccatcctgctatttttatcagccagtaactctcaacagtgggaatttgattttgaagcattgttctttcccactgattctgcaccagtggagccaaggatgttaatcgaggaatggttcggacattaactcttctagttgtagtttgtcatttaattgcagattgaggtagatcattcagtgactattaactaccataaacagcaataataaacaacttcttttcttttttttaaattcatctattttttttcgagacagagtctcgctctgtcgcccaggctggagtgcagtggcgcgatctcggctcactgcaacctccgcccctccaggtttaagcaattctctgcctcagcctccggagtagctgggattacaggcgcctgccaccacgcccggctaattctttgtatttttagtagagacggggtttcaccatctaggccaggccggtcttgaactcctgacctcatgctccacctgcctccgcctcccaaagtgctgggactacaggtgtgagccaccgcgcccagccacaacttcttttcaaaattgaattcaattctgaaatatctcaagggaggtcatggattatttaaaaggaaatcacttgcaacaataaacataaaacaatgcagaaatagtataaactcatctagattgaagaaacacaaacattgagtactagcatcttcttgggatgacttaaaattaggacaaatacttagttaccttactacccaaagtgacatttcttcccattttagagctgtgctgtccacacgtacaattaaaattttctagtagctagccaaagtatttaaaaagagaaattaacttaataatttacctaatttaatgtagtatgtccaaaatattaccttttcaacatgcaatcaatataaaatttactaacgagatggtcttccacatctggtgtactgtttactccacagagtggcaagctgcctttccaaccctcacttagccacatgcggctaccgtattggatggcagtcttagggaatttcaatatcaactgattctttaattctgagtttgagaatttctttttataatacacacggtcgctaaggcgcttagagatctgtgaggcgcatggagattattttactctccggtcccttttgatccaagatcccacagcattaaaagcagtaagagggaaggcaatgggcatcccttgcgcccaggaacgtggcctggagggcctggctgctccgagcagtagcagtgcccggcggggaggctgcagacgcggcgttggaagttggatttctagacaagctccggcagctgcccggaacccgtgtctttttctggggcacccaggaacagcagggccagacggagagagagcagcctccagccaggcacagggtcccgagctgccaccgacaccgagggagcccggcccagggctgcagcgctttccgcctaggtgggcggcagcgggagcgaggagccggaggaagcccggcctgcgtcctgcgggcagcaggacacgatctccccggcgcgctctcgccggcgccgcagcgggcgcgcgggcgacagggtgggcgtggaccgatgggggcaccgcccctgggagaggcgggcgccgcggttccgggggcgggacgcgccgaggagtggggcgcgagccgccggttttgattagtgcggcggagctgcggcggtggagctgctcggccgggagcccggcggcgagacggagaggcggcggaggtgcccgcgcgcagggtctggtgggcggccgcgaggctcgggagaggcgaaccggagcgcgggaccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacgtgagtgagggaccgcaggaggggctcggggcaggggtccgggcctcggagacaggcgagaatgggaaacgtttgcgctttgaaggggactgggctcgggcgggggtggagaaagctgatcgtcaggctgttccccccgttccctcgcccctcggaccggcggtggcggtggtctttgcgagggaaaagtgttgggcgtgggaagggtttgctgggttgcaggcgactgcccagccaggctaaaggagactgctcttacgtgtcaggctgaaggtggtggcttggtttgattgtgctggggattcgtgtaatttttcatctgggccgagatgtatggtgtattgtttttttctcccgacctgggccacgtttctgttagggtggtgattgtgtccacttttctgggagctgctcacagctatctggacacctctctgtggattttcttcttcctggaagggctctatgcgcttagataggtgtgaagcacctgtccaccctgaaaaatgtccaccaaacctccgagctggcatgatagctttgagtcctgtcagcttgtacatctcagcgtggttttctttccttttttcagttcctcgttttattgttttatgtagatttgtactctccccgtgccggccacatcttttcatttttgtttaacaaatacttcttgaggcctactagataccattcactgttattggccaggggacatggtggtgagcaggacagaattcctgtcctcatgagtcttacattctagaaggaaggagcagataaaatctaaataaggttatgagattgtgacgaagcgtgtaagtaaaatagaactgggtgatggcgtgaatagagacatgggttatgtggctagtttggtatatccactgtttaaggtgaaatctgcctctgtaaagaaatgaaaaaattatatagagcacattactgatatcgattcacttggatttttagtctggggggagaaaagagcaattgtatatagtaatcgttaccatgaactagaatagagtgtatgttagtggaagagactttaagaaattagttacttttagttttttggttttttttttttcctttttactgcggaaaaagtgtgcctttgcttttggaaacactgtattttattagtatagtgtggcatttcctggtactgagaaagatgatgctggtacaggttatactgatatttctttgaaagtgaaagaaaacatgccacttggatattgttgactttagtttttggagttggtgagcttagtcacagcacattctggagttcatttaaaatatgtgagttctttttctttaaaaaaattgttactttttaccgtcataaaaataaaaaatgcttactgtgtaaggaatttatgcaatagagagagatggagaaaattaaaatatgcacacaccaaaactacattaccttgttaaccttttgtgactatccttccaatctgtgtgtgtgtgtgagagagagagaaggagggaggggaagagggaagagagaaaaggactatattatgattattgttctgtaacctgctttaaagttcatctgtttaataaatgtttattgaaaagccgttttgtgcaaggcactgttctagttgctggaagagtgaagaacaaacatacaaggcccctgttcacatggaactgtcctgtaaaatgtcttgaccgttttttgcatgtcaatatctgtatgatctctacatcatttgtaatagatgcatgatattttagtttaccaggtaccaagatttatttattattactgatggatgtttaggttgtttccaatttatctagattacaaagaacactgtgatgaatttatatgcatacatctttgagaaatgatctcatttatatttccgaaagaggaattattgggccagaagtggtgcacattttaaactttgatacatattggccccatggaaatgttatgtatattcacagtcctggtaacattgtatgatggccccattttgccttacaaacactaagtagcaggcatttcactgttttctgtttctattttcattcctttaaagttacattgagcacttttaaaatatgtttatatgctagttacatttagatgtaaattacatactcataatcctttgcctgtgctgcaatctgttgctgaattcatctttctgatataaaggttgttttctgtcacatgtagcattcttttccccagtctgttttttgtcttttaactttgtacatatatttgacatggagaaaagtgtgtgtgcatgtgtgttttaggtagataggtctttccgtttcttttacattttctaactctgttataatttttatatcttccttattcctccaaattattatatatgttagtctctgcttcctcttagtatttttttcttaattttttcacatattaccctgaattcacccagtattttacttcgttatatgagagctagagccctaattatagtttcttctaaatatttagagacttgtccagaattacttatcagatgattatttgattattccactgttttgaaatatttttattataaactaaattctgctttatacttgggtatgtttcaaagcttctattgccctttcttaacctattttagatggcagatgtttgtaggatttctgccaacaatgtcaaaggtaacattcagattagagacatttcaaattcaagagtcttattgttgagattgaagatttcctaaaaataactaaagagtatagccttggcaagttaaatagcctttatgggttaattttttttttttttttaatggtaagtgctagtgtggcttgataggttggggcctaaggtgaaattgtataaaagcctagacctgatggtagtgtttctcttctagcccttgggagccacgttgctgcgtgatgaagtgatctaagcagaaaccttgcttcatgctctcttccctatcccatccacctcatattattattatttccctgtgtacataaggtcctaatgtttatcatcaggctttatctttcgactggaggtgctaggctagtgtggaaataatttatgtgtccttaaatattagctaccctcaagtaaaacagaggtccttttttacctggaggtgtatatgtatatgtgtgtgtgtgtgtgtgtgtattctttctttgatacagggtcttgctctgttgcttaggctggagtgcaatggcacgatcttggctgactgcaaccaccgcatcccaggctgaaatgattctcctgcttcagcttcctaagtagctcccaagtagctgggactacaggcatgcctggctaatttttgtgctttttgtagagacagggttctgccatgtttcccaggctggtcttgaactcctggacttaagtgatctacctgtcttggctcccaaagtgctgggattacaggtgtgagccatcatgcctggccccctggagattttttaagttttttttaaagttaattctgctttctacaaacgtatttcctttattttgtttattgttatttttttgagacagtcctctctgttgcccaggctggaatgcagtggctcgatcacggcttcacatcccaggctcgagcaattctcccacctcagcctcccaagtagctgggactaccggtgcatgccatcacgcccagctaatttttgtcacccaggctggtctcaaactcctgggctcaagtgatccccccaccttggcctcctgaagttctgggattacgggcgtgagccactgcgcccaacccaaatatgctatctctaatgtacagcaacttcaatacctgatgcacagtttttgaatggaatttgcatactcattgtgtcaggataactgcgataaactacccgtcaaaaactggttatgtttttcatgtaaattttagcatttgggatattatttttagttagtacgatctttgccttaaattcatgaatacttggtgttccaagccttagtggaatgtaaattgagaacgtcttttttgggtttagtcctgccaatgcccttggactgtggtcaaacgttcatcagtcaggatcattgctacagggctactttcagggaaatgaataaggcagtccagcaattcagcccctttaacctgagcctgggaagatacggaattagactatagtgtgatagctttaaagaacaaagtgaggggcagtgtggggagggagagcatcaagaagaatagttaatagatactgggcttaatacctcggtgatgggatgacctgggcagcaaaccaccatggcacatgtttacctacgtaacaaacctgcacatcctgcacatgtacccctgaacttaaaagttgaagaaaagaaaaagagcaaagtggaaattgcaagattttagtattcagtgatggttctattgattcattatccctgcctttctctctgacattagttagttcagcacaccttcatatctatcctagatgttgaagctatgtctactcgctggtatctctagctgcagccttgtgccccctcgattttatatttcttattgtagcctttatccttctggattactaatcttggatcacagtagcttaaaatcttaccatgaatcctcattgcctccgggttacagttcaaactccttaatgagacaagcacagctctgtaggagctgaaccagcaacgttgtattactggcatttccccaaatgtacaatgtgctttctttggaattgtctttactttctttcttttttctttctcttccttctttccttccaaaaatcttgcttaattaactcctactcgttcaagtcattttagactttagttccttattgggttaggtgccccttatggcacccagccatctcctatttgttttctatggtggtggaatcttctacattctatagtgtagtaagcccattgtccagtgggcagagtttgtgttttcctatagagctaactcactattggttattttaccttctgtgagagaatttgtgttagcaaggttaagcttgcacaagaaggtgtgctttatattgcttatgaagcccattttgaagcaataccatttttgaaataagtgatacaggtagtaaattggtcatgatatactgattataaacaaacagtaatatagtcatgagtgataacaataacaaaggtcattagtcactggaaattgctggcatggactatgtgaagttagggacttgctgatatagcagtgaacctaattttacacgaaatactaacaagctttgtgacttggagcagggaagataaattcctagagtcagataaattggttcagcagaaccacacagcggaattataaaaacaacacattctggggttgttaagcaaggtgaacttttgcccttgtggaattcatattcttccttagaaacctagagtgaaattctctctttttttttttttgagacagagtctcattctgttgcccaggctggatggcagtggtgcgatctcggcttactgcaacctccgccttctgggtttgagtgattcttgtgcctcagcctcccaagcagctgagactacaagcacgtgccaccacaccccgctaatttttgtactttcagtagaggtggggtttcatgatgttggccagtctggtcttgaactcctggcctcaagtgattcccccatctcagcccagcaaagtgctgggattacaggcatgagccactgtacccagccgagtgaaattcttgtgcctcacttgtgaggagctgtattaaggttgctgcagaggctgcttcccgccatctgaaggggaaggagcccaccctccttgtttaacctttacctgtctccagtgggtttccctgcatcccaggcttccctcttgcaaaagccaaatttgaaaacagaactgtaaaagaagttatttaaaaatgagacagacagggcgtggtggctcacgcctgtaatcccagcactttgggaggccgaggcaggcagatcacctgaggtcaggagttcaagaccagcctgaccaacgtggcaaaaccccatctctactaaaaatacaaaaattagctgggtgtggtggcaggcgcctgtcatcccagctacttgggaggcagagacaggagaatcgcttgaacccaggaggtggggcttgcagtgagccaagattgtgccactgcactccagtgtgggtgacagagcaagactctgcctcagaaaaaaaagaaaaatgttcccaccttggctttttttcttttctttttgagatagggtctcgctctgttacccaggctggagtgcagtagtgcgatcatggctcaccacagccttgacctcccaggctcaagcagtcctcctacctcagcctcctgggtagctgggactacaggcacatgccaccacgcctggctgatttttgtgttttttgtagagacggggttccgccgtgttggctaggctggtctcgaactcctgagctcaaacaatctgcctgcctcggcctccacaggtgctgggattataggcctttccattcttcagtcacccagtctttctagacctgtggttgtcaagtttgactgcactatggagtcacatcaagggcttaaaaaaaagaaacaactgctgcctgggtctcacccctacagacatggttaaattggttcaggcatcagtattttcaaaactccataggtgacatggatgtgcagcctaggctgagaatgattgcccccaggctgtctgcccacagttgtgtccagcacctgccacctcttggcttcatttaattctccatttagcctagagcccacagttcatcacttcattatcttgcctcttgcctcacctcgtatcagtctgccctgttatcttgaatccatccaataattatagctgctcaactttgaaaatcctacagagggtaatcacacagccatgtggactaatactactacacattggtagtctcagggctcagctaaacctgcattgcggtgctgcctggcagtgcttttttttctgtgtttagctctgacatccatcacttaaaaaaacctcttctaaatcttcattctaccgcattcttggtagatgaccttagctcctacttcatactgtggatcccatcatgccttaaattagttttttctttttctctctttgcccttcggctagctcttcttgaatttttaaagaatttcaagtagtctttaaaaaattgaactagaggctgggcttggtggctcacacctgtaatcccagcactttgggaggccgaggcaggtggatcacctgaggtcaggagtttgagaccagcctggccaacatggggaaacaccatctctactaaaaatacaaaaaattagccgggtgtggtggtgctcgcctgtaatcccagctactccggaggctgaggcaggagaatcacttgaactcgggaggtggaggttacagtgagccaaggttgtgccattgctctccagcctgggcaacaagagcaaaactttgtcttggaggaaaaaaaattcaactagagagccaaggcggggaggatcgcctgaggccaggagttcaaaaccagcctgagcaatatagcaagaccccatcgccacagaaaaattttaaaaaattagccagaggcagtggtatgcagtgagctatgattgccactgcactccaacctgggtgacagagcaagattgtatctcaaaaaaaactagaaaaattaaactagaagccgtctgttccaccctttggccctttcactcactgtcaggtttcagtagaaactagtgtttgtttactgttatcacatttcaactcccattcatttactttttaaccgatttttagctgtctacccttatcctccatgaactgccccaattcttgccaaaagtgctcagagatagcagcaagtacatatgtaatctactggacattaccattcttaccttggtctctccagcagcattcagtgttattctttcttgaaccctttgagaaagaaaacagcctggccagataaacccttctgtcactttacttgcatcctggctgtctttctgcttctttgatccccacttttagtctccttcatgcattactctttttttttttttgagagggagtttcgatcttgtcatccaggctggagtgcagtggcacaatcttggctcactgcaacctctgcttcccaggttcaagcagttcttctgcctcagcctcccaagttgctgggattacaggcgcaccaccgtgcccggctaatttttgtatttttagtagagacggggtttcaccatattggttgggctggtctcgaactcctgacctcaggtgatccacccgcctcagcctcccaaagtgctgggattacaggcatgagccactgagcccggcctctccttcatgcattactgattcaataataatatattccttcttggccatcttctaagaatgctgtgcctcagagagcttgtgtatttaccttacggtggatggcttctgtatttttatctctaggctaaccttacctgctgagctctctgtatctgtttatttatttactcttcatttattcaaaattatttttaaaaattgagaacatactgtgtattattgctttgctgggctctggagaatttatattctactgtagtgtttctccagttgtagtttactgccagcctgcatcatttggtatgcttgtgaaaaatgcagattcctagtctcttcatctggtttattcacttgtgatctctacctgtgggcattatttatactacaagttgcaaacctctggtctcctagatgagatgtcaccacttgatgtcttgagagtaaattaaagttcgtatgttcaaaagttcattactctttcccatctctcattgtgcccagattttatgaatggcaccactagttaccatagcctgacccaggtatacccctcattatccctcattccccctccagcaataccatcatcagttattggctaaactccttgattctgagttctcaccttctcttgactttgcttccttcgcttgtttcttttgtgtgtgtgttttgttttgttttgttttgttttgagacagtctcgctgtgtcgcccaagctggagttcagtggtacggactcggctcaccacaacctctgcctcctgggttcaagtgattctcctgcctcagcctcccgactagctgggattacaggtgtgcgccaccatgcctggctaatttttgtatttttagtagagacggggtttcaccatgttggccaggctggtcttgaactcccaacctcaggtgatccacctgcctcagcctcccaaattggctgggattacaggcatgagccactgcacccagcctttcacttgtttcttatgcctttctggtttgtgtgcttgtctctttcttttggacctttgcaatatttttcccttgccttccatctcccctgcctgtactttattctcttaacttctataaatacaaaaatgatcctggttgcttccttttagtctttcatggttatttcttgcctagaggatgagctccaggccttttcagccttgtctgtgaagtcacgaagaatttatagcagagatgagtcttaaagcagtgctgctcaagcttgagtgtgcctgtgaatcacctagagatcttgttaaactgaagattgagtttcagtagttttgggggatgaggcctgaaattttgaagctctgaaaagctcccaggtgttgccaatgctgctggtccatgggccacacttggagtatgaaagtctggaaagaccgcctcctaggagtagttggatgcttccatctctcttctctcaaagtgttccaaacatactttgatgatagcctgtatcacactgcatttgcagagtcccgtacagactctacttctgaatgagaggtggcgtgtgcacatgtgagaaccacctctcctattaacacatggaaatgctgtaacgattagacacttacacacccagagcctgaaaatgtgaaaagaaaatctgcatattccagaaaccaagagggaatgcaaagcagtgggttggtctggtctgctaatttgaatcccggtggggttttaatttattgatatttcttctcattggtatattttcctgattctttgcatgcttggaaattttttaatagataccagacattttgaatttcaccgtgttgggtgctggatgtttttgtttttctggactgttgactccagctcttcaattcattttctttcttttttttttttttgagatggaatcttgctctgttgcccaggctggagtgcagtggtgcgatcttggctcactgcaacctccgcctcccggattcaagtgattctcctgcctcagcctcccgagtagctgggattacaggcacgtgaggccacacctggctaattattttttgtatttttagaagagatagggtttcaccatgttggccaggctggtctcgaactcctgacctcaaattatcctcccgccttggcctcccaaagtgctgggattacaggcatgagccaccgcacccagcctaccttattttctgtgtcataggaatcactgtcttcctttgcttgatgtccagtatcttcaaaactgttgtctcctgtatttttttctgattttttggttgtttcaggtgggagagagtaaatccagttagcgtttcttcatcttgtccaaaagttgaaggcttggggggtgggtggtgggaagagtagggcttttagtactagtgcgaggacagagtcagtgctgcacactagttataataacctcaaactgtaaacaacccaaacatccatcaacagaaagtaaataaagtgtggtatattagtaaaactatcctgtaacaagagtgaatacatgatagctaaatgtaacaacgcggatgattctcacaaacataacgcaacccaaagaggccagacaggaaagatacatcctatgggattccatttatataaaaatttaaagccagcaaaactagtctgaagtcaggacagtgagtacccttgaggggagcatagtacgtggaaggagacacgagaggacttctggggttctgctaatactgttttttgatctgggtactggttacatgagagtttcactttgagaaaattctttgagctgtgtacttacaggtgactttataatatgtacattatgtatcaataaaaagtaccccccacaccacttccccaacaaaaaggtcaaggctgcaagccagatgcattataggaaggtaagaactggattcccagtatagaacctagaaagcaagtcgtctgccctaggctgagggtagaaatggacacccatgagaaagcttgtgcaacgtgtaggaatcataggctcaagttcatactgtctaggaaatgcagaaaccctgatctgagacactaaaagaaaaactagttagaaaccagtaaaacttgtaagaccctgtccgagccacttataatactgccccactttaagggctccaccgtggaggccacttttgaaacactaggcaattgatcacagtgccctccctccctctctccctctctgtcacccaggctggagtgcagtggtgcgatctcggctcactgcaacctctgcctcccaggttcaagtcattcttgtgtctcagcttcccgagtagctggaattataggcgtgtgccaccacgcccagctaatttttctatttttagtagagatgggggttttgccatgttggccaggctggtcttgaactcctgacctcaagtgatccgcctgcctcatcttcccaaagtgctagaattataagcatgagccactgcaccagcccacaaggctacttctgaccttggaaactcttctttattttgaaaaaaaccactgggatttaaaaaatgtttttgaaaaaaaatcactgggatttaaaaaaatttttttgaaaaaaatcactgggattttagagctttttattctgtcatccacatctcaaactctttcatgatttctgtgtagaaatctgtagattggtttccaacacactggtcatggccaaaggcattgtttccacctgtggaacgattctccagagcaaagctttgttgacatctttaagagttttgtaaggagaagagcttctgggcatgtgcaacccaacttccccattaagccacagctccttcacagtagggaattcacctgttgcttgttgcattccagtgcatatgataatgactagtgtacattcggggctgtaaagatgttgtccagtaagtgactgcaaagcagtcatggagtaccactgtgtgctgagcctagtgctagaggtgttttgtttatttggtgacttaatggatattcttctattgttttgacaaacatttcaagtaatttgtaccacatggctttgttggttgcgttatgtaagtcaaaacagtattctgcaaggtaggatctcgtaccctagggggtacacaacaaactgacctgttgggttttggaaagaaaatattagagagagacagggacagaggggaggcacaaatacattttttaaaggccctgtgatatagtctggcttattttgagtagaaatttcagatatagtacttaacaattctctttatccataaacctagagagggctttgtggctgttgggagagtcagaatgaatctatgataaaatactgcattctcaacatgaaaagttcttcaaaggaggaggtgtatctaatgatatttaaagtaaaacatcttgggagaagggagaagtaggatctactctaaactttaccaaaatgtaatcgcctctagactattcagtacagcttagatgatcttcgttgctactgtttttgatctaaagccttgccacaggcactgagattattagtgggccagttctctctgctacttagccagcacttgacctgcatgttttggtagtttaatagcacttaaggatcacacagtgggaccaacagataaaaatcactgggattttagaccttcttattctgtcatccacatctcaaactttttcatgatttctgtgtctttacctgtccctctctctgggctgcattctggatagcttcttctaatctagatgccaattctttcgtaaattgtgagtacgtaagattctgtattacttgtcttttgagtttctgatgtcagtgattgtaactgtcattcctagaacttgtgtggttcttttcatattatttgtggtcatatataatgatttccctcatttccttctcttctcttgggttttgttcaggtacacagggaggttgcattcttggcccaaacccacgtggtgaggtgttctccaagaagacttttttcttttttgtttttgtttttgtgtgagatggagtctctctctgttgcccacgctgaagtgcagtggcgcgatctctgctcattgcagcctctgcctcccaggttcaagggattctcatgcctcagccttccaagtagctgggaccacaggtgcacaccaccatgcctggccatattttgtattttttagtagagacggagtttcaccatgttgaccaggctggtctcaaactcctgacctcaagtgatccacctgcctccacctttgaaagtgctgggattgcaggcatgagccactgtgcctggccaagacttttttcttttattctatttcactgaggactgaatccaagatagagagcatccgcatcttccctctatggaccaggatttttctgcttgcctttcagggagtccagatttacccaaggctctcagaacagttgtcctgtcattcttatctcaggcttctctccatctccaggtcaccagtagatggtcaggaggcaagcatggactctagcactcagtcactgaagaggtttttttctcatttctgaccttagagactcttctttattgtcctaacggttcaattatgtattttaaaacatgcttttactacacttgtattaaaaaggaagagagacaagtttatgaatatgtacatatataattcatatataccataaatgtgtgtatatattttgacttgtatatgcatttttaaaacctctggaaggacaagaaactagtaatgctggggaagcagtaatggaaacaggcagatggggggccagtggtgacagatttcttttatcagaccctcttaatatttttagtgatttgaaccatatcagtatattaccagttcaggggctgaacgtggtggctcatgcctgtaatcccagcactttgagaagccaaggcaggaggattctttgagcctaggagttcaagaccagcctgggcaatatagtgagaccccatctccataaaaaaataaaaaaattagcctggtgtggtggagtgtacctgttatcctagctactggggaggctaaggtggcaggatcgcttgagcctgggagatgcagataattacaccactgcatgccagcctgagcaacggagcaagaccctatctcatatgtgtatattcaacaggatatatatatatatatatatatatatatatatatatatatatatatatatattcaacaggatatatatatattcaacaggatacatatatatattcaacaggatacatatatatattcaacaggatatatatatatatatatatatatcctgttgaatcaattaattgtgtaatataaacttttttccccagcagtctagatgttctttacctggtgggtttcaggcatctagtctgctattttgttagaaatagaatagtgattacttttgtggttatatgcgttttagatcgtggttttacctgtctggtcctccagatgaactctgtagagcaatattttccaaactatctatggcaaagcagttgttctttaaaattatccaatctggctggctgtagtggttcacacctgtaatcccagcactttgggaagccgaggcgggcagatcacttaagatgaagagttcgagaccagcctggccaacatggtgaaaccctgtgtctactaaaaatacaaaaagttagctgggcatggtggtgcatgcctgtaatcccagctacttgggaggctgaggcaggggaatcatttgaacccgggaggcgaaggttgcagtagctgagatcgcaccactgcactccagcctgggtcgcagagcaaaactctgtcttaaaaaaataaaaaaaaaaaaattccaatctgccatgagccaatactttggtaaactacaataaaaataaattgctgatcacatgcttgatgtcatggcaatgttaaattgctatacaagtttctaaaaggtttcactcaattgtttctcacttgcaaaccagtaaaaagcaatgctggaccagaccacactttgagtagcactgcgatagatggtgctccagtattttctggtacttggtgtatcagaaattgataccaccctgttctttaaatttcttgttggttttaaagtttttccattgtaaacctggtgtgtgtgtgtgtgtgcgtgtgtgcacgtgtgtgtaaaactgtatggccttatctaaaacgttagatgtttgctacagcacacacctgccttagttagagaccaagcccatggctaagtggtctgggtggtggtaccggtgtccctccagaagtctttcccagtttaatagtggattttatcaaatcaagatgcattgatgcaagtattttttgatcatctagaagttctcattggttgattttcacagtaagtcagagctgccatctgcctggcagcaattgtaaggtaccattgatgtcagagatgttaaaatgtggaagaacatgtgtcttagaatatcttgcagatggacccatgatgttctagtgcctaattactgtcgaatgcttggagacttgtttatgagaagtacttgtcacatatttactagaagtaggaggaaggcttcagtggcttcctttagaaacttcaccactgtattgaatggcatcttgttgcaacagcctgatgttaactggggcacgttctgtcttctctagcattgcttctttcttttttttgagacggagtctcactctgtcacccaggctggagtgcagcggcacaatcttggctcactgcaacctccacccccgggttcaagtgattcttctgcctcagcctcccgagtagctgggattataggcacccaccaccacgcccagctaatttttttttttttttttttagtagagatggagtttcagtgtgttggccaggctggtctcgaactcctgacctcaagtgatccacccgcctcagcctcccaaagtgctgggattacacaggtgtgagccaccacacctgtgtggcattgcttctttcattaggagccctgctgtgctgcagcatccttgcaatggacaagcagtgagaacgttggccatttggtcacttatctatgaactggtggcactggtatatcttccagtgtcattaatagacatttttctcatcattgagtttttttcttactttcagtttccttctgttctacccctgccattctgaccttattaatattgggagttccagttgtcccattatcttgcttgccatgcagactgcttgacacttcttttaactgtgtattatcccactgcaaagaaatttctcagaaagttctggttatcctttcataattttctgctgcagacggtgttttattttacctgtttttatagttctgtggccacttcagtggcaatttaagaggaagaggagttaatctttgggctaacactgccattcatttcttcaccatgtattttattgaaatgcctgcgctatgcctggcatagttctgtgagtatagcaatagtcagagagtagtacatcatgggtattcaatcttttggcttcccttggtcgtattggaagaagaagaattgtcttgggtcacatataaaatacactaacaatagctgatgagctttaaaaaatcgcaaaaaatctcataatgttttaagaaagtttatgaatttgtgttggaccgcattcaaagccatgcttacctggttctacttcccttcatgtttagatcctcttttagaaagatgtcaagttttaaaaatcttaacttagaatttagggatttattgatagcttgtcagtgctttgatttgacactaatgtattctatagaaataatttttatatcatttgctttttagccgattacacctcaacaagaaggcaactgacaaacagccttatagcaagctcccaggtgtctctcttctgaaaccactgaaaggggtagatcctaacttaatcaacaacctggaaacattctttgaattggattatcccaaagtaagttcagtgttacggttttttgttttgttttgttttgttttgttcccctcatgataaacatttagggattttaacactgtataaggtgaaggtattaaaaattcatgatgatattggcctcataaaatataacctttagtagtagtcatcacagaacagaaataggttgaggaaggggtgtaaattccctttctaaccacctatatgtccgtgtgaagtagagatccctgagtaaaccttctgaaactcagacattgtcaagtgcctggtagtttgaaaataaaaattttcttccataagagctggatatgaacaataggaagaggagacaaggagagggagaaagcagtgttagtggtctgaaatgggttgcagtacagccagaactaaacgtgacttctccggagaaactggctttgagccaagaatagattacagttagtggtactgtagggtttcatcttacctcatttttaatttccttactgttctgattttaatagctaattgtattgcttataccatttatctatataatctgtatatctgtaaactcagtgtactcccttaattggagaccttccagttttcttgagatgaaagtattctttttatcactttgctttagtagtccacctgtagtttcttaggataacttaatattctttgatttttgtacttagctttacagcagctttgtattaaattgcttgagactgcttttgaaagggcattttggtggtaacagatcacttgtgagaagaatgtgtctttaagcttctacccacttgactttcagtacagtttagttttccctttgcggtctctattcacttgcctcaatttttaccctattgcctcagtttttccatagctgtttttgctactgggagagtcgtccctcttaatttttttggacagggtagctcaaataatcagaaggaagatgatatgcgcactacacttcttatggtgactggttttcatgctcttatttcttttcttttagcctttatttttctcggtagcaccaatgaaaagaatagagaagacacagatgtgatagccttaatgcagcacttattaagtaggtagacatgagtatcattcagttgtatttttagtgtttttatattattgctttggagttttggagtttagaagccaattttggagtattggaagctgttttgaagcaaaaaaattatatgttctagtttgtgtgtgtttatatgcttaataattttagatatttgaattaaatacatgtgttaacttcaatcaaatatataatttttaaataagatataattgtatatacttgttttttcaaactaaaaaatggtaaaacttagccttttgtaattgagaaagatataaataaaattaattgtaaaataagctttgcagtaagaaaaatgggagattttcaagctccataaaagtaaatgcaaaggagaattaatgtttacgaatgaaagaaattttctattgattatgaatgaatcttagagcatagcttagagtcatatgcattatcattgtgaaacttaatctcacatttcagttttttaaccatcctctttcactttccccattcaaccactcttaaaattggtcatggaatttttacgttgtagtgcttgtgagatgatagtcatggggtttaaatgcttgaggaagtcagtgaggggtttagttgtagaaagaatggttttttgtgttcgtttttgtttttaagacagtatcttgctttgtcacctaggctggagcatagtggcacagtcgtggctcactgcagcctcagcctcccaggctcaaccagtcctcccacctcaccctccctggtagctgggactatgggcatgtgctaccacacctggctgatttttgtattttttgtagagggtgttgccatgttgccggggctggtcttgaactcttgggctcaagcaatccccccacctcagcctcccaaagtgctgggattacagacatgagccaccatgccctactgaaagaattttaaaaagtaaccccagggttatatgtatccattgattacgagcatttctaatgaccccataactgatttcttgtgaatgaagattttggccaggcgtggtggcttgtgcttgtaatcctagcactttgggaggctgaggcgggaggattgcttgaggccaggtgttcaagaccagcctgggcaacacagtgagacccccaccttcaaaaaaataaaaattaaaaaattgaaataaaaaattgttttggaaattacagtttagaatgatctcaagagctcttgttttcacttagagtagtagctctttttccatttagttatatcatttaagtgggttgaggagaaagctattttgacattcattgtaagatgaagaatagcatctgcagattattttattctttgttagtacagaattttattttctaattataaacgtatatttagctgtataaatagaaagtttggaaagcagaggagaagtgcaaagtacctgcaatctaagggaaatatttgatttcacagcattttatttacttggtgaaaaccaaatacaatggcaaatgttccacaggagactaaagttaaaccactgaaatcacgcatatctgagcatgaacagacaaggcatttgtgtcaccaagaagtcaaggagacccaaaataaacatttacgtgactgccaggcgcagtgccctttcatatttgcattttgcctggtgtgaacatcgttttaccagagtatggaaatgttttcattttggacataactttctcttctaatattcgattgggactatcataggccatttgggggaaaataataaaacatatcttcaagttttaaaattttacttaattttggacatgtgcaagaaaatttactgctactggtacttgctctgaatttctaggtttcaattttggtgagactagactagttgctctgaaagatctctgcgctgtattcatcttacaagtctacttttatactgatactcattccttgggaagacataaaagaatgaaaaggtgatgcagttcattttccacagcattgaacactcatttgtcaccagcgtagaagggatttggggagagattaagcagtagcagtaatagtcaataatctgcgtctaaagtggcttgctggctttacttcagtaaattctggccatgtgaagaatacctaaatcaactatcagagttcttaacagtgaacctgtcataactatgatttttttttcttttttgcaattatagaattgattttttttttccttttgaggcagagtcttgctctgtcacctgtgctggagtacaatgccacaatctcggctcactgccacttccgcctcccgggttcaagcaattctcccgtgtcagcctcccgagaagttgggattacaggcgcatgccactaccgctggctaatttttatatttttagtagagagaggatttcatcatgttggccaggctggtcttgaactcctgacctcagttgattcccctgcctccgcctcttaaagtgctgggattgcaggtgtgagccaccgtgcctggcctgatttaacaattttaatacagggattcttagcaaataaaatatctcatcaaattgtgaagacacagagctgatagctgaaaaatgattcctggttaaaatctgatactttagaaaatacttggaatgctgcctccaatttggtgtaatttccaatatcaaaaacaaatgaatcttatgtatttgagtctgaacttttttttggataatatgaatatgagtctcatttacactctggctaatcagaaagtatttgtttttaattaaaaattatgtttaagcagtgtaatcaataaaaattaaaacttcaaggccgggggcggtggctcacgcctgtaatcccagcactttgggaggccgaggcgggcggatcacgaggtcaggagatcgagaccacggtgaaaccccgtctctactaaaaatacaaaaaaaaaattagctgggcgcagtggcgggtgcctgtagtcccagctactcgggaggctgaggcaggagaatggcgtgaacctggaaggcggagcttgcagtgagcggagatcgcgccacagcactcccgcctgggcgacagaacgagactccgtctcaaaaaaaaaaaacaaaaaacaaaaaaacaaaaaaaaacacttcaaaccttgcatctgaataaaggcagactgtacctcccttacttataacctccctacttaacactagtatagcatttttcttcccattgagtatatttctagtactatatttttacaaagttttctcttgctggggaaaataaaagctaagattagttttttattgtactttatggaattgcattacttataaacatttcctttcatcatatgtactcatactcacaaaatagcattaaaaaagcattaaaggctgggcatagtggctcatgcctgtaataccagtactttggaaggctgaggtgggcagatcacttgagcccaagcattcaagaccagctcgtcgtctgtactaaaaatacaaaaattagccaggtgtggtggtgcacacctatagtcccagctactcgggaggctgaggtgggaggattgcttgagcctgggaagttgaggctatagtgagccaagatcacgccactgcactccagcctgggtgacagtgaaagaccctgtctcaaaaaaaaccattaaagatactatgctggctgggcacagtggctcacacctgtaatcccagcactctgggaggccgaggcaggcagatcacgaggtcaggagattgagaccatcctggctagcacagtgaaactccgtctctactaaagaaaaatacaaaaaattagccgggcgtggtggcggatgcctgtagtcccagctactcgggaggctgaggcaggagaatggcgtgaaccctggaggccaagcttgcagtgagctgagatagcgccactgcactccagcctgggtgacagagcgagactccatctcaaaaaaaaaaaaaaaaaagaaactatgctatgtttggaaaaacaaggaactctttagagcaagcctggctgagcagcctcctatagtaggaaagctcgttgttacttttgccgtttgaaaagtcacttaacctctctaatcattattgtgaaggtcattgcctttttggtggctcagccaaatattgttttgagagtctggatgggaggctgactgacactttctgtgacttagagtcagctcttaaggaaatctcaggagggtggtagaagtagggccctttccattttcagatttttatctggtctctggagaccaggtaactgtcaagttggtttcagtacctcttgagtggcaattttcgtcagtcatcattagaggtagatattggatagaatatataataacagcagtatgtaggtagaaagtatgaggaaaatatacattgttttcctcatcgacttaattattaagaaaacatgtttttcatttgacaaaaaatcttattagctaaccttcttcattaaccttagtcttggttcttttgtgatcaactgcaaatttcttttatttttattttccccgagacggagtttcactcttgttgcccaggctggagtacagtggcgcaatctcggctcactgcgacctccctctgcctcccaggttcaggcgattctcctgcctcagcttcccaagtagctgtgattacaggtgtgtgccaccatgcctgctaattattgcatttttagtagagacggggtttcaccatgttggtcaggctggcctcgaactcctgacctcaggtgatccacctgccctggcctccaaagtgctgggattacaggcttgagccaccacgcctggcccacaaatttttttattggcagtttttgctgagattataggtagtgggcaaacaattgttattatgctcacaggcactataaacattttatttctactttttacttgtgtatgcttatcattggaagtaaatataacagactttgtcgttctcttgagttagttagctttgttatgttttcatggacataattaacctcccttctgtgcttaaaaatgttcgaccagttttatgttgtcgtcgttttgttttttttttgagatggagtctcgctctgtcgcccaggctggagtgcagtggcgtgatctgggctcacttcagtctccgcctcctgggttcaagtgattctcctgcctcagcctcccaagtagctgggattataggcgcgtgccactacacttggctaatttttcgtatttttaggagaaacagggtttcaccatgtttcccaggctggtctcaaaaacttgacctgaagtgatccaccagccttggcttcctgaggtgctgggattacaggcatgagccaccgtgcctggctgttcaaccagttttagaaaagatttggtaggaaatttcttcattgagtcaacatgaatttattaccacttctggggaaaaaaatcactacttagaatacatatcctacaaataatagagtagtatttttgtatgttaaggacaaatacttaaaaaatttagttgttgactgagcatggtggtttgnnnnnnnnnnnnnnnnnnnngcaagcagatcccaaggtcacgagtttgagaccagcccggccaatgaaactccgtctctactaaaaatacaaaaattagccagacatggtggcgggcatctgtagtcccagctactcctgtttgggaggctgaggcaggcgaatcgattgaacctgggaggcggaggttgcagtgagctgagatcatgccactgcactccaacctgggtgacagtgagactctgtctcaaaaaaaaaaaaaaagttgggttgttaatggaaatttaggggttcagttcaggattttataaatctggctgcatgtcagatcaccccagagattctgactcaaaagtctaaaatagggtccaattctctttttaaaataaatgccccagggtgattttttttttttttttttttttttttgaggcagggtctcactctgtttcccaggctgaaatgtagtggcgcagtcttcggctcactgcagcctcaacctcctgggctcaagcaatcctcccacctcagcctcccaagtagctgggaccacaggcatgcctcaccatgcccagctaattttaaaaattttttgtagagacagggcctcgcctttttgcccaggctcctctcgagcacctaggctctagcagtcttcccaccttgacctcccaaagtgctgggattacaggcatgagccaccgtgcccagccccagggtaattttgtcacagctgggcaagtgttaagaaatgcctttcttaatttactgttaaaaatctaaacatagcactgggcaaaataaagttgtaggtattttcatagttacaaggctaagcatgcatttcaagatcgtaaatgtccattcaaatcaaattctgttttgtttcaaaaagttatgaaacaaaaaagggtaatcttactttgtccttttcatgtgatgaatttggaagggccctttaaatttattataatgggattttatatgaaatttgttgcaccttcatgaaataatattaagtatagagacaaagcttctagagagaggttgtgtttattttgcttccttttgatgtcactttttactctgctaggcaccctgtgagcagttagtaaatcttcagtagtgatggccatggacaagcttgagatccagttaatggagattaactaggagattcctatctgggaatggcaagactgcagttgtgggcactgccagtctcttccttatttattctgcttgcagataggctcctaattagaagcttcactccattaaagcaacacttgttatcataagtgtttgcatccattgtgaatgctctcttttaaaactttgcataatacagttgcttgttttttcctgtgctttttgttcaatcaatacatgctagtaagtgcttatttttttaaagaatttaatttacatacaatgctttttgactagtatgaagtgctcctttgtgtacaagatcatgatgatccagccattgatgtatgtaagaagcttcttggaaaatatccaaatgttgatgctagattgtttataggtaagtaacaaattctgtagtaaccattttccattgatagtattaagtatcagtaatctctgcattgaactgaagattaaggtgttagccatgtttgttttaaacatgtttgttggagtactgagaggtgtttacgtccttttgagaaaagttataaaaacaaaggtttttttttttcatatctgagatgaacaaaatcacacacaaaataatatttttcccattaatcagacatgagggtctgttattttttgtttcttcaatattttaaatgtgtggccttttctgtatcttactgactataattggagtgaatgatagaattcacttttattacattacaagaagggtatttttccaaaagcctacaggcttatttgaaagacttgtagaggtgtgtttgccattagtgtttttttttttttaacatagagctgatgtggtctctctaaaaaacaagtaagtcgtataaaatgatatcagatctttgctatttgaagatcgggcaatgatttaaattttttattagcttaaaatgcaaatttgaaaattaatataagtgtagcatgcctacgaattaatcaggaccattacaaatctatcagctcatggtcagagatgctcattcttcacatgtgctatcttaaattatttactgtcatatatttatggggtttttttggttttttttttctttgatacgaattttttgctcttatcacccgggctggagtgcaatggcacaatttcagctcagtgcaaccccttccacctgggttcaagcaattctcctgcttcagcctcctgagcagctgggatcacaggcgtgcatcaccacgcccagctaatttttttgtatttttagcagagacagggtttcaccacgtcaggctggtctcgaactgctgacctcaggtgatccacctgcctcggcctcccaaagtgctgggattatagcctccccagtagctgggattacagtcaggcaccaccacgctcagctaatttttttgtatttttaatagagatggggtttcgccatgtcatactggtctcgaagtcctgacctcaggtgatccacccccctcgacctcccaaagtgctgggattacaggcgtgagcccatggtgcctggccatgtgtgtttacatttaataaacctttattaaatataatctcactgtatttatgaatttatactgttttaattatagcttcaaaataacgcctgtagctttttcccttaggattattttttaaattgacaaataaaatttgtatatatttttggtgtacagcacgatgttttgaaatatatatatatgtacacattgtggaatagctaaattaagttaattaacatatgcattaccacacatatttattcatggtgggaaatctctcttagcagttttcaagtaaacaacatgttgttatatactttctcatgtacttatactttatttgtggtgagaaatctactcttagtcattttcaagtataccatacattgttgttacctatagttgccatgttgtacaattgccattaaatattgactcatacttaactactaaggcaaggacttaagaattagaaaaagtgaaacagtgaattttcaaagataaatgatacagttttccttttgagaatggacagttttttcctaaatatattattatgaataatagagaatgttaaataatatgaaagtatgtttaattattaaatatgcaagtattctcatttctatcatgtatctttatactataaaatatttttaatgttgcataaatcttttactactgtacctttacatttttaggtggcaaaaaagttggcattaatcctaaaattaataatttaatgccaggatatgaagttgcaaagtatgatcttatatggatttgtgatagtggaataagaggtgaggtttttttcttatttattttataaaactattaatttgaagataaaatgctaaaagcaatctcagatacattcatgagttctttttatttgcctaaaagagtaatttatttcatcatcatttcatggtaatatgtccagttatgcttactaagattttgatttttttaatcctaaactagaatgttacatgtattaaaatgttttcattttgaagagaaaatttcaaccattaaattaaaaatggttgtggttcattatataatctgcaagctttcccatgggtgtaacttttcccttgtttgcctgacacttatctttaatgtgtttcggcttgcgtaatacaccgtctcacaaagggacagaaattaataggtgcatattttactaaaacacatacacttatcggactatacacatgactttttacttaaatgattttagcaagaagcctttcatatactgaaattataacttgcattttcgaacactcataatagtttcagtgttctataatattttcttatattctaattgccttaagcttctcaaccccaatactgttcacattttaggctttgttgtgggagctgtcttgtaggatgtttagcagcatgcctggtctctaccatgagatgccagtagtacccccttctcagtagtaaaagcaaaaatatcttcagatgttgccggatgtcccctgtggggcagaattgcccccagttgagaagcactgacctagaatgagtatttaaggtccaaatacaacttttctttatacggtagatttagttcttaaagacttggaggaaatgaaaaataaggtcatgtaaaaatgatatgagatgtttgctaaagattgggcaataatttaaattttttattagcttaaaatgcaaattagaaaatgaacataaatgttgcactcctatgagttaatcaggaccattacagatctatcagctggtcagagatgatgttcattcttcatatttgctatcttaaattatttactatcatatgtttttcagtgtacagatctctgttcaatataatcacgttccattcctgtgtggaaatctgatactcacagagaaaatagtctcatttcctatggttggagagtagagaagccagcacgagaactgaggtcctttagcctctgctcctgagccttttccactaggacagattgtccttattccaaattagaagttccaacagggggtaactttttcaaagtatattctgcctctggtacatagtaggtatatactgggctaaaaaatgtataaattagctttcgagaattaggcccttttgaaattttgtattctcctcagaaaggtggttgagattcattttattagatccatatgtttaaaataatgtattttattaagaatgtaataacaattcacaaaatatattttatattaatgggcattctactaaaaacaaattttcttttctccccctctctgccttttttttaaattgtagtaattccagatacgcttactgacatggtgaatcaaatgacagaaaaagtaggcttggttcacgggctgccttacgtagcagacagacagggctttgctgccaccttagagcaggtgagtatggtggttataaatcatgttcatagtatcagacccctcatttcccagaagcttgagactatgggagctggaattaggtatctcaagttaactgtattaagtccatttgggaacctgctgtgttctagaagccctgagttgagagcagctgttttcattagtgaggaaattcttgggaccctgactgtaccctggcagtgaacagctgtgcgcaggaaatgcctgcggtcttattgccagctgaacacagtctaacctcttgccttgtagtattcacttcctgttctagagttcagttctttatattgttctttcaaacattcgatctgaaaagaaccgctggccccctccccccagcctttttttttttttttttttttttttttttgcgacagagccttgctctgttgcccaggctggagtgcagtggcacgatctcggctcactgcaacctccacttcccaggttcaaacgattcttctgcctcagcctcccaagtagctgggatttcaggtgtgctaccacacctggctaacttttgtatttttagtagaaatggggtttcaccgtgttggccaggccggcctcaaactcctgacctcaagtgatctgcctgcctcagcctcccaaagtgctgggattacgggcatgagccactgcgcccagccctcaaaagaacctttttaaaataccacaaagtatttcaaatatacacaaaagaaaatgtattcatacaagtccttataaaacctatttgatgtccttttaaaacatatttctaataattacctgagaaacttatgttttcattttattttttctccaacttagaaatagtaacatccataggaaactataaataatggaaaagtataagatgcaaaaaaacaaaaaccaacaacctagaaccctaacaattacaggaagtttatggggtttttttgttttttttgttttgttttttttttagatggagtctcgctctgtcgcccaggctggagtgcagtggcgcgatctcggctcactgcaagctccgcctcccgggttcacgccattctcctgcctcagcctcctgagtagctgggactacaggtgcccgccaccatgcctggctaattttttgtatttttgatagagacaggttttcaccgtgttagccaggatggtctcgatctcctgacctcgtgatccaccctcctcggcctcccaaagtgctgggattacaggcgtgagccaccacgcccggcaggaagtttctggttttaaaaataaacattgtatcatttggacactttggagtctttatttcccccaccacccccttctgggccctttagaaaacattgttgagatagtattctaaaaataatctgtatcttatttttgtgactttgtaagcttttcccatatcattaatagcttttcataaaagtaatttttattggctgtatcataggccatcgtatgtgtgtcctatgcttgagttaatcattcctgtactgttaaacatttgggaggaaaaatttgttgtaatgttataaggacagatatgtgatttcagtctttaaatatgtcaacttgctcttaagcatatctgcatttatattcttttgaattgcagtcttatgatcgccacatatctgaaggggtaaaggtacattgtgggaacttgcatctggcctttggcagtttgaaccatgagctctttcttaatattgcctgtaaatatatttgtcctactgcaagaaattgttagtcttaaataccagaatttttgtttagaaaaagaaactgagtagccactttaaaataaaatacaatgtgttctagtataccaaattgtatttttgtcttagaaatatccaaattgatacagatgtcaataacatctctgtgatgtgtatgtcaataaacatctcccagaatacacccattgccttagtgtaggtttaatctctggaagtcactctgccatacttagagttaatcattctcaactgtaaagagcacattcagctcagtgactaacatctcattcctaagacctcaataactactaaggaattaagatatgtgcctctgttcttagaagtcaggttcagttcagtcccacaaacactagggcttcactggagtctgggttcagggtaggtagcaagaatcataatcataattgccccttagaattctcttgctctgcactgtgtgtgtaactcctaagaaagatgactactctttatttcaggctaattagaaaaggcaacatatctgaggtgtaaataataaataggattttatgtctactaagtagggtaataacagtccttttctaccattgatttatcagcgtatatatcttatgacttcagagtatatgcagagaaatggcagtagcggatgagagaattttagtatccccgttatgaaaaatacattgaaaaaaatggagaaattgggaagaatcttagtgactaagggagagggagcagctagctacaaaaggatgcaagaaaaggaattaagaaataggattgtgtcccctccccaccccccaccccccaaaaaaataggattgtcccgaaggttgatatacctatgggtggtgtgtgtatgcatgcatgtatatatacacacatatacgtaacatacaaatatgtatattgatcccagtaaagtagatgtgtgtgtatatttacatgaacaccctaaaaacaagatacattgaatatttgttaatattttatatatcaatgagtgatatttttaccttattttgtatctaaattaagttttatttggatgcatttttagcttactaactgtgcttgctctatgaaagcaatattgtctaccactttttattcaggtagtctacgtaagaataataagatattcactcaatcatacttataaaaaaaccattgggaaaaacagttcgtgaacaccatgcttttaacatgaaattctaatcatacacgtttgtggttttttgggcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccggtaagacaactaaatgaagccatagtatttttattacctaacttctgttggtttattctttttgttcaacctatagattagggctttttaatttaattttattttttttgctagtaagtacagaataggtcaataattttattattttgtttgtttttgagacagagtcttgctctgtcacctaggctggagtgcagtggcgcgatcttggctcactgtagcctctgcctcccgggttcaggtgattctcatgcctcagccaccagagcacctgggactacaggcatgtaccaccatgcacactaatttttgtatttttagtagagatggggtttcttcatgttggccaggctggtcttgaactcctgaactcaagtgatctgcccacctcggcctcctaaagtgctgggattacaggtatgagccaccacacccagcagatcaataattttatagagtaattcatattctaattatagaattgtagatatgtactaatgaagaaggtaaatgttctgattcctctacatttttcaaattaatgtgttttaaagcgattaaaagtaagtttctctgtgtttagaatttttactatatagatacaaatttctgtgttttagaagaattaaaactatcagtgcagtcataaactagtaggtgaaaatttaaagactatcatttcaaaatttgaaatttgtcagtgaattatatgatactttgctaagaagccactgaaagattcatatgactgacttagcatttctctatcacaaaatacttgttttgttttggtttttttttttttttttgagacagtctcgccctgacatccaggctggagtgcagtggcgcaatctcggctcactgcagtctccgcctcctgggttcaaacgattctcctgcctcagcctcccaagtagctgggattataggcacccgccgccacactcagctacttttttttgtatgttagtagaggcggggtttcaccatgttggccaggctagtcttgaactcctgacctcgtgatccgcccgcctcagcctcccaaagtgctgggattacaggcatgagccactgcatccagcctaaaatacttgtttttaaaggagatcactgccttgtgtgagaattcttttaaattttttaaaaactgaagtgtgttttaaatacaaattctgtcatgattgtgttcatgtggttcatggtttcctagtgtctcccatgagatccataatgccactttctgtttacatgtcttgttgtttggttagtagtcatcagagactaatctattaaatatggagccctctccattttttttcaaaatgactgcattttaagtttcttaaattgtaaagtaaggtgggtacagtttcttctagttcttagatggtgctgtcacgggccagcataattgctaaaacatccatacgtatggtagaccttaagtcatgtgctaatcatgaaagctgggctcaccctgaataccggcagttgcctggtctttataatgattactgaatgcataaccagttacgcttgcatgtgttcatcatcataacttattttctaattatcttaattttcagaggttggaggtttgcaatgtccactcaagttgcaatgcaaaactctggctcatattcaatttctcagtttcaatccagaatgatcaggtaaatcaactgttttctttttatacttcgttaaaaggaaagtggggaggggggtggtaatttttacaggtttaatgtagttaaatgaatgtacctaaaggttgaagatttttgtttagttgcagaaaatagagtttaacgtctgtgtttaagataaatttaatgtctaaatgtattttatttgctgtataacactgaaagcactcattagagaaatgttgagactgaattttttaatatgctgatctttattttctaactttctgtgctgattaaattttattatctgtattcatcagagcgtaggccatacaaatgaatttaaagacatttttctttgacatcctagacaaaaatagaaaagagagtcattaaaaaaaatttttaggttgtgtgtggtggctcacacctgtaatcccagcgctttgggaggccaaggcgagaggactgcttgagcccaggagtttgagaccagcctgggcaaaatggtgaaaccctgtctctacaaaaaatgcaaaaattagccaggtgtggtggcgtgtacacctgtggtcccagctacttggtgggatgaggtgggaagatcgcttgagcctgggagattgaagctacagtgagtgccactgcactccagcctgggtgacagagcagaaccccgtctcaagtaaaaaaaaaaaaacaaaacaaaaaaagtttaaagagaatggtctttctatcacagggtaaaaaaattgattatttgagggaaaaaaaaaaggatttgtcttgtagccaggatattgttttaaagaaaatcctttttgtttttccaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccaggtatgtggataggcatgaaaaggttggcagtcccttggtggaactagaactatttcaatttagaaaaagttgaaggaaatgtatctgagccattcttcagcttcccattgtaggttagtctcgggtttgaacatgactttctctagtggaatgttgatgcaaaacttaagtcgatttgcaactttctattggttatataatcgcttttattaagtttccaaaaacatgaagttaattaaatcagtgagtattgaaactaataagacattaagatagcagttattttaatgcttcattaacaattagcattttcttgaacggtataacatggcagttaaattacataaggaagcagacttgattttacatagtatacttagaaaagtgaaatccaagaatttaattttttaaccttgtctttagtttgacagtgagtgaaattaaaaaatttttttttccattcctagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaaaaaaaacacatctgtagtcttggccaaatgatacactttattttgtggaagtagagaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgttttttttttttgttttttgtttttgtttgtttactattatagtaagtctagtcttatttaaattggatttttgtattccagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttctttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacag

SEQ ID NO: 15338 - DNA, 61913 bp, Human
  misc_feature (1)...(61913): n = A,T,C or G
aggaatattgtaatacctagagcaaacacacacacacacacacacacacacacacacacatgcaaacgaggtgtagctaggaagccagtagagaaaaaaaaattatcccaaaagaaagcagaaaaagagaaacagagaaaccagccaaaaagatagaacgaataacaagatagtaaatgtaaacacaaccatcaattactatactaaatgtgaatggactagctcctttgccttccctggggctgggagtgcaggatggactcacttgcacaattatgtcatgtttgctagggcttgggctagggttgtggacttagcatacttgctgaggccagtgcccaccccaagtggttgctgacagcagggataggctaaggagacacctaagtggctggagattggttttatatatatgggaatggagcagataactaaatacttaggcagagatgtaaccaggccatgtgacctgaactttgctccagggcattgacactgctgttaaaatgcttctggcctagaggccctctgcagccaggggaggtagatggagcttcagcctgaaaacccaggtcagagggcccaagtaccctttgcagagctggcttttccccttgcaaattgctagtgacgcttcagctgatgtgtgttactattaaggtcctagtgtttgggagggtggggcaggaggtggaggattgtcagaaaaaaattacatggaaaaagatggcatctgagatgttttgaaagataagtggaattttccaagtggaaaaaggaaggaaaatcagtcagataggaaggcatggagcattggggaatgacaagtatcttcttggactagggtgggagatgggctggagagatgggtcagggccagttgtctggcatcttgtgtgtctcagaagagggtgggcacgctgcgtagggaagcccagggccactctgaaagccctaaaggggaactgatgcctctggccttgtttttatcaccatcaggactacccattgaggcaggctgcactaccagctacttcctggtgccctcttgctcatagccatagtattttgcctctctgagcttccagaggttttaagtctggggaagacccagggactcaaagaaagattggggtgggagataaggggccacagtttgggggagtcaggcaggaggcctttgaggaaaatagataaagtcccaaagcctgtgagtgtgaatttggaggcaatatgctgtgttctgaaacgttttcagacactggctaggtgcaagcaagtgtttgtagggcgaggctcttcatggacctatcactgcttacgcaagcttgggatgtggtcttgccctcaacaggtaggtagtctaccggaaaaccaaactaaggcaagaaaaaaattagtgaataataaaggactgaaccggttcagagaaggcattcagcagatgtttgccagtcaaatgaattaaagtgtgaatgaatgaaactcgaggtagtgggtgaatgtgtcccaagaatccagcgaaacagggtctcccaggaggcgggactggaagggtccggagaggggccacaggctcctggcctttctaagcacaccaagtgcccagtcgcggacccccgggaccaggatgcgctgacgacccggctggcaggcgggtcctcgtgggcgaggcgagggaggcggcgagagaggagcaatagtttcccaccgctccctctcaggcgcagggtctagagaagcgcgaggggatctagagaagccggaggggaggaagcgcgagtccgcggcccgccccgttgcgtcccacccaccgcgtcccctcccctcccctcccgctgcgggaaaagcggccgcgggcggcggcgcccactgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagcgcggccgcggccccggccgctctgggcgactgtgctggcgctgggggcgctggcgggcgttggcgtaggaggtgagtgaggctccggctcggcagcgtcgcagctgccccaggatctgcgccgcggtcaagttgcggacttggagccggcaaacgcggagggctggtcccgcgcgtctgcgctgggaatgcacgtgtcctggctggcgcggtcggagccgggagctggggaccttcctggcccggcggtggcggggctgagaggtgcctggtgcctgggagcgggtcctccgagacgccgaagccatcagccaggctgagcgccttcccggccgccgcggcgcgcacggtgcggtgggcgcatctctgagccccgcgctcacgcggggctgcgcgcgtcgcgggtggtcctggtcgggccaaggacgactggcccaggagccaaggcgaggtggggcttccgggggttgttcccgcgccttggcagagggatgccgctgtagcttcctgggtgagagcgtgcgcgcgcgcgggtttgccagtttccccacatttccaatttctcctgttacgctttctccagaaggttttttcttttccttttttctttctttctttcttttttttaccttcaacttggcttcctgcggggttgttttggagcaggatgagggctttgcctcctccagtgtccccaggtggcagcggtgcctctgctcccagggcagaccctgcacccgaaaaatctctagtgtattcggggagccatgaaaaggctcccttgggccggtgggatccttggctttgtctctggctgctgcgcacaccgtcagccgtcagggcaattggcattcggcctctttggtactggggacacaggtggagggatggagcgggcacagcccggggttgctgcccgtggtcctctctgagtccttggtgattttgcctgggctggagagaaaccctggctcctggtctgctggggccgcctctgcctcagaggatgacacaagagtgcatgtaagtatttttaataaaaactgtagtactcgtaaaacaatctacaccctgcagaagggatttgttattttattttattatttatttatttatttatttatttttgagacggagtcttgctctgtcgcccaggctggagtgcagtggtgggttctcggctcactgcaacttctgcctcctgggtttaagcgattcttctggctcagcctcccgagtagctgggattacaggcgcctgccaccacggccggctaatttttgtatttttagtagagacgcggtttcaccatgttggccaggctggtctggagctcctggcctcaagtgatccgcccacctcagcctcccaaagtgctgggaatacaggcgtgagccaccgcacctggccaggatttattttaaaaagggaagatttgttgataaattcacttcaaagataaactattcgaaaatactttagtgattcccgtcaagactcttctgtgtatgtatagacgtataactcattctggacagggcaaggatatctttttttgtttgtttgtttgttttgagatggactctcgctgtcgccaggctagagtgcagtggcgcgatttcagctcactgcaacctccgcttcccgggttcaagggattctcctgcctcagcctcccgagtagctgggattacaggcacgcaccaccacgccctactaatttttgtatttttagtagagacgggatttccccatgttggccaggatgatctcgatctcttgaccccgtgatcagcctgccttggcctcccaaagtgctgggattacaggcgtgagccaccgcacccggccaagggtatcttgaaggagggattacagttgatatgtagaggaatattgcagtggttattgctgcatttcctatgtgactgggactaaaacagatcagctgatagtgttagcgtgcagtgagcagtctgatgactatgacacagaaataagaatctccagcattctgccctgggacatgtggagccttgggtcagatgctgctggctattgatgccgggaatggagaaatccaccagggcaactcagtaaaaataaataaataaataaataaataaatacataattaaaaaaagggtatccttgtcctgtccaggatgagatgcttgcttccatgcacttacgacaatttttgctgtcattaaaaaattttcacattcacagtcttctaaattcactttggagtgtattggattccactgcattgacatacgtaagtttgcattaaaagatcctttaagatatctggtcaggcacggtggctcacgcctgtaatcccagcactttgggaagtggaggtagaaggattgcttgagcccaggagttcgagaccagcttgggcaacatagtgagacctaatctctactaaaaattaaaaaaaaatccttaggcgatctgttcacagattaatcttgtgattggggcgattccagaagtggtaatgggttgtgctgagctagccccacactctctctgagaagcagtgtacagtagtgtttaagggcaggggctctaaagtcagacttccagagtaataccccccccccccaacctcacaaatcagtttctactatatttatatctgccatcccagtgttggtggtagggtcttcagatccctggggaagcagatggtgggatgagagtaggagagttgtgttgggactccaagtgttgaaggggcacagaaagagctgagtggcacagagaggttgtcccagagtagcggagtctgctttggggagaagagagattgactgaggatagcatcaagtttttcattttatgtacaaagatgatctttttagcttcacccaggaagtatgggttttgtgtcttcctcgtgtttaggtttttattctgacctaattaggtctaagctgaggtgcttatttctcttctggagtttatatcctagaagctctccaatcgaagccctctgcaggtatcctcaggtcctggagaaacacagcaggaaggcttgttggcttcggaaagggagggctatggtttaaagccagtaagatgtgggtttgattcttgactttgtctcctgtaggctgtgtggccttaaataagttacctaatctcttgagtcctcagtttcctcatttgtaaggcagaggaaacaatgcctatgattatgctgattaaatgaaacagaggcacaaaataagtgtttaatgaatgacaactactattgtcattattcttcctatccatgctatctgccatgtattggaggcaaaagctgttactacttcatgcatatgcgctatgcaggcttccagaatgaaactgatggggtccctttcccccacatatgtgagagggggtccctcttatttcaactcgttcctcattgctggtttggcatatctcagctactctaacccggcaagaatccacagaagaagccaagaaggaaaaaggcttatacatttgctttacccataagaaaacctcaagccctgtatctgaaaaaagaggaagataaaaggatctataagacttcaagttccatgagaagagggacatgtctattttgttcaatactctatgcccactgcctggcacataggcagcaaaacaaatatctgtggaatgctatgtaaaggcatctatagatgatgtgcctccctttaagaaacccaatatttgaatatttgcactcattcatacaagatcctcaagtgctccgtttggataatctggagggtatgaaaacatagccaagatcatgaattctttgggcatttgggccgctgcactgttgcaccatttagacctgtgatctgagagtgtgaaaaactcaagggatcctctgtaaagtgtctgcctttttttccctcctgggaggagccgttagaagggcaacattctcctttctcccccttggacgtgtgggtgttggggcaagggtgaggagtgacagaggtctcctgggaagaccataagatggggcaagcacaccacagtgaggagggggagtctggctatgactttagaatttcctgatcgaaatttctcctctaaagctccccaccctacttgggatctgaggttatcatcccctcccagtcccaagaacccttcttcccttgttggcagaaatctccaggaagcatgcccacaggaaccacaactcatgaatcagaagacagataattaaccgagggagtgactgagcagcttcagggatgaaccgcttcgttttacccagccctctctgctgcccacagagtgggctgctccaccccatcgcctctgctccctcttcctgaaccttggcccttcctgagtgggaccttcattgtgcctgatggagctcaggccactagtggaaatgaaggtgggagcagggaaatgactctgtttaggggaactgcctattccccgtgtgggaactgctggcatttattgaaacgtgagactctccagcaaaaaagtgatagcatctgcctttctgtccacacacacagtctcaccaaaaacactctttttttttttttgttagataattcaggtataatttatgtacagtaaaattcaccctttttagtgcatacagttctatgaattttgacaaatgcatatagtcaagtaaccattgccatcatcaagatacagaatttttccatcatcccctaaaattcccccaagctctttttttcccttctttttctttctagaggcagggtctcaccatattgcccaggctggtctcgaacttctgagctcaggcaatctgcccacctcggcctcccaaagtgttgggattacaggcgtgagctactgtgccaggtgcccccccagctcttttgtaatcgataccctaccctcaaccctcgtcggttgcaactgctgatctatttcctgtccctgcagttctatgttttacaaaatgtcatataaatgaaagcatgcagtgtatagactttcagtctggcttctttcacttagcacaatacatttggggttaatctatgatgctgcatctatcagtaactctaagacattgtctgaggccactccgtcatcctccgtgttggaacagttaccctgaaagcagtgggactggatccgttaaactttggaggtgctccccagctttcagcttctaaattttataattggatagatgtatttagctatatataagtcattagattttccatgtgctaagtagttaaagacttcaggatactagagaggattctgtagcaaccaacacttattattcttgctcataggagtaacagatattttgtggccaaatattgtatgtcatgatgcttggagtcagaagttgttaagtaaacctgggggctattctacctttttacatttttggtagcatctctgaaaaaacaacccacttgactttttttttttccttttttttgggagggtgggtgggtgggtggctttttggccaaaaccagaaagcttgctagacaaattctaacactagatctaacactagatgtcttatttctgtttttctgtcatgttcccatgaaaagactatttacttacccccctctctcggttttatagttgagttagttcaatttcttagttcagttagtgaagatgtttaaatattcaaggagagaaagaaaaagaacaaggtgatacacattttaaaaaagtcaaaataacaaatattgttatttcttggctgggcgcggtggctcatgcctgtaatcccagcactttgggaggccgaggcgggcggatcacctgaggtcaggagttcaagaccagcctgaccaacatggagaaaccctgtctctactaaaaatacaaaatcagctgggcatggtggcatgcgtctgtaatcccagctactcgggaggctgaggcaggagaatcgcttgaacccaggaggcagaggttgcagtgagccgagattgtgccattgcactccagcctgagcaacaagagcaaaactctgtctcaaaaaacagaacaaaacaaaacaaatattgttatttctcaaataggttcatccacataggatcattgtcagtcgttaaaattgctggttcccttctaattctattcccctataatgttcatattaatcaggtggtgtgttctgtttagacatttcccctcgcatttatgtttatttgtgtgtgtgtgtgtattcctttacttaaacccatgatatatagtacttccttttatatagaaaaaagctcagtgtggaaagaacaacgtatctggaattaagaaacctacattcgattcacagttctgcaggctttttcatcagcttgctgggtgactttgaacaagtgactttacctttaggcatcagtctcttggtgtcccaggggctgcaaagtgggacagagaagatgaagggaaatacttcaatttgctcctgccccttcccaccaccttcaactggaactcctttaactaattaacaatttggagttcatgtaaggatttctttgggaaaaaaagaagatcctgctgttaaaatcaagcttgaaaaactttgcactagaagagagctccagaagtttggcaaaagacatattcagtagccacttaaaaagtccctgtagtcaaccctacatctctttgctaatggaaattttggatagagaaacctgggtctgtgagatccactgatggctccagaccccaactttagccatcgcacgtgttgaactccaggttgagcctttgctggagccgcctgcaaggagcatgtttgaccaatccccagtggaggggagggtggtgtttcctttctgggacttccacaagttgagaacagaccatgctgccctgggcagttcttgaaggctgtgagagtgggcctgacaaagtttattccttttttttttccattctcttttattattattattgtttgaaattgacaaataaaaattatgtatatttatgatgtacaacatgatgtcttgaaatatgtgcgcattgtggaatggttaaatgaagttaaataacatatgcattacctcacatacatacttctgatttatttgtggtgagaacacttaaaaatctcctcccagcaattttcaggtagatgacatacggttattaactatagtcaccatgttgtacagtggatctcttgaacttattcctcttgtctaactgaaaatttatatcccttgaccagcatctcctcatgcaaaccataccccaaagctcatttctgtgttcctgctgagtttgccattccaagaggttttgatgctgaaggtgcagtttgtggaaagcccagcagactctggggagcctacatttaaataaatgcaaatgtcgacagggaggcagaacagaggacatttcaaattagctttaattttcttttagcttataaaagtaattaagcttattatttaaaaaaaggcagctcagaaatataatgcagaaagtaccagtaccagttccttgtagtcttgtccttaaagataaccactgttgatagttactgcagagtttttttctatgtatttgtcaacatatataattatttatcattattgttatttctcaaataggataatcaataataggatcattgtcttttttttttttttttttgagatggagtctcactctgtcgcccaggctggagtgcagttgtgtgatcccagctcactgcaacctccgcctcctgggttcaagcaattctcctgcctcagattcccgagtagctgggatcacaggcatttgccaccacgcccagctaatttttgtgtttttgatagagacagggtttggccatgttggccaggctggttttgaactcctaaccacaggtgatccacccgcctcggcctcccaaagtgctgggattacacgcataagccaccgcacctggcccattgtctcttaataatatactctaggcatctttttatgtcagtttatggctttccattatttatcccaagagctataattctagccataaggcatactctttgttatatggatatatcagaatttacttaaccaattccctgttggcagacattgggatcattcccaattatttgctactacaaataaagctgcaggggatatccttattcatttattatgcacctttgttcaagtgtttctacagacttaatttcttgaatgaaagttggtgggtcgaagggcatgcgtattttaaatttaaattttagtaggtgttgtcaatttgtcctcccaaacggttgaaccagtttgctttcctaccaagacaggctggcagtaaggactggtgttagcaccgcggcctgctgtccacacccataacacatgagctgggggaggaaggctgcagaactggacagcaggatgccaaggaggtcaccaatagggcacccctgggctgagcctcggacagcttggtacagacctgcttcttctgtatactgaatgaggtggggtcgatgctaataaaaatttccagaactcttgagatgcagcgtttgagtcaaatatcaggccatcaggaagaaatggccacttgtgccttgtttgagggttctcatgccttgggttgctaggcttcctagggtatgagtccccctgttgatgttttctggctggaagagtggatacttccaggactggcagcaccttgaagatcatcaaatttgacacctgtttgttttacaaaaaagcaaaaagggagttcctgagaagtgaagtgacttgtccaagatcatacaactggctcagtggcattggttgggtctctccctggggactcttgtctcctgcccagagtgatttcttcactatatcctgttagagacaaagggccctttcacgtctgaccctgaggtggaggcgaggggatggggattcctggtgtaggaagtgactagagtgaaagtaagggggaaggaaatgaacatttattgagcatccactatagagggttctttcatacgtgttatgtcatttaatcctaacaactcgggagcactggggaaaggaagcagctgtttggagtctccggtgcttggccgatgtggctggttagacccgttaaatactacagagcagttatcacttctcgactatgaatgtgacatagactcaaagaggcactgggccttggagagagcaccagagagatgaagggatgtacttgaggtcatacggccagaggaagggcaaagatggctttagacgtgaggtttcctgctgctttgcatgctttttctgccatatccatctgttgttttactgctcctgccttaccacatttctcaggagctgggtgttaattttagaccacaaccttagagaagacaggactctgtccctggaatgggctttatgcagtcttcagcacatggcgacctaattaacctcattggagatgataaccagacataatgtggcttcatttacaaggacaggacctgccctagatcttcccattaacatcatcttgaagtgtcagctccacagagagacctttcctgaccacatgctttaaaggagactccttccctcattgcttgctattccccgccccccccacccccaccctttcttttccctttgaggcagagtctcactccatcacacaggctggagtgcagtggcacgatcttggctcactgcaaactccgcctcccatgttcaagcaattctcctgcctcagcctcccaagtagctgggattacaggtgcgtgccaccatgcccagctaatttttctagttttagtaaagactggatttcgccatgttggccaggctggtcttgaactcctgacctcaggtgatctacccgccttggcctcccacagtgctcagattacagtgttagccaccatgcccggcctatcctgctttattttcttacagcatgaagggtcaatgaaaggatatggccagtggtcaagacatttgaactttgtgtacagggaatccccttgctcagacaaaaatccttcctgtttttcccttgtgaacaaaagttctctgaaaaggaattgggaggaaagactttattccaatgaacagtttggaaactggggaaactcagctgttggtgtcagaattgggggtttataatgaaagttcctgcctaggatcctgatgaggtccacttatgcaaatgaacaattccaacttgcttagttctgtttggttgaaacaactgaggcctgattggtcaaggcagcagagccctgactggttattttaggttagctctggaggtcccaaagttgaagagaggtgttgattttcagggaactcaaagtgggttgtgacctctagtcagcaaatggcagctttgctctgtttaaaatttaggcccacttagccactccagatctatcttgaaggactggctctttcaggttcacatttgttcacaccctcatgccccatgagccatccatcagcaagtctttagatggaacgtatctagagtctgaccacatcagtggctccgctactgtccaaatccactgccatctgttgcctggattattttagtacatttctaattgaataataagtctctttcctttttgcttcccttctttctgtcttgcactcagcagccaggatgatctttttttgctcacctctgctcagattcctccagtggcttcccactatgtggagaaaaaagccacactctctaccatggcctatagcttcctagtgttctggtccctaactgctcctctaacctcctctgtgcttttctcttcctcctttctctccacctgctatttctttaacaggctgatgtccatccagatcttgccttgggttctttctggaatgtctgtgccttggatcgtcccaggattcactctttaacatcattttgaaatgtcagctccacagagagaccttttctgatcacatgctctaaagagagtccttccccttattgcttgttattcctttatcctgctttattttcttacagcatttgccactgtttgaaattgtgcatttttgttgtgtattttttgttaccatcttcctcactaaaatgtaagcttcacaagagcaggggctttgtttagtttatcagtgtgtctccagtgcctaggagagtgcctggcacaggtagatgctcaatgaatatttgtcgagtaaatgaatgaatgaatcaatgaatgctgacaccattgatatatataggtagaaaaatgtacagctaaagtaaccatttttcaaaccttatccatacgtggattaaatgcaacaaaaatttcatttcatgctggctttttttcaatcatgcaaagtatttcacggcagtgttcttcaaaatcatgccatatacatgatggagatgcaaatccattttgtattagtttcttagggctgttgtaacaaagcaccacaaactgggtggcataaaacaacagaaatttattcttgttggaagctagaaatctgaaattaaggtgtcagcaggcccatggtccctctgagactctgggtagaatccttcctccttcctatcttctggtgttggctggcaatccttggtgttccttagtttctggctgtatcactccaatctctgcctcatgtggcattctctctatatgtctctctcttcgtgtggtgttttcctcttctcataaggacatcagtcatgttggattagggcctaccctaacgacatcaattgatcacatctgcaaagacctgatttctctgtaaggtcatggtcatgggcactggggtaaggacttcaacatatcttttttggggacataagtcaacttataacacattttaatattggtggaggcaagttatacacaaatgttttccaatgttaaataccgtacttaactggctctgatatacttaaaaacagttttaaatctctaaaatcaggacatatactatattcatagtgttagatttgatgaaatatggtgcctgggttctctactgctttgggtgatgcttactggagctttttgctcagagcacagaggtatgtgttaccctaaactccacctccctgtctccttctccttccttgggttacttagctgatgctacatttaaggaaggaccaaaattaaaataaactttcttagcaacttgctctagataaaccacttgtgcctatgtaggacagtaagcatgagatttttttttttcatgagtcacatggccaggtgactacaatgaggcatcatgtgagtcacccactgtccccatggacctaattgggaagtgagcagtcaaaggtcagtggcagggctggggacccagattagaactcctttctggcagagtgatagatgtccatagtgttagtggaacatcctcccttctcgataaacacctcttactgtgacttagccctctcctgtagtcccctgtcctcattagggtggcctgttcctatagtccagcatcctgtctcactggacaacatgtcctcaaaatagcccccattgacgcattatgacttccactggatccaattccctcccttgtttcctttgttcttccatttttcccaccctttgtctctcttctgcttctgtgattcaagctgatgtgccaaaccacagccttctacttctactttccaggcaaacttcttggctggtcttgattggattaaaatttttattttcaaaaaacttttttgaggcagggtctcactttgttgcccaggctggagtgcagtggcacaatcacagctcactgcagcctcaacctcccaggtccagctgattttcctgcctcagcctcctgagtagctgggactgctggtgcatgctaccatgcccagctaatttttaaaaaaattttcatagagatgggggtctcactatgttgcccagactagtcgccaactactgggctcaagcaatcctcctgccttggcctccgagaatgctgggattacaggcatgagcctggattttcgaagactaatattcctaaccccatttagaagccagatctgacaagtaaacatttcaccctggtgtgatactttctggctccacgctcccacgactccttctgctcagggcatacttaacgtcatgtctagtgtcccctagaatgatgtcatcaaggaaaaaaaagtattcacctgccctaaacaatttgagactcaggataaaaacaacaataaaaccaatataaattacagcagcagcagcagcagcatttattgagtactttctgtgttccagctgttgtgctcagagttttacagggtttggtttatttcatccttacaaccaccctgtgaagactggggtcaatccaccttgtccctggttctggctaacctgtcagaggaaaggggtggtaggaggtaggagttgtttgttctgtaagtgacattatggtgaagattcccactttagcaggaatgagtctgggccccagagaatgagcaggaacataggctttatgaatgactggaaacagaggcccaaactccttccacacgttcaggagggaggggtgggctcagaacaacaactcattgaatcagcatgggctcagtgcagagacttctgatgagtcagtcacttttaaccactgcattccagggaatctgcctgggtagcaggacttggttgggggtatcatggggggttcattggttctcataaaatcaacctgtgattcattaaaaagagtggataaagggacttggtaaccatgactctgcaggcatgatttcctaaagaacaaatcccagcacctcattttatcctctggggtcagggaccattagttcactgggagggacctgctgttatttattttgtatcttgcaaaactttctattgtggctacaagtcaaggactcatagggaaatgctaatttgagaatgaatgggtggttaaatgaatagactgggaaaagtcctaaaaagtaatctgacagtgtctgtattagttcattttcatgctgcttataaaaacatatccaagatttggtagtttataaaggaaagaggtttaattgactcacagttcaacatggcttgggaggcctcaggaaacttacaatcatggtggaaggggaagcaaacacgtccttcttcacatggtggcaggaaagataagtgccaagcaaaagggagaaaagccccttataaaaccatcagatctcatgagagctcacttactatcatgagaacagcagcatggaggtaactgcccccatgattcaattacctcccatcaggtccctcccacaacacatggggattgtgggaactacaattcaagaggagatttggggggtggggcacactgccaaaccatatcatttcaccccaacccctcccaaatctcatgtcctcacatttcaaaacacaatcatgacttcccaacagttccttcaaatcttaactcattcaaggattaacctgaaagtccaagtccaaagtcttatctgagacaaggcaagtcccttctgcctatgagactgtaaaattgaaagcaaattagttacttcctagatacaacgggagtggaggcattgggtaaatacagccattccaaatgggagaaattggccaaaacaaacaggctactggccccacgcaagtctgaaatccagcaggacagtcaaatcttaaagctccaaaatgatctcctttgactccatgtctcacacctaggtcatattgatgcaagaggtggtctcccatggctttgggcagctccacccttgtggctttgcagggtacagcctctctcccagccactttcatgggctggcattgaatgtctgtggcttttccaggcacatggtgcaggctgtcaatggatctaccattctggggtctggaggatggtggccctctgctcacagctccactaggcagtgcccgagtggggggctctatgtgggggcctcaacccatatttcccttgtgcactcccctagcagaggctctccatgagggccctgccttgtagcaaacttctgcctggacatccaggtgtttccatacatcctctgaaatctaggcagaggttcccaaacgtcagttcttgacttctgtgcacctgtaggctcaacaccacatggaagctgccaaggcttggggcttgtatcctctgaaaccatggcctgagctctatgttggtcacttttagccatggctagagtggctgggatgcaggtcaccaagttcctaggctgcacatagcagggaggccctgggcccagcccaggaaaccattttttcctcttaggcctctgtgcctgtgatgagaggggctaccatgaaggtctctgacatgccctggagacattttccccattttcttggtaattaacattcagctcctcgttacttatttctgcagctggcttgaatttctccacagaaaatgggtttttcttttctatcacatcgtcaggctgcaaattttccacacgtttatgctctgcttcctgctgctgtatgctttgctgcctagaaatttcatctgacagatcccctaaatcatctctctcacattcaatattccacagagctctagggcaggggcaaaatgctgccagtctctttgctaaagcataggaagcatgacctttactccagttcccaataagttcctcatctccttctgagaccacctcagcctggacttcattgtccatatcactgtcagcattttggtcaaagtcattcaacaagtctctaggaagttccaaactttaccacatcttcctgtattctgagccctccaagtttctaggaagctccaaactttcccacattttcctgtcttcttctgagccctccaaactgttgcaatttctgcctgttactcagttccaaagtcacttccacatttttggtatccttatagcagcactccactctaccattgccaatttactgtaatagtctgttctcacactgctaataaagacatacccaataccaggtaatttataaaagaaagaggtttagttgactcacagtttagcatggctgagaaggcctcaggaaacttacaatcatggtggaaggggaagcaaacacatccttcttcacatggtggcaggatggagaagtgctgagcaaagggggaaaagccttttattaaaccatcagatcttgtgagaacttactattaggagaacagcaacatgaggataatcatccctgtgattctattacctcccactgagtccctctcatgacctgtggggattatgggtactacagttcaagatgagttttgggtggagacacagccaaaccatagcagtgctcatatctcccatggtcctcttccctcttctaacccttcttgatgtcttcttgtgcttctctctcttgtgaatatcaatggcatttatgtccagaattaccccttggcatgccaattcccatggaaactccagaaagggagggagatacttaaaatagttcaggctgtgctcctctcagaagtcttctgataggggaaaaaagagaggctctgtccacatctgcctgggaagagagcaattataaggctaagagatggccaggcagctcatgcagggagaagtcttgggttgcattgttcgttgtgaacattcaggaattctgaaactagcagccacttttctttcattatagacattgcatggctcagggctgccccatctcagaggtgaccttgatgctttaaggccaggcttggaaccaatgtcatcattcccactcatgggcctcacgcttacattctgaagttgtagtcaagtcggagagtggagccccagaggttattcatgggctcataaaggcatcccacttgtagaattttaaagttgggcaaggcctttgaagttagatggactcaaggctctgaggaaacctggggcttccaggaggtgcttcaaggattccgcatataatctagggtttttgggagaacaatgaaagtttaaattgcctgaggaattgttgtagcccatttacatgttttatattggaattctatgcataattttgagaaatgagctcagttgcttaaaaaagcaaagcaaaacttcatctattcccctacctttcattttgccccagtgcatatttactgagcatctccactgagtaagaactggagctgagctgggcagggcagagcaggtctcaagggacttaaaatctgttgggtggcagtgttgttaaggcagacacataaattattatgatgtggtaggaatattagaattgaagaaatggaggctgagaggagttaaatgattcacccatggccacactattagtgggtgactcgattaggatgacagtctactcattgtgtgtacccattctgttagacctcctgtcccccaagtaaggtcctgaaatgggtactgttaaagtatatataattttaacagagttaaaagtatgatttctacacaaatataaagggaatatgtgtaaaagattttattcaactttagtaattaaagaaccagtaagacgttaggagtagttcaaaaggaatttcaaagaagggagatttatggttgatcagtcaaaggaatgctgaaatgaattagtgaatagattgaaaattggttaatattctgcaaggcaatgaaccttaacctgtgggggataaccttttctaccagacagaaatcattggtattgttgttggataagaataatatacattgttctcttatctaaataatttaccttgcacaccacaatatgatcatgattagattaaaatgttgtcttagccagttctagcagctataacaaaatgccataaactgggtggcttaaacagcaaacacttatttatttatttattttgagacagagtcttgctcttgttgcccaggtggagtgcagtggcatgatatcggctcactgtaacctctgcctcctgggtttaagtgattctcctgcccctcctgagtagcctcccaagtagctgggatcacaggcgcccaccccaatgcccagctaattttttgtatttttaatagagacggggtttcaccatgttggtcaggctggtcttgaactcctgacctcaggtgatctacctgcctcggcctcccaaagtgctgggattacaggcatgagccgcctcaccggggctatttttttttttttttttttgagatggagtcttgctctggctcaggctggagtgcagtgacactatcttggctcaccacaagctccgcctcctgagttcatgccattctcctgcctcagcctcccaagtagctgggaccacaggggcctgccaccacacccggctaattttttgtattttagtagagacagggtttcactgtgttagccaggatagtcttgatctcctgacctcgtgatccgccggtctcggcctcccaaagtgctgggattacaggtgtgagccactgcgcttggccattttttttttaaaagaataatatacattgttctcatcaagaattatttcccttttttttgagacagagtctcgcactattgcccagggttggagtgtaatggtgatcatttccgtttttatggttttcaataggtcaacatctactcttacagtattgtaaaatatcctgattaatagaagccaaataataggtacatactcttagaaaatcagataatccctaagcatggtgggtcagctagtcaacattctgcattacattgaaaggacatttgtattttctttgcctgtttccaaattttatgtaatctttctttctttctttttttttctttctttctttccttctttctttctttctttctttctttcgttctttcttttctttctttctctctccttccttcctttctttctttccttttttttcttttctgagatggagtctcactgtgtcacccaggctggagtgcagtggcatgatctcagctaactgcaacctctgcctccttggttcaagtgattctcctgcctcagcctcctgagtagctgggattacaggagtgcaccaccacgcccggctaatttttgtattttttagcagagatggagtttcaccatgttggccaggctggtctcaaactcctgaactcaagtgatccgcctgcctcgtcctcccaaagtggggagattacaggcatgagccaccacgcctggccataatttttctttacaatattgtgtgtgtgtatacaccctcattttctgagtgtgtttttgtccaggtgttgggaaggagggaattcagtcacactgtaataaaatgaatggagacagctaaatgagaagttttggggacactgggaaaacatcgcaatggtcaggctgatttctccaaaataggttcgctggtcttaccagctggggtcaaagaggtccctttggaaaactgcatgaaggagctgtcagggtaactgggtcatggagaggaacagatccctcacattctgctccttatattggaaaaaacctccttaaggcactgcaggaagaagggttcacctggctggagcaggaatgctgagctaggcaattagagaggacagtggcttctgtctaagcagatgcctgggtttggcttcctggctgagcttctcaaggtgattttggttctcctggttgtttctgctcctcctcgtagcctttgctctgtcctttgacagtatgaggactgttcacatttgaatagcaccttatagtgtaccaagtgcttccccttacctcactgaattcttgtacaaatcctgagagacagatattgtcatcccatagaggctagttgagttgcccaaggtcatgaagtagttagcaggaagaacattcagaattcaagcacaaaccttccaactctaaaattccatgttcttttagtgtatatcagtcagccttttctaacatttctgcacttcctcctagagcattttgtggttggattccaagatatatgcattgagaagcttgagaagatttcagatttgcttttcttttgccagtcagtgggacactgccaccaaagtcacctcaccctccacgcccccactgtatttaggctatgtgttaatgttagtgcatctgggccttggatcccctgtgtagtggctgtgaatatcactagaatgactgaagaggggatacattgccatttttctgggccccggagatattttcatttgcacaatgtaggtgtcaaaccagttgttaattaaagcctttccatcagttacgatctgagacttgcgtccatggctcagccttgccctgtcacttgttaccactgtggcctcatcagttgagagcggtgatgagtttctcctgattttcctcctcctccttcttcctaaccaataacctgtatttggtagacgtctgtggtatggttagggtgtgtttgtgtgcacctgagagctgtaaacctggacattgggaaagttgggaaggatgaggcaggcaagtaccttcactgagccaaatctggtgctaatgcctttgtctgtctgttgcagggcccaacatctgtaccacgcgaggtgtgagctcctgccagcagtgcctggctgtgagccccatgtgtgcctggtgctctgatgaggtaaggagcagataccagaccttgtttcttctccagactaagctgcttttgtgcagaaacagacccatgaagttatcacctccctcttgaatacacatgccccttatcccttctaagcaaaactttgatgaatttttcccattgatgcatggtgaggagctgtcatggggatgttgctgggaatactaacccaagtctaccatatagcccctggcccttgccagtttggctcgacctcctgtcctctctgtaaccactgctgccctttctcacactttgcttgctttttttcctaagaaaaacagtttattttaaattttttgttagagacagggtctcactatgttgcccaggctggtcttgaactagacataagagatcctcctaccttggcctcccaatgtgctgggatttcatgtgtgacccaccatgcccagccctttgcttgcatttcttggggtggaatatcccagggaagcagggcgtcaggtctcaaaaggagaggcagcaaggggtataggtacggatggggttgggaggggttgctggcttacttctttttcctagaggttaaaaaaggcaaatagaagagaaatcttgtgcttgtgtgtggtgatgtttagtcagaaaatcttttctcttcccttctctttgatgattgggccccgcggctttacatttttctttctcttcttctttccttccttccttctcacaggtgttgaagaaaggagctgggcccacttggtgaggatggaagggggacaggaaagggttagttgtgtctaggcagagggtttgttgtgtctggggccctagggaatgagtgtgtctgagggaatggctatgtttgtggctgggatggaaatttggagctggcaagagctgatggggtgggggtggaagatgaatgtggttgaagagattcggtgattatagagtctcaggctgagtcactggcctggccagcaggtggttacctgagttcctggcctggctgcggctcagctacctgaggcttcctctgtcccacaacaagtcccagccctctccagttttatgaccgctccaatccagccctcagtctctctgtctgcttctttttcagatctgctgagtttcctaaaaaggcaacctccctggccgcctggggggaggggcgggagctgggaggctgtgtttatcaccggccaggagggctgccagagcagcagaggccagctccgcacgttgctttggcctctttgccgttcagcacgggaactgcttccagaggcagctgcccaacatctgggccacattaacttcatttagcaaatgaaacattccctggggctagggaaggggtgtaaggggggcatggatgagaccttctcccccacccccgcaggttctcctcccctctgggctgagcgggctgctcagtgtgatgtagcctcctccctccttattcactatgtcctccttcctcccatcgtgatattactaaagcttcttttaccaggaagttgcaattctgcaactgaatgctggaagaagagagagctgaatggggaggggggccttgggtagccgaaagccttcaggagcagaggaaggtcaggacagaagccctagtgtcactcaaagggtgcttcccccttttcctccttccctcctttccaacccaaagcaagagaaaatgcaggtatctctggcccagagaatctggggaaaaagaaaaccttcttggagggtctgtcctgctccctatcccccatttttcatccctcttgatctgtatagggactagccatgcagctgaggtgggctggggcctgaccagacaaagcccttaggtcacataaccagatttcaaagatgcaaatgtagaatatttatgggtgactgttgtgctccttgtcccctggggcaggcctggggagggcagagggaaaggtgcagggtagatcagagcatgacataggaccagcctaggaattaggggtgcagtcagtgaggaaatgggcgcagctaggaccaaagaaaacaaatggaaggaggtagaaagtccagtaagatattccctgggagaatggcatataaacatgaaaggaggcggggccaaggttagtgaaggactacaactatccctcagcaagagggaggagggagagaaggaagggtggaggaccccagtatgggacagaatgtggtgaccggggagggatgggaggtgggaatcctggactgtaacctgaacataaatgctattttgttcttgagaggagcagggcttcccctggataggccaagtttaactgctgaaaatgccttggacattgacttcaaaaaaccaaaggtgaactggctggtccattttttaggtaattttttgaataatcaaaccttggagagccctctgttcttcttcctcccctgagttggctgttccaggcaagctggcagtgcctggaaaaacaactggttgggctcggctttccccttggtcctagaggaccggagctcttgggtgtgtatagtgagagcttggctgggtaagaggaaaacagccaacgtggatgagcacggagttttgggcccatctgcatagggtgtgttcttggagggttggataccgacgcgggttgggttgctgtgctctctctggtccataaatctagcaaagaggcgggctttatacagagactcaacgcgtagtcttagtctcaacagtgacatgctggagtctagaacctcccaaactcatttggtgttgagaattgcctgaggtgcttgttaaaaataaagcttcccgggatggatcctgggtctgttacatcagaatggatatttatgatagcaagtttggcaaacattgctaattgaagggccactggggttgggtcaaggtggatggaggtggagttaaggttgccagataaatacagaacatccagcctggtgcctgtagtcccagctactcaggaggctggagtgggagaatcctctgagcccaggagtttgaggcaatagtgcaccatgatcatgtctgctaatagccactgcactccagcctgggtaacacagggagatcctgtctctaaaaaataaatctagattacagaacatccacttaaatttgaattaaaaaataatttttagtataagtttgtcccaaatatttgctaaatttggcaaccctacagtggagggaaatactaggaattcttatataagcctgagtacaccctggaaggtgggccagcttcccacttagcctgacaaccaagggtgacagaggaagaaggagtttgagtctagcaaagtagaggaagactctaataggatttccttctcattttcttctctgcaactgcaggagcaagatataggccatgatttacatttctttataatcacaaacataattttattctgacttgtcttctttctatttatttttaatctggaggacaaatgttcatcttgagagttttgctccaatttattattgtaaaaggaagtataatattaagagtgctcctcttcttgtaaacaatgaaatgtgaataccaacaactataaacaaaaatgcttcatgttcctcccctcctcctttctgccctcttcattcttttctctttgcatgttcaagtgatttcttgtcctcaccagatgagttaatcaagacagcaatggatgggagatgttttggtggtgctctggggtaaaaaaagtactggggcatattgactctcgctctccaagaagagtatgaaataatagtagttattgtggtaactgtaaaaaagagtcacctgccaggtgtggtggctcactcctgtaatcccagcagggccaaagtgggcagatcacttgaggtcaggagtttgaaaccagcctgaccaacatggcaaaaccccgtctctactaaaaatacaaaattagctgggcgtggtggcgcaggcctgtaaccccagctactagggaggctgaggcaggagaattgcttgaatccgggaggtggaggttgcagtgagccaagatcgtgccattgcactactctagcctgggcaacaagagcgaaactccatctaaaaaaaaaaaaagagtcacttatatttgcatttatttgcttatactgtgtcctaaagcaggggctccaattcctagtccatggcctgttaggaactgggccgcacagcaggaggtcagcagcaggtgagtgagcattaccgcctgagctccaccttctgtcagatccgtggtggcattagattctcacaggagctcaaaccctactgtgaactgggcatgggagggatccaggttgttcactccttatgaggatcaaactaatgcctgatgatctggggtggaacagtttcattctgaaaccatccccacctccctgtccatggaaaaattgtcttccctgaaaccagtccctggtgcctaaaaggttgggaacctctgtcctaatggatttcagtatagttaacttatgttgagatttttatattttgaaagcatttcacattcacagtcttcttttacttcctgaccaaccctgtgaaataggcaggataatgacaactattcatgttgtactttcccaatttccaaaatgggattaatggagaatggtaccaagagcgtgtgtcaccctcccaggagagggaggtaattcagccagctcgcagggcgctggctggaacctcccacctctgtgctcaggcccttcccctgggtcttggctatttttgccctttttgtgtaacatccggtttccctgggaactgaaactttaatatccacccctcccccttctagctttcttcctgcataacctggagacattctttctaccttctcagcctgggttaccaagaaagggaatgttgcccaagtatgttgaggtcactgccttggtgctcttctggaacagagggctctcgtggagagcttggctgacgagcaggcctgttatattcctgacctctgatgtcagcaaccacaaagggagggagggaggcagttttgtttttcagtgtttaatttttctaaggaaactcataacaaaccattaggactgtcagcacatcttagcgcttcaaaccctcttctcattaggactgccacattagaaaataggagtcaggaaactcccgtctaatgcattctctccctctgctgatggagcctgaagatgcatgaaggccttgctgctctcatccagtttgctgggctccggtccctgctgtcttcttcagcatctgtcttggtcctggaaaggatccgctcctcactgcattctgatttatccactgcctttttgggaaggttttctccctggggctttgtgggcagctagaatcagagataggattggggcttttttgagcaagagaaagactgcttccagaggaggaaggggtaggagaggtgggcagggacaacaggaggagtctgggcacaaaacctgaagtgcccaagttctccccaggtcattccgtcctcagccagagctgggtgcacgggagactttcatcttcctcagagttgtggaaggtctgtgatgtccctgttggagtatttgccaccaggaaggttaagtcttattcattgatttccatcgccgaggctggttccctgcctgcatacctgtgaagatgagagagaaagagagaagctgctggcttccagaaactctacttacttcttgcctgggccagggtagtcctcatgctgttgatgttgctcgtgtccccatccacgtggggaaggcttcagcccatgaaagggggatcggactggagagggagagagactttaagcattgggaagggttttgggttacagggtttttttgtttttgtttttgttttgaggtggggtctcactctgtcacccagactggggtgcagtggtgtgatcttggctcactgcaacctccgcctccctggctcaagtgatcctcccacttcagcctcctgagtagctgagattccaggtgtgcactaccatgcccagataatttttgtatttttagtggagacggggttttgccctgtggcccagggtggtccggaactcctgagctcaagttatccacccgtgtcggcctcccacagtgctgggattacaggcatgagtcatcgcacccggccggttacagggcttttgagtatgaatggctccttgtggcccagtccctcttctggcattatggctgccaggttgcttgagggggctgaggaggcagatgtcatccatccttctccatccctcgcacatgcccaccttgcatcctgttccctacctggggcattctctgttgtggctcctccctaggaccattccttccacacttttccttttccgtgccttgactctcactctatacggaatgtagtaaagcttattttatgatgataattacagtcagacaatctagctggcctctcagttctgccacttcctagctctgcaactttgagcaaattccttaatttatccaagcctcagattccttacctgtaagattgggttccttatttgtgaagcctccaaaccttaggtttctcccttgtaaaattataatagttccagcattatggaactgtcaggcatattgcaataatccatgtaaagtgctcaccacagtgcctgacatacagtaagtgttcaataaatgtcaacactagttgttctgggatattggtgtgggttatccagcagacatttggaagtgctggttggggatgtgggtaggggtggggttgaggagagcccgaaggcctagacattgtgaaataggtcccgggaggggttttccagcttcctggctggtcccctcaacttggtaaggagccctcatagacatgcacccacacagtgttggctaaattggctgaatgtcagagccggaagggactgaaaacactgtgtcatctaaaggccttgttgaacaggtgaggacacaaaatgacgtatctgaggtcacatgactagtcagtggcaggcctaggattgatcttctttcctgattttcagtgttctttccagggtggcgtggtccccttcaatactcaggtttaagcacccagagccccagggggccgtgggtttttggaagggtactcaatttgttctttgttcagggtgaaggaggacactgaagtgataggatgggctctggttaggtgcctggcccatgttcccaagtttgtggagtttattcataattagcttatccaggaagtacttgtcaagcatctcatagtaatagcttacatttgctgaggacttcctctgtgccaggtgctgtccaatgcattttatgtggattgtcttatttagcctgtgtgacatccctgtgagggaggtaccataattactattattttaagtaacttttattgtgggaaaatatacataacatagaatttaccatcttaaccattttgttttgttttgtgagatcaagtcttgctctgtcacccaggctggagtggagtggcacgatcttggcttgctgcaacctccacctcccaggtttaagcgattctcctgcctccgtctcccaagtagctgggactacaggtgcacgccaccacacctggctaatttttgtattttcagtagagacggggtttcactaggttggccaggctggtatcgaactcctgacctcaggtgatctgcccacctcagcctcccaaagtgctaggattacaggcataagcaactgtgcctggcccatcttaaccatttttaagcatacagttcagtggcatgaagtacattcataatgtcatgaaacccctcaccaccatctatctccttaactcttttcatcttgtaaaactaaaactctgtacccatcaaaacagtaattctctattcctcccagtccctggaaactactattctactttttgactctatgattttgattgctgttaagtactgaaggagggactgttattatgttcgtgttacagctgaggaaactaggcttggaggaattaggtgacttgccttagtaagcagttgtaagtgcaatgctgagatttactcctgtgctcttagccctgactctctcctgcctccttacactgcctttccctatcacatttgtggtaagtcctaggtcggatgctgggaaatgagaggggccaagacacacacagtccctgactacatggatctcacagtctagcccgtgtcaaatacagtagcttccaaactgttttgactctgacctacagaaagaaacacactgtactgggtatagttatttattatatgtgttattctccactctcctccaacaatataagaatttcacaaaacaaccctttgactatttgtacactttcatattttctattctattctattgtattttatttaacaaaatgatggttgacacctgctaaattgattttgggacccacaaatgtgtggtattccacagttaaaaaatgctggtctaccaggcatcttactgtacaggctctccttctagctacaactccatgaataggccttcttgatatctcaatttctcttttctttttcctttttttttttttggtagagacggggtctagctatgttgcctaggctggtcttgaactcttggcctcaagcagtcctcatgccttggcctcccaaagtatcaatttcccctttctgtacaacggtcctaagggattatcccaggaaagaccacaacaatttgtttatgctccaatgtacggggtaaactcttagctattgggaagtggtagggcctgcaggaggtagagagtcgccatagctctgattgctggacttctctttgggctcctgtcttacaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccaggtagggctgggactctttgcggggagagacctgaagcaggtgggcatagagcacaaggtggaggtctgaggaggaagtcttggggaagtagctcagaatggaaatggggtgggaagacaaggatgaggggggaggtgtgggcaagagaatggaagaaaataagagacgttaggacttgagtcagaagatctgaggtgaatctttactgtatcatatattagctatttgaccttggacaagttacttaacccttcagacatagtaggtgctcaaaaaatatttgtttcttctttacccaagtgcctgttttacctagcttagagctttgtgttgaggtgcaaatgagatatagaacaagaaagcgacttgtaagcccccctttcatggggaattgggacaggggaatgggggcagacacaataggtacacaagacctttagagggaggaagggttagactaaagacagaaattttgaagcattgattttgactttccaactaagtcaagaaggatttacctactatcaaggcatgtgttggatgcaatgggattcagagaagggtagggtgcagtttctgtcttttacagagtctgaagtgtagtaactatcaaaatctctgtgactcacagtgatagacccgtggaactcacaggattagaaatcccctgggatttagagaaagtggaaaattttagaatggaaaagaagaggttaaaaataggagggtcaagagattagaagagtaatagaattgcaaaggaagaggaaaagggaccagggctttctggtttgctttgatcatgcaatttcttagtcccaactgtatccaaatctgcttattcaatcttggtgggagaagaagataaaaactaacatctttctgccttccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgagtaagtccctcctccagacgccaggacagcatcctttgccccaggaaggtccaagtcctggttcctatttctagctctaggatcactttgttggctgtcttcttgccaaactatagctcctttctaccttggtctccctgtttggcaaatgggctagcttgtggatctggagtgttgtgtcaatggagcctaaggctgtttggagaacctagaaagaaaattcatcagcttctcagtcttggtaacaaataaatagaaggcaagagagaatgggagggaaatgacgtcaaaagtagaaagaaatttatggataaggaaaccgagaaattacgattacagaaggatcgattccattgttggcattattgtcttcatcaaggccgtgcatcctgcagggtgaaaacagaagaaatgaagtgctaaggaatataaaagagtggaaatgacatttgttggacacttttatagtctgtaaatggataacttgtgcctctgtttgacactttggcttaaaactgaatggcttatttatttaatcggtggagactgtgcaaatccatgtattagaataacttacaatgctggttgctgagcctgaaaaggtgtgaatttactttttagttttcaaagttacggccaggtggggtgactcacttctgtaatcccagcactttgggaggccaagatgggaggatcacttgagcctaggagtttgagttcagcctaggcaacatagtgagacccccatctctacaaaaattacaaaaaaattagctatgtgtgatggcgcatgcctgcagtccccaggactacagggaggctgaggtgggaggattgattgagcctgggaggttgaggctgcagtgagccatgattgtgccactgcactccaacctggacaatggagcacaactgtctctaaaaaaaaaagaaaaagttttgaagttatatgatgtggcattcaaccttctatctgggttgtaaggttcccaggcaagacatcagctattaattaaacacactattttgactgggggcagaaatgctcctgtcttgcatgatctatcaatttattgatggttcagggaccttaacttactgatggacttttgctttattgttactttaggaaagtgttaagtataaggtgatagtaatagcaactcgagcctcgctctggtctaagtgctttgtgtgtatgaacttacttaagtctcacaactcttatgggatatgtgctatcctggcccctctttcataggttggattgagaggcttgccaaaggtcccatgactagtacagagggcacctgggatctaagctcagggagtcttgtttccagctcaatctcttatcttctaggttagctggatgggggtaatgttgatggggagcttcagataatttgaggattttggagtctgaactgtctgggtaactgtggttgtatggaactggccttggcataccactatctatatttgtcccctctctttcctcccaattcccatgctgccttttccatgaaggtgtctgcttaaattatctcccatccctccccagtatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgtgagtttggaggacttggagtgccaggtgtggctggcatagatcaaaatgggaaaggaagtgactgaactctggggatttctggtgtaaaatgagatgagaactaagcagggcttcctgcagttatgagtagtaagttgctcctgatattcagccttggcttagatccactccctggcctgagctgacatttctttgaacctcagtggtctcagatgttcccaggggagagcatcttcccatcttcagagttacttcagagttaaggctgagttaacttaacctcagcaaagtaggcagatgttcagatgagatttcttctagcccagatcagctctgtggatgcacgtcagtttctagatgagcaatgtgactgtcattagaagagttaagtttggagtttaagaagatctcattcagctgcttgaactaatcagctatgagactgttttctgaagagaatgaaactcctgaactggaaagcttcagcttcggttccaaggactgggactgagacccttgttttgaagaaaaataagctgtccagccctttagccagggagcaccttgggtctctgttctctaccagtgacatggctgaatttgttttgtctcctctgcctttgttttttgttttcttttaacaggaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggtgagatctctggcaccacctatggtttctattcatgattgtgagggttgccctaatctaggcagagtctgtgtgaatatgaaaatggcagcccctccttctgggcagggtgcagggctcggttccagcttgcccctatcccttaccaactggacaccgtcatccagcatacaacctatataaccattagagatgtccctgattgtggtgttatcactgccttcactgtcaccagcatagcagcagcatcatgggatccagaatggacccaaaggatttttacaacccagctggaaagcaggtcttcctctccactctgattagccctttcttggaataccatactaacttgtggttattggaagaagacagaggaaaaaaaagagaaagattggccaggcatatgatggctcatgcctgtaatctcagcactttgggaggctgaggtgggaggatcacgtgagtccaggagtttgaaaccagcttgggaaatatagtgagaccctgcctctacaagaaaatgcaaaaattcgttgagtgttgtggtttgtgcctgtggtcccagctacttgtggggctgaggcagaaagatctcttgagcccagtagtctgaggctgcagtgagctgtgatcttgccactacactccagcctgagtgacagagcaagaaccacccccgcctttttttttttttttttttttttttttttttttgatacagagtcttgctttgttgcccagctggagtgcagtagtgcaatcttggctcacaagcttcaccacctcagtctcctgaatagcttgggaccacaggcatgcactaccatgcccagctaatttttgaaaacagggtctttctatgttgcccaggctggtctcaaactccttggcttaagcaatctgccctcttaagcctcccaaagtgctgggattacaggtgtgagccattgctcctagtggagaccccttctcttagaaagagagagagagagagagagagagagaggggaaagaacataaaaggcatggtgaacaggtcctacgaggaaagattaaagggccagagtcatttagcttgaaagaaagaaggctaaaggatgatttagcttatacatgagaaaacttcttataagttgttttatatggccatagaaggttaaacaagaggaaaatatttaaattgaatcaggagaaattactataagccataagagaaatgtgctgtaatgctctaggtatctggggcaggtgtgaactcttcgtctcctaaggacaatatagcaacttcctcatctaggtgacttaaaggtgtacctgtgtaaaggcaggagactgagctgaggatctaatgagctccctgcaaggtctaggatcccatggacatgttcacgattcaccaccgcccccgcacagtgtccttgagttccttggtgtcagccatatccaagtcaagcactaccagacaatgagtcagcaacatttgacccctaatctatgcaaggcactgggccaggggctgagggaggtaacaagactatgtatggttctatccttggggagtttttggtctacttgaggagaaaggatatatatatttacaataacacaagatgcatgattagtgccaaatgggtgtggcacagccaatgtggctatacgtatccaagggaggaaaggtcatcatgagctgggatggccaaggaagtctcctgaagaaggtgggggctaagctaggccctaagaaaggaggaggattaccaacaagaaggccactccaggtgggagacagtgggccagatcactgctgagtggaagagggagagaggtgagcaatatttggaaagaaagactgagaccacacggtggaggatcacgagggccaggccaaggcatttgtcagtagttccaaaacagaggcctaacccagtcccttgtgcacggaagcagctccatagtattagtgcattaaattcaagcaggaagaaagaggtgcttagttttgacaccactggcctgtacctcttcgtctatccctggagttcacaagtagacttctgtgctacttacccttcttatctcactgtcaccccccttttttttttagagacagagtcttgctctgctgcccaggctggagtgcagtggtgcaatcatagctcactgtaacctccaactcctgggctgaagtgatcctgcctcagcctccccagtagctaggactataggcacttaccaccacatctggcaaataaaaaaaatttttttgtagagatggggtcttgctatgttgcccaggctcttgtctcactttcagcatgaagtgaaatggtttaagcaccaccacactctgagccacagcccaagcaagataagttctaagctttagaccctagagatgtacatgagacgtcattaacctctacatccttcattttcctaggattatccctctttggggctgatgactgagaagctatcccagaaaaacatcaatttgatctttgcagtgactgaaaatgtagtcaatctctatcaggtgactgtgccttcgggcttcctggagtgggccctgtgatggtgggtgccccaggtagccagcctgtgctagcattggatacagtccccaatcaggaaagagtctcccctaatccactccccaggagctaaagattgcactctgggcctttttcctgcaatcttgaacttactaggtatgtgttggtgtttgtggtggtggaggggaggtggtgaggggtgtgagaggtttcctctacttttgctcagggctgaaaaactgctagatatattcctggcagtgacaattgaaatatcccgtaccttcctccaatcttcatctcaggactctcagtgggatttggggagggcttttggagaccaccagcttcctttggtaagctctggacatctttgttttcctttctagaactatagtgagctcatcccagggaccacagttggggttctgtccatggattccagcaatgtcctccagctcattgttgatgcttatggggtaagtgtcttgtgctgggaatagtcccgcggagagtccatctcatttggcttacacagcagggctcagatttgtgagtcccagttgccagtctaccacacggtcttactgccttctccgtgtgctcccagagcccaggcaatggcccgctctagaagggatgcagccttctgagaaggaaggaaggaaggaaggaagagagaaagaaggaaagaagatggggatggggatggtgattagatggagaaggagcagagccctggaattgtgggggcagagtgagggaaaactgggctccaataacagggaaaagagagagctgagacatggggaaggtgaggttgatgaaacattaggtagaaaatgccactttccaaggtgaccagtattggcactcccccttttgcaacatctgtgaggcctgcaggagggtgtagctggtacattttacccagactcacctagacgcaagtggagatggaaagagggagcaggttcctgcgcaggaaacagagtcctaggggtgctccggcagcttccaggtcaaaccttggcctctggcactgctggggtgagtccagagctacttgccagatttggcttgggatggaactggctcttgccatttcccgtttcctttcagttcaatttcttgtcttcttgtgcccctttctgctcagaaaatccgttctaaagtagagctggaagtgcgtgacctccctgaagagttgtctctatccttcaatgccacctgcctcaacaatgaggtcatccctggcctcaagtcttgtatgggactcaagattggagacacggtgaggtgggctgggcagggcctttgtcctggagcatctgtgggcacccaaccccctttcttccttttgtagtgactaaaaatggcccccttccaccagaaaaaaaatatgggcaagaaaaatacgtttcctgaaagtcattctaagttagatgtaatggatccaccaatcttttcctctgaggcttctgttgcgtaagccatttctgttacgtgaacttcactctcaggaatttgaaaaacttacaatttggttacctttgtttgtgtatgcacagttgattgcaaaggaaaatatttctttaccttcagtccctcaccagtcgccagcctttccaaggtaattaatacctttcttttgtaaaacgacacaagaaagtaaaatctaaaatgtaaaacactccagtctctccacgactttccttattggtcgtttctcctccgcttctgcctaaggggagaggggttggtgggaggggaggaaggaggggaagaaaatagatctttggatacgctgatcctttctattgacctatctgtctctcaggcacttgtgcaaacatcccatgttagaaatattgtcctgaaacatgctttattgcataagctatgaaatgtgtgggaactgaagtagatcctgagcttatgattgaccaccatgtgggattgtgtggtgcaaaatagtgctttgtgcatcttgctgataattataatcaggccaaagcagggtgtttatatgatcacaggttctgttcagtttgagctggtctatttcatatgtggagtgaaaaaacagccttttattatttattgactgtaaaccatgtctctgcatccagctagatatgtcacaacgatactattcccgtgcttgtgtttttgctttgcagaccttcatatagggaaggctgaggaactccagattgcaaaagcataagacacccaatttgggtattccttggcagggcagggaacaactttttttttcctccagagctggagtgttaactgggcccaactgtgtctaaatacaatctttctttccatccaggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggtgaggagaactgcagggccccctgtcctggaacccacaccccctcatatacctgcaaccactggaaacataggtgaaggcctgagatgggtctttgcaggcagaggtgtaagtcagtggttcctaatctttttgagtataaggaccaatccccttttcacgttaaaaaaaaaagttactgatagatggcaattaaatttttagcatttatagacttagaaaacacatgtcagaatatgtagtaaggttagtaataattttacatgagtttatctttgtatcacaagagaccgggaaaagagtagtatatatgcaagacattggagtgtgcttgaacaatgtctggaaaatggtgtaatgctcttgttaatgttagcactattttgttaatcactgttactactattggtgctactgttattttttggattctagatctttgctatccaatatggtaggctttagccacatgtggctatttaaattaaccaaaattgaaaaattaaaaattcagttcttcagctcatcagtggccacatgtagctagtggctgctatattggacagatctagaacatttcaacgtgatagaaagttctcttggatagcactgccacagagagtccctgctgacagattggggattataattttaagtccttctactcagcagggtactgagttgtccttctcattgcaaaattcagtaaaatcttgaggcccactgataatctcaaactagtttctccttgccccaagaaccactcctggggtactttcccagctagaagttgaactaatgttaatgtagtctttatccgcagacatgttggcaacactctcagagggcaaatagtcttgagttgttcctggggcactgaggatgggtttttactgggccataatcactgtggcttaatccctcttgcgacagacacaagttggttgggactgggttacgggtgtattgtgtggccaaacagagagattataattgttttctggggatgacccttgactcagattggcttcattggcattggggttcttttttttttttgagacggagtcttgctctatcgccaggctggagtgcagtggtgcgatattggctcactgcaacctctgcctcccagttcaagcaattctcctgcctcagcctcccgagtagttgggactataggcatgcgccacgatgcccagctaattttggtatttttagtagagatggagtttcaccacattggccaggatggtctcgatctcttgacctcgtgatcctcccacctcggcctcccaaagtgctgggattacaggcatgagccactgcgcccagccagcattggggctctaatcagttgagctaatccatgcagatactcacttcgatactgatattaacctttaaaaaagctcacttagaaaggtcgatctgtgtctttctaaagcatgtcagtaacataaaaatgactgctttttttattatctacgacattgtttcctttactcatgctgtcaaaattttagagagagtttggaaggaagtgttatcagaatgattaggggagagcaagagatcagatacacacagatgaaagcacaaacagcaaccatttgaattagggggtgaggcaggagtttcacttcattttactatttaaagtatttatatctaattcaaagtaccaaaggaaatgggtaaatttgaagtgggagacccctgggaagaaggttggggactgagggagagagggtggtcccaggagaggagtacggctggaccacgggggcacccccagtcctcctccatggcctgatggttcctggtctggtgtgaggcactgcggcaggatcccagccagagcatgtttcttttggctgctgccccactaaagccacaaaacaaagctgactgggtcagaagccccagttcctgcctctcaccagtgcaagaacagctcctcctcagtgcattccagtctaatccatgagggaaccagggcagccattgccgcctccctctaccatgtcttgctagggtgtcaggtgcccacccagcctcaggtctagaccctgtggtgccatcatcacatcctccagtgacagatactcaggggcgcacatcattgagcacttgctctgtgccatcatttggtccatatgagtgaacaaggggtcatgcatgatccctgacctctccaagcttaaagccccactcaccattgccccttgccagagctgctggctctatgcttcattctttgctataagcaggggctcaggaggcaggtgttctgtgactcggccatttccctagcccatggcctgtaagcatggcggctggttccctggccatccccgttgtcccctccctactttgggcctggtcttcatggttgctcatgatcaacattcctgcctcaaacatcaagaagtgcatcatcctcaagggagttttccacttgccacagccacagatcagtcaggcagcttctgtgagccagattctgtgctgttgtggagtaggatagagaggcgtgaataagacagttaaccaaggataattcccaacatgaggttgaatctgacagatccaggaagtgtggagtgctcagggaatgttataggagtccactggagcgagacttgactggggacagggtaggcctgggtggcttcatggaggaggtgggatgtctgacagatctcagaggaggggcaggctcaggacagacaggagtggagcgagcatcagcccagaaggtctagctgtggggctcgtgttcccaatgaccttaagcacccgttcctccctcccttttctggctcccctccctttctcctcttccactcttcatttcttactttactcctctgactttccgatgaacccggactcagcctcccttttgctggaagggtgccagtcctgtgacattaccacactgtggctaccttttaagggctaaccctaccaaggcttggggtcagcctgctggctctgacctgtcacttccactcccaacctcactccctggctggcccatcttgtcaaagatcactttgtttagcctcacaaaggaaacactatgggacaagagtttctgaggaggcggaggcctctgagtgctgccaggcccctgtggtgtcggtctttcccatccaggagccgtggccaaatgcagggtgtagtgaaaggccggggggcgggtgggggggcagctctgctggctggcgcactcctcccccagctgctgtgaggttggccgatagcagctcacagctgccccttctgtgaagaactgccctcggctgacaggagctgtcttgcccctagatgttggccaatgactgatggagaaggggttactcaaggctagactcttcgcctcagggtgggcctggctttgtggtgccattcacgtaggatcaggctggagggcatctggctgagaccacattcctgccagctctgcctcttgccatgtcctgtttccctccctcctctctacatcctcagcgagtcccttaaataagatcctcatccaagctgtacttctagggaacctagcctcgggacacagcctttctgctttccccacccttctggcagcccaacatctctactttccagatatacttggcagctggggcagcttgggttatgtccgccatccttcctgggaagcagacatttctttccatgcccagcccatagtgcagtggcatgatcatggctcactgcagccttgaactcctgggctcaagtgatccttctgccttagtctccgaagtagctaggactacaggctcttgccatcatgcccggataattttttaaaaatttgtagagacgggatctcgctatgttgcccaggctagtcttgaactcctgggctcaagtgatcaacctgcctcggcctcccagagtgttgaggttacaggcatgagccaccatgcttggcctttgaaggtttttaagcaggtgagttacatgatcaagttgactcatactttaaaacggtggttctcaactgggaggaaggagctattttgtctcccagggcacatttggcaatgtctggtgatatttttgattgttataactggaaaggtgctactgatgtctagagggtggagctcaaggatgctgctaaacatcctaatgtacaggacagtcctccccaacaaaaaattatctggccccaaatattgaaaagtaccaaggttgagaaatcacattttacaaagagaatcctggccacagaggaattgacaatcacctggagaaggggagatgacttacttatctagagacaggaccaggctgaggacagggcatggaaatatctacagtgaggcccatccacccttcgcttaaatagttcagaacatttgactcctaaaatgttccttccttgaaatttctcattgagatcaagcctagttactggactttccataacttctttcttactactttggtctcttttcttcctccactggtcaatttgaagaatattccattaaaactggctccatcttctgttggttaaggccattttctctgtaagttagagacatcttctggaaagaccatattagtataaatagggaaaagcattgcttatgacactgcatagaggctaagcacttgggatctgaagtcacagtgacttcagtttgagtcctgaccctgccatttacaaggcatatggccttgggaaagttacttaacctctctgacctcaaagggttgttataacaaatgaaaaggataacatactaaagaacttgcggctgggcatggtggaccagctggccgggcctgtagtcacagctctttcggagggcaaggcacatggatcacctgaggtcaggagttcaaggtcaggctggccaacatggtgagaccccatctctactaaaaatacaaacattagccgggcatggtggtgcatgcctgtagtcctggctacttgggaggctgaggcaggagaatcgcttgaacacgggaggtgggggtttacagtgagtcaagatggcgccactgcactccaacctgggtgacagtgagactctcaaaaaaaaaagaaagaacttggcacaagcccacaagcctaggcaatataacaagactcccatctgtacaaaaacaaaaataattagccagctgcagtggcacatgcctgtagtcccagctactcaggaggctaaggtgggaagatcacttgagcccaggagtttgaagttacagtgagcaatgattgcaccactgcactgtagcctgggtgatagggtgagactctgtctcaaaaaaaaaaaaaaaaaagcaaataaataaaaagaaaaagaacttggcacagtacttgacacatattaaatgcctccttggttggtttggaaagtagatacacattctcttctctaaatgctttccaagtctgttccactgcactcccagatatgatatgatgaggtcagattgagaagggaaccaggtcaagaaagacaggttgtgttggtgaacttgaactgcgcctgtaactttaaataattaattaattaaaaaaatgttgaattgtggcaaacatttctccacctgttgagtgcagaggcaggaaccaggatgagtcaacaggggcatgggggaggccatcgggctacgtgaggtcattactagtgattgtctctactgctgttcaccttaggaaaatctctctttttttcatttaatttctcttattttctgacttcttttctctatggcattcatgggatttgtttaactgcactggccctcggcagtctgggaggtaggggatatttgttctctctgcttacttggctccgttggccaactccatgggttctcagtgccgtccctctgccccttggatgccccaccccatctacccatacattcagggtgctctgtgtgcactttccctctctgcatttggaataaccccatgccctggatctctcctttccttctttccctatgctacaattttcctgtcttgtgcatgtgccctcagagccctgcttctcatcctgcaaggtaacacctagctgatttgagaaatggaagtggtggctgctttgttagtgggacgggaccagctcttccaaactggaccctatgttgttgtctaacccaactgggtggccacgatgacgacaatggtagtaggcctctcaggtcaggtaggagaggcgagcagcgctgtgtcaggtcaaagggagagagttttggggcctgtgaggccttttgccatcatcaagtcacaccgtcaaggctactgagtgccctgtgtaggttcagggctgtggctttgtgctgtgtcagccaaactagaagggctaaagagcttgcttctagttcttagactagaaggaactaagtcttctaagcctcctaccctttctcttgcctttctcagaaggcagaggtattcagaaaagggcaagagagagggcaagaggcccaggagacttagttcctgagaatcttttgctctacagtggctccgagcaagtcctgccataccttgggacccctagaaaactgagtttgtccctgctgggtaggactcccctgggtggtgagccaattccctgccaacctggaggatcattatctgtgtggttgggagagcaggatggtcgtgtgtagcctgctgccatgggagtggagctctcgccagcgggtccaccttcctgggctgtgtgttttcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaagtgagtgtggagtctggagagagccgggaggctgggaggtaggagaggatcccctgactagaatccccagctctccaggtgtgtttcttgctcaccagagccttagggagaggagtccactccagccagatggctgtctctccttttgccaaaggctttgggcaagttggaatagagccaactgtgaaggagccaaagttgaacgagctggacttcgattgagaatgtcctctcctagggtgacatcctgactccctctgagctgggaggaaggctaaaccagtctgaggaacaatccagtgctaatgttctgattcagtgggagatgtgagggctggaattatggaggacactctgtgaaactactacaaacctcccactttaggggccagaggaagccccatcagcctgagtccatggcactgccattctgcttaccactttaagcagggccagatttacgagtgtgcaacctatgcagctgtatagggccctgtgcctacaagggcctcatgcttgttttaatgctctgccatcactgtcttgacattcttagtaatctttgaacaagggagctgacattttcattttgcactgggcccccaaatgacatgactggttctgactttatagttctcagaaatggcatagggttcaccatcctggcacagccctggatgggacgggaagtttaatgaaggacctgggaggcttctggctgccaggtgctgcctacaggtgagggggacactcccacccctgaactccacacttgccattcaggtccccaggattgtcttacaggcgcgcgcgcgcgtgtgtgtgtgtgtgtgtgtgttttaatggaggtggagcagctttctgaatgcatggagatcagagctggactgggatacgcttaggcttgctccttctttgccttaatcactgtgtcctctctccttcagagaatgtgtggagtgtaagaagtttgaccggggagccctacatgacgaaaatacctgcaaccgttactgccgtgacgagattgagtcagtgaaagagcttagtaagttcagcacatcttagagttgcacacacccaggttctaaatgtttctaattcaatcccagaacctatccaactcccacctgtaaaatggaagcgtgacttctacctcagggaatgttgtgcaggcttgaggaacaatggacacttgatgtgagctggtgtctctgagagttgtcctcctctcttactagtgtgtgcagccatccaccacttctgcttcccagagcccacagactcagcaagagcctgcaaagcaaagggagcaagtgcctccctaaggaagggaagagaatgtatcccattttacagatgaaaaaactgaggcacagagctgggaagtggttgcctgtgatagtcatcatcttagctcagtaggctagtaagcgtttaccaagtttacttaactaaaagtgttatgcagtgcccaagattttgcttaaagctttgcagtttggagggaaaccttcaaccttatggataggcaaccaaaagctttatctgaagtccttctgcctctctggggccccttttgaaataagacagacagaaatacaaacaatagggagaaaaaaaatcttgcctgcaattattcttgaagtattctctgtccttcatcttaacttaaaaggagatgatctttgctgctgtcatcacatctgatatagttatgtgggccagcgaggcattgagatggtactctagtactagagagatggcaatctctccatagatagcaatctcccatgaaggcagaaacacatttcagagagagccacagtaagacacagccagccagtcagcttcctggtgggcgtgttatagaaaagagtcagctctctgggccttttggctaatatcagaagtagggctggggtgaggttagcgatttggggattgagtttgaagaaacagtttttcctctggaggagattaggcttgctatgattagttcagagaggagaggctgctgagatattatttttaccatctacactaggtgggtattacaggctaattgataagcagttctgtacctccacctcccctctacctgtggtattatagtacagggaaaagagtgtggaaataagcatattaaaataaatgcttatttatagggaattttatagcttgtaaaagttataaagtatctttcatatacattatcttatttttctgtcaatagcctagtgaagtagaactacagtactattctcatcttcattttgagtctcaggaaagttaagtaactggcccaagcaagggaatggcaaattaagataagaactaggtcctgaaatccgtactcttttccctgtattataataccactggttttctgaagggttgttgagttcaagtctgcaagatgtgctttgagactcctgttcttgttctgcttcatcactcatttgctgtgtgacctgggtacatttgcttaatttcatcatgtgtcagttttactcatctggtttcatcagtatggggcacagtgcagctagtggagggtaacccctagtatctttgcagaataacaaactttagaattagaagagatgaagtctacaaaacacggtgggagtcagagaagagaggatagctctggggaggtatactggatcagaaacagaaatggaagaaatagaacagctgcataagcaaactattaagaatcactaagcaagcagagaaaggaaagagagggaagagtacacctactatatgttaggcactgttcactttatgctgtttagttcaccgaccttgtgaggtgggggtatcattttctttttatagatgaagaaagacttgatgaggtcaggtaacttacccaagatcacacaacgggtaggtagtgaagccaggatttgaattaaattgtgtaatactgttatatcatgtccctttcagaggaaggattaggaaccaaaaagggcctatgcagtacaaaatacatcagtgagtgtcagtgagtggcaactgccagacacaacagccaccttgaatctaggcatcgtgcacatgaggcacagggtttcctgtcacatacttccctggaagtcctgtgataggggtttggagtggtcccatcttccagtagttgtctcactttttattcctccattttccctactcccagaggacactggcaaggatgcagtgaattgtacctataagaatgaggatgactgtgtcgtcagattccagtactatgaagattctagtggaaagtccatcctgtatgtggtagaagagccaggtgagtgaaccctgacggctcccggccctgccccaggagggagagggagaaccatgttaggcaggaatctctactcatcgaagctgttaagcaaaacaggttaagcctgcaagtgataagttaggggccaggtgtggtggttaacacctgtaatcccagcagtttggaaggccatggtgggtggatcgtctggggtcaggagttcaataccagcctggccaacatggtgaaaccctgtctctactaaaaatacaaaaacattagccgggcatggtggtgcatgcctgtaattccagctccttgggaggctgaggcaggagactcacttgaacccgggaggcacaggttgcagtgagctgagatcgcgccactgcactccagcttgggcaacagagtgagactctgtctcaaaaaaacaaacaaacaacaacaacaacaaaaaaaaacgataagttagggaccgtcatctgggtgaagggcatttataaatacaaatattatcaagaaagtgacttgttaattgaggagacaggaaaatcagaaagcaggtaaggagaagaagatagatatggatctcattaatggacaaaatatatcacgcatttttttgaggcaatgatgtcaagaaataaagaatttaaattttaggactttacagcacatggcatctgcactattaaaattgagatggttgccaagagcaacttgactgtgcttcagaggaaggcctgatggttagaggtgttacctttccaagtttactgcaggatgtagggataggtttgaggcactaaggcaaggctgccctgaacactgaaagtacagtgccttctgggagcaggaggaatccatcccatcatacacagaccagccacaggtttgtcaccaaccaatgctgtcgatcgcttgcttccctttaacaccttcatggcctttgttctccttaaacaacaggttaagatgaattattagaaaacatttttgagtattcactgccagtagaccccttcccccacattaggagaacagaccccagatccatagacccacgtttcctatctttttttttgagatagggtctcattttgttgcccaggttggggtgcagtggtgcgaccttggctcactgcagtctcaacctcttcggctcacacaatcctcccatcccagcctccctgggactacaggcgtacactaccacacctggctactttttaatttttatttttttgtagagatgaagtctcactatgttgccctggctagtctcaaaactctgggactcaagtgatccccccgcctcagccccccgcaaagtgttgggattacaggtgtgagccaacacacagggccaacatttcctatgttgttgctctggaattctaggctccgcctccctgctcatctcccagctccaatcatttcctggctttgagtagaatgttgcagctggggcctcagacagtgggggagatgattctctttctcttccccaactcatgctcttgcagatgctctctttgaagggctaagccactatagggcagtaaagacaacactgccaaaagttttggcattggccaaatggaatttaaccacatggaatgggctcttgagctgggctcttatcactcccagatggggttaccaaataaaatacactaggtcccatgcagtatttggtacacaatgatagtaaaaaataatcatttatctgaaattcagatttgtcttggcttcctgctttttttgttttgtttttgtttttgtttttgtttttgttttgagacagagtcttgctctgttgcccagggtggagtacagcggcgtgatcttggctcactgcaatctctgcctcccaggttcaagcaattctcctgcctcagcctcctgagtagctgggattacaggcgcccaccaccacacctgactaacttttgtatttttagtagagacagggtttcaccatgttggccaggctggtcttgaactcctgacttcaagtgatctggctgccttggcctcctgaagtgctgggattccaggtgtgagccactgcacctggccaagcatcctgtgtttttgtttgctgaatctgccaaccctacccagacttctctgaccttgggtcatttgccattggtccaccgctgtggctggaagggccctccagaggtcacctgatcttgccttctgcttccaggaaacccaccccaaactcctttcaggacacatggttaacagattgttttcccctaaagacctcctggcaccctacctgccctgcccatactaatgtgcagaattaaagagattttactttgataattgagggtcagccctacccaaatcttccagagaatccataattgtttttcccagaactggggcccttcactcttgggaacttgaacactggaacctcacagcctctctccaggcactcatttaattatagacaggttgtaatttggcgggttgggagatagccagcttgagttatggtggtggttgtttttgtggtgtgtgtggtgagcattgggtatatgtttggcgaagaaggtgggagacagtgtggaaagtgggtgtgacttcctctccaggctcattagcaccctcatatataaacacctggtttcataacacttgaggttactggaataagatcacctattagatacctgacatttgtgggaagcagagctctgcagagtatactcagcctgacccccagaggggtgacatgcctctgttttagttgttgactggggttgaacaggaaggcagctttcaatagggttatgattttagatgactaagtattttgggaaagaacccaaaatattgtcttggctggcaggtcctggtctctaagaatgcaaaaaatgtcattaggttcacagccctcaggaatgtaaatatctgaaccaggataacagacacaaatacttacagtggctaaggaagcaaataagttagtgaaaacagctgggtgtaagaagatccgttacaacggtagctgatatttactgagcacttactctgtgccaggcattgttctgagtttttaagatatatttaatttaatcattcctcataacaagtttcttttaaagtcagtgctattactatcttcattttaaagatggagaaacaggaaacagacattcagaaaggttaagtaattttccaaagatcatgtataaaagttaagtgataagtcaggattcaaacccagggagtctggctgtaacatccacaggagcgcagacacaccaacaagtcacactgccttcctctaggagagagaagggagagtggtggggattctggtaaactagaaaacatgagttccaactaaaaggagcagctcctcctcagctctagctaactgctgctctgcaggaatataagaatctctctctttctgtatttctctctttctttcttttgagatagtctctccctctgtcatccaggctggagagcagtggcacgatcatggctcactatgaccttgacctcccaggctcaaacgatcctcccacctcagcatcctgagtagctgggactacaggcatatgccacaatgcctggctaattaaaaaagacaattttgtagaggcagagcctcactatgttgcccaggctggtcttgaacttctggactcaagctgtcctcctgcctcggcctcccaagtgctggcattataggcatgagccactgggcctggcctggattttctttttaaagagactaatatgaaattttagggggagaatctcctgattattcaatattgccaataaagtcaattttttatttcttattcatttatttatttatttatttattttgagatggagttttgctctgttacccaggctggagtgtaatggtgtgatctcggttcactgcaacctctacctcccaggttcaagtgattctgtgcttcagcctcccaagtagctgggattacaggtgctcgccaccatgctaggctaatttttgtagttttagtagagatggggtttcaccatgttggccaggctggtctcaaactcctgacctcaggtgctctgcccaccttggcctcccaaagtgctgggattacaggtgtgagccaccacactcggctttttatttttaattttttaaaaaacttttatttttgctttaggggtacatgtgtgggtttgttccgtagataaactgtgagtcatgggggtctggtgtacctattatttcatcacccaggtaataagcatagtgactcataggtagtttttcgatccccacctcctccccgtctccaccctcaagtaggtcccagtgtctggtgttctcttctttgtgtttaatttttaaaataaacacttgggtgaacccccacacaaaggtgtggctgggttctgtctaggggttaccaggtctagacttctgatttgagccactcagtgcagattattgctgtcctaatgattgtctccttaaaaaaattaatttttgaaaactgtcctatttccttcaaggaccttagttactttgtcaagaacacctttttcatagccagttcaagtgactcctgcttcattcacaaccgccctgctctgtgcttcttcctcacagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagtaagagacggggctgggcgttttctaaagtcattggtctgagactcttaagtggaagcagcagatgctttgggtggtcatgttcagccagtaccatcgtctttccattatcctctgttctggaaactgggagagatggtctcactatccccttgtccttcagcttccttcagcctcttagaaatagtggcaggatgtcattccatctcattctcttctttctcctcaaataaatggttacttccaggctgggcctggtggcgcgtgcctgtaatcccagcacttttgagaggccaaggtgggcagatcacttgagctcaagagttcgagaccagcctgggcaacatggtgaaaccccgtctctattaataatataaaaattagccgggtgtggtggtgcatgcctgtaatcccagctattcgggaggctgaagcaggaggattgcttgaacccagtaggtagaggttgtagtgagctgagattgcaccctgctctgggtgacagagcaggactcggtctcaaaaataataataataataataataataataaaataaaataaaaggttacttccaaatcagactctactcttttatcctgatttattccaattaaataagcatttactgagaactttctatatacttaatcttactctattctcttttggctcttctttcacatttcaacttttttcctcgaccctccaaatggctatttgactccccaaatgtccagagttaggctgcaagtttgttcccatttgatgttgaccccagagctttatactcaagggtcccaagaaactgagatgtttctgttagaacagtgtggaacatcctgtacctatgaggcccacaggaatgtgtttctttctctttttttttggagacagagtcttgctctgtcacccaggcttgagtgtagcgatcttggctcactgcaaccttggcctctcaggttcaagtgattctcctgcctcagcctcccaagtaactggattacaggcgccagccactgtgcccagctattttttgtatttttagtagcgacggggtttcaccatgttggccaggctggtctcgaactcctgacctcgtgatcacccgcctcggcctcccaaagtgctaggattccaggcgtgagccactgcgcctggctaagaatgtgtttcttgaagctaccattataggatttgttactttctgttggaaaatagtttgggaaacctagtgagggtcttactttttcctgataacatgacagtttgtggatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcccttccctttcctccttccttctttttttgagacagggtctcgctctgtcacccatgctggagtgcagtggtgccatcatggctcaatgcagcctccatctcctgggctcaagtgatcctcccacctcaccctcccaagtagccaggactacaggcacacatcaccgagccagctaatttttgtatttttttcccttgtagagacagggtctcactctgttacccaggctggtctagaactcctgggctcaagtgatcttcctaccttggcccctaaaagtgctgggattataggcataaaccaccatgcctggccatggttagtgcttggccagattagatgaaaacaaattaataattatttgagcaaaagctttcctctgtgttctgaattgcacctgatacatttctgtcccttgtccacatctcctatcactgtcacagggaatggaaaataggagaagggcaaaagagacggggacacaggggtgaaataggagaggttctatccccgaatgctgtggaatcactgaagagtgataggctgaatatagctccttagaaatagtggcagggaacaggtgtggtggctcatgcctgtaattccagcactttgggaggctgaggcaggtggatcgcttgagctcaggagtttgagaccagcctgggcaacatgaagaaaccccatctctacaaaaaaatgcaaaaattagccagacatggtggtgtgtgcctgtagtcccagctacttgggaggctgaggtgggaggatgtcttgagtcaggggaggtggaggtttcagtaagccgagattgtgccactgcactccagcctgggcaacaaaatgagaccctgtctgaaaaaaaaaaaaaaaaaaagaaacggtggcaggatggcattctacctcatctcctcctgttatttcctatcaattcccatgccaagaactaaagtgtgagcaaaatgaacattattctgtttcattgatgatgtattccagagaacggtgccttgggaaaacttctgagatgaattttaaacattcagggtagggaaggacttaaggaagtcactgtaagatgctattctgtttcctccacaggccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgagccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgttttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagccctgtctcacccatggattactccttactgtagggaatggcagtatggtagagggataaatagggggcggggagggatagtcatggatccaagaagtccttagaaatagtggcagggaacaggtgtggaagctcatgcctgtaattataaccttcagctactaagacaggtgtggtggctcacgcctgtgattataatcttcagttactaagacagagtccatgagagtgttaatgggacattttctttagataagatgttttatatgaagaaactgtatcaaagggggaagaaaatgtatttaacaggtgaatcaaatcaggaatcttgtctgagctactggaatgaagttcacaggtcttgaagaccaatattatttgtcaatatgtggggataacctgtagctgcattcatgaggtagcaaatagcagttttggcctgtggggtgaacagctaaacagtgttctggcatcagataacacggcacaaagggattgtgtctagctcttttggagaaaatttatgtccagtctcaggatctgtggacaataacggaaaactttgaatattcctgacaagttgccatattaggagtcagttctttacttctctgagattcccaggtcatccatgattttttttttaatttgagacaaagcctcactcttgttgcccaagctggaatgcaatggcaagatctcagttcactgcaatctctgcctctcaggttcaagccattctcctgcctcagcctccccagtagccgggattacaggcacccgccaccacacccggctaatttttgtatttttagtagagacggggtttcaccatgttggccaggctggtctcgaactcctgaccttaggcgatccaccttcctcggcctcccacagtgctgggattacaagtgtgaagcactgtgcccggccagtcatccatgattttaatggggtccaaaggcctctttttctttgttaagtattcctggttgaaatttcttttcttttttttttttttttttgagacagagtcttgctctatcacccaggctggagtgcagtggcacgatctctgctcactgcaagcttcgcctcccgggttcacgccattctcctgcctcagcctcccgagtagctgggattacaggcacctgccaccacgcccggctaatttctttttgtatttttagtagagacggggtttcacggtgttagccaggaaggtctcgatctcctgacctcgtgatcctcccgcctcggcctcccaaagtgctgggattacaggcgtgagccactgcccccggctttggttgaaatttcttaagtgccttcctcacttcctaaccaccttctctgtttgggtttgtgcaacagtaaattaaatgtactttccaaaaagaattggcctaaggctgctcagtgcttcctgtgttgttatttctgtttcctttggatgaaaagaataggtgtcat

SEQ ID NO: 15339 - DNA, 69642 bp, Human
accaccctctccagtttttcaagttggattattattataattgatgtgtgcgtaggagggaacccactttgcctgggagatgagtaaaattggtaataattagacaagcataaggatttgtgaagtgggaggaaggaggcaatgcaagaaaatgtcttgcagaatctgtaactgtcacatctttgcaagtttaacctaaggcaagcaaacttttctcacccagccatcctcaactcactcatatgaattctaagtttttagcccattctccagttcagtcattctcacaagtgtgcttcctagactgatagcatcagcatcaccccaaaaattattagaaatgcagattattgagccccaccttaatctgcctgaatctaaagatgcttgaggtgtggggcccagcaatctaactgattctctgggtgattctgatatatgctgaagtatgaggaccatacaccatgatgtacagacatcttcatagcagtttcatagctgaagatttattgcatttgccattctaatcttttctagttctaatcatcaaacattttaaaaatattttggagtgcaggtagattgcttgaggtgggaagacgttaaatctgtaaaatggagccagacagtcatgagcagcagtgggactgcattttcatcttgtaggtttagatttagtggcatgatgcctatttcaaaaactaaatgtagcagcaaaatgcttagggcattgtatgtgtgagacattagaatgaggaagaaccaaggggttaatgattataatttgcatagaggaacttgaagatcaggaagaaaaggggttatatacagaagagacttttcaaaggtagaattaacttagtaactgactgaagccggaaaggatggaatcaaagatgatttaagattcctagccgaggtggtaaggataatggtggtggcagagctatttaatgagtgaatgagatgagtccattgttgggcatgttaactttgaggtgattgtatggagaggagagcttatctttaggcagattagtataataggaggacttgaaagtatgatgaagaaataaatgtaatgcatgtattcattcctcaaacttttactgagtgtctaccatgtgtctggtacagttctaggttctcaagatgtagtaatgggcaaactctgccctcagaactaatactgtagatggagggaaaaaaataacatataaacaaatgaacaagataaattcaggtaataagaagactgggcaaggacaacaaaagagtagagaatttctttagatagggggtcaaaggaagacctgaggtggtaacatgtgacaaatcatatagagtatagtttttgccggccaaaagattttagagtcacagagtggccaatgagaattacaggaaataatattaaaggatctgttatgctttttgtcctttcaggggctattccatatgaaagacttggagagagagatccaagtataatgttaaaaggaacttgggcttggagacagtccacctcagacatttcagccatttgttagctgggcagaaaactcactttcttgaagtctgctcttatcactagaagaagaaggagtaacacctcatgggattaaattgtaatgattaagtgagagaatgaatttaaaacaactagcatagtgcttggaacaataacagtaatactgagtggatcataaaattcagtcatgtgaagtgcagttttatttaataatgtaatctaatgtcttctgatgtacagttttatttaaaagttgtactttgatcttttatcatgcaaagcactttaaaagcacaagactggagttcaaaaatatttatattattaaattatctactttagctacctggtgacatttagaaaatatgcttacatgcataatactcttaagatagattttattaacttttaaatattttcttcttacagatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtgagttttattatgcttgtttttggttctttgtgcaaagagttctatatatttggcttataaatgagcatgcttatattatcttggcgattgtatgattatgacataattatagtgacattaaaaatgggttagttatcagattaatacagttaaagtatttttatattaacacataaatgttgcaaattaatttatatgttttagattggcgggatgaaatattttgttccattatatatactactgcttcctgtttatgataaaaagattgtcttccctttgagctatagaggatggaaccaggcttggatgcctcccagggatttggtggaaataaactctcagatcactatccttcattttgctgggtggcttaaaatagttgtcactctcagtagttgattgagttggttttagcatatgaggcttaacctaacctttaataattagctcaggagttcctaaagcaaatgaaatagaagagatggaagttagtttttcacctaacagacatttcctttaatgaaactagtttttagtctttgaattatgttgaatattcctgtgttcacagaagcctttggtttcataaatttgtatttgtggcaggttttccttttgtttttttataaaaggagaattcattataactttctggcattatggtctttgaaatgatttcagaagattgcctttcataaattaatcagattaaacataaaataaaggttaggacattccaggaaagcatttccaaattgtaaaggcagggatgggaagggacacatatgaggatgaatggggattacaatttattttattaaggatgagaaattattaatgtaaaattttaaagtatattagtatatattccaaagctaattctagagaaattaagcaaaagtatttttcttaatatttttcctgaaacattttatgccatgctattgcttagataatatataatgtaatagcaaaaagtcttttccaaaattaaataactttaaattatatttaaaaattctttaaaacctttgtaacctatgtaattcattgtgaattgttaattattttaatgataggtagttactttgatttctctgaagtagcatgatcttgaggaagccagagtcagtattcacacatgtcccaacagggcttctttagactatttggaatatattctttgcctgcaagacctgttaactcttcaaggttttctgtatcttttcaaattggaaccactagaaacaccagcttcttagttataccttagatatgctacaccattttgatgtagttgggtttgattactacaagattgatcccaactattaatacattaaaatggtattgcatatctaaggtataactaagagtatcaggaacagttcccatggacttgaatagacagtaatttgacaaaattggttgcatacttaaggtataactaagagtatcgggaacagttcccatggactttaatagacagtaatttgacaaaatttgaagcttgttcattatgcaaaccgactttgagatgttatatagcatcttagagatttgtacattagtatgctattctcagctggtagatctattaattcagcttaatcattaaaaaatctcattgttttatcatcatcaaattgataggggacactaacattaaggagccctcaatataacaacatagtttgttcataaaagcaatattgaactttagtttcaaatcttcactcaactgtacttcccctaaccaggtccttgcatttctctattaatcaaagttcttgtcttctgataactgaataccccaccatttgagaatgagaatggcttctcatttttatagacatgatttctcatgagtttgcactacagtttctttcacggtattatttggagcggtgccttttaaattggcttaattagtgaagttaagttaactgaaaattttacctctagtacagtggtttttaaaatttgagaaggggatagttatgtacccttttgacagtatgttggaagctatggataatctctagaaatatccacttagcactcaaaattctatgtgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatagcgtgaacccgggaagcggagcttgcagtgagccgagattgcgccactgcagtccgcagtccggcctgggcgacagagcgagactccgtctcaaaaaaaaaaaaaaaaaaaaagaaaaaaattctatgtgaattgttgctgctttgggctattagataaattcatgcattatcccctctttaattcgtagacagtttttgctcatgttcttcctagtattgtgaatttaatatttactaaaatttgtataaacttgtcctcactgtttatatatacacaatttgtttttttgaaatattttaaaaagaatgtgaagcaagccattttaagcattatacttatatttacagttgaaaatacaaatgaaaacagcagtgcagtggctcgcacctgtaatcccaacactttgaaaggccaaggcgggaggttttcttgaacctaggagtttaggaccagcctaggcaatatagcaaaaccccatctctgcaaataaaaagattaaccactgtggtggcacatgcatctctgctattcaggaggctgaggcaggagaatcacttgagtccaggagtttgaggctgcagtgagctatgattgcaccactgcacctcagcctgggtaacagagggagaccctgtctcaaaaataaaaaaaacacagcagcagccttcacaagaatgttatttccaaaggaatattcatagttttagtttaacttagtggaaataattcactcggaagcattttgtcactgatcaagcatacaaatggtaataaatgaaacatgaccaggagtaagcaattaggagtttgtacgtccaaggaaatgaactagacagcaagtactctttcgttagaataccctgtttatagtcagggaaagtgagaattaaactgattcttcaaagtacatgaatttcagttaggtaaaactgaagttgtcttacctgtccctttagttcattcatttattgattcattcattgacatatactttcttcagacatgggatattgattgtcctgtgttttatatacttcctctaaaaaaggtggtggggcctggcagttactggaaggcagttgttggtgtataattaaatcatcacaattttagagactttatgtaagaatatgtgcatcttagaattgctgaaattttgtagtatttattagtatctgccacgcagtaggcatttttctaggccctgggtatacagccatgaataaaacaaatatctctgcctaattttcacatgttcacatggggagacagttcacaagacaactagtagtgtgttggcgatacatgtttaaaaaaaatgagtggagaagggaaatcagaaatattgggggtgtcgatattggatttctgtcaagtatggaggagcaacccaagacatttcttaagcaaaaccacaaaaatgataggctatccttatgatgggtaacactttttgtgccatattggctattagcacttgaaaatattaaaataagttaatattttaacaagtttatcctattttacagccaaagaaccctcaggacaaaaaagttaagcagtttacccagagtctcactctggctccagtcttattctggcttcagagaccatgctttaaccactgcattgtatgttacctgttacaaaagttcagttcacatagcttgtaaaagagttgcactatgaagaaagaggtagctgtgttccctcttctctatagtaatttttgataggggaaaaaatttttggaattacatggtgaaaaaaattttggtttaaggttctgcttatcaatttgttctttatttaaaaaacataccctggccaggtatggtggctcacacctgtaatcctagcattttgggaggctgaggtgggaggatcgtttgaacccaggaatttgagaccagcctgggcaacattaaaaaagaaaaaaatgagccaggagtggtggcacatgcctgtggttccagctactcaggaggctgaggtgggaggatcgcttgagtgtgggaggatcgcttgagtgtgggaggatcgcctgagtcaaggctggcagtgatccatgtgtgatcccacaaaagagtgagaccctgtctcaagaacaaaaagagtgccctattcaagaaattgtatttatgtgattcctgtttgtcttgcccatttatcacttgttttctaacaatatgttttgaagaatatcatatgcatactggtcaataggaagtgttttgaccagatataattttcatattaaaaacttcccagtggttctgattaaccatcctaactcctaaagaaattggaactgtaaatttcaaagtgaactggaattgaggcttgtaacttcatatttttggctccgttagagaaagcatctgtcttacagtcctcagaatccaagaatgcacttttataccaaaataacctgcttataacatcctaactgcataaaattaccttcacagtttttttttcttctgtatctttgttgttttcctgcattgactttcttattcatattctgaatcacattccttgatccttatatttttacactagcttttggtatatctttcatctcattgtggtcctatgttatattttatactggatggtagggtttctggtatacaggcctccagccctaggatcatgtttgttattcagagttctacattaaaaaaggaattcatttttataaatgaattcataaaaattaaaggcaggtgccaagtggtattctgtaagaggcatggcttcatggacttgtaaagggcaagaaagcaaatgagacactaagcttttaagtggtggttgctgaaattaggtccaggagtttctcctgagctttaggtttgaaagcccaaaacacacaaaacccacagtgtttaactggttgcttgtcagtctcccccaccaaactatgagctctttgagggcaagtggtagggaaaggcatcctgagtcatttccctttgtatgtctagtgcacagtgacgtagtaggcatttgggaaagaatgtgtaagtttgactttagaacagtgtctcttaaatttgcagttagggacgggattgcctcctcttttgaaattgagaaaatcatgagaatattagattgtttcccaagaagaataaacataaacataaatttttatgtactttcttggtctgcacattttccggtgtccctcacttagaaaagtcagtttggctgctgctataggtccaccatgatacagactgtgttactccgtttgcgcactgctataaagaaatacctgaggcagggtaatttataaagaaaagaggtttaattggcctcatggttctgcaaggctgtacaggaagcatggcatcagcatctgcttggcttctggtgagtcctcagggagattttactcatggcagaaggtaaagtggaagcaggcacatcatatggtgagagagggagcaagagaaacaagggggaggtcccagactcttttaaacagccagatctcatgtgaactaactgagcaagaactcacttatcaccaaggggatggtgctaaactgtccatgagaaatcttcccccatgatctaatcacctcccactagaccccacctccaacatttggaatcacatttcagcatgaaatttggagggaacagacatccaaaccatattattccacccctgcccccaccaaatctcgtgtctttctcacatttcaaaatacaatcatgctttctcaacagtgtcccaaagttttaactaataccagtattaattcaaaagttcaaagtccaaaatctcatctggagatgagttccttccatttatgagcctgtgagatcaaaaacaagctatttactccaagatgcagttgtggtacaggcattggttttaccttcccatttcaaaagggaaaaatcagccaaaagaaaggagtggtagaccacacaagtctgaaacccaacaggacagtcattagagttccaaaacaatcttctttgactgcatattctgcatctagggcacactgatacaaagggcgatgtcccaagaccttgggcagctccgcctctgtggctttataaggtaggtgcagcccctgtggctactcttaggttgtagttgagtgattgaggctttctaggcttaggatgcaaactgccagtggctctactgttctaggatctagaaaacaatggcccccttcccacagctccactaagcagtgccctagtggggggactttgtgggtgctccaaccctacaattccccttggcactgccctagtggagtttcactatgggggctctgcccctaggcgggcttctcttgtggcaccaagcctttctgatatttcctttgaaatctaggggaaaactgccaagcctcctccacacttgaattctgagtatctgcaaatttaataccacataggaactaccaaggcttacggcttgcaccctccagagctgtggcccaagctgttcctgggcccctttgagcagaggctggagccagagcagccaggatgcagggagcagtctcctgaagctgagcaggacagctgcaccctgggcctagcccttgaaagcattctttccgcctaggctgctgggcctgtgatgggaggggctatcccaaagatctctgaaatgccttcgaggcctttttctcattgccttatctattagcactcagctctcttttagtcatgctaatctctctagaaagtgattgcaccacagcccacttgttttccttctctaccacaggtccaggctgcacattttccagactttaccctctgctttgcttttaattataagttccaacttcaggtcattcctttgctcctgctaatagtaggctgttgaatcagccatgcctgttcttgaatgttttgctgctgagaaccgtcttgtgctagataccctaggtcattactcttaagttcaaacttccacagatccctcaggcatggacacaatacagccaagttctttgctaaggcctaacaagggtgacccttgttccagttcccagtaagtttctcatttccatctgataacttgtcagcttggacttcagtgtttatatctctatcagcattttggtcagaaccgtttaaccagtctttaagaagtttccagactttccctcatttccctgtcttcttctaagccctccaaactcttccagcctctgcctgttacccagctacaaagccgcttccactttttaaggtatctttatagcagtgccccacacctcagtaccaattttctgtgtgtgttcatttttgtgttgttataaagaaatacttgagactgggtaatttataaagaaaagagatttaatgggctcacaattctgcgggctatgcaggtagcatggcactggcatctgcctggcttctagggatgtctcagagtgcttttactcatggcagaaggtgaagcaggagcaggcacgttacatgatgagagtgagagtgagagaaggaggagttcccagactcttaaccagatctggcatgaactactgagcaagaactctcttattaccaaggggatgatgctgaaccattcatgaaggattcgcccccatgatccaattaccccactagaccccacctccaacatttgtaatcacatttcaacgtgagatttggaagggataaacatccttactatatcacagacatacatacatgtacatgtaatataaacacatacagacacacatatacatatgatatatacacaaatacaaaatttctagtacagaatttgataagactgtagtatgtgctgtgtgttagctgtgattgtcggttaaatctacatccaacattccagtaaattccccccactttattcctaaattgggacataattttattagtgcctgcaattgggatgctacattttcttgtaaaatattaaggtcttaatataagtgacattttatttcattgtatgttcttttcaaatataaagacagtacttctgagctgttatctactcatagatcaaatatagacttttatttctccaaacaatgatggagtcagaccccaaaagcatgtaattctgaggctacttttgatgtgttttggttatattttctctttgtgaagttaactgggccataagatcatcaattccatgcatgaccttggcctcattgccactacactacaattaactgagccaattaggcagaagagttctcattatattttcttataagttattcctagtaatttgatatcattatttatatttttaaaactaggaccagtaatttctttgccagttccaccagcttagctatatctcatactttactttctccctccttacagtagaagcctcctcctgcatctgtattagacaaacattgcagccctgaattgcatggcctctggccccttcgaaggcttacctgtggtattacccttcatctcctgtatcatcagtgttgtcttctccacttgatcattgtcattaagtcacttgtcttaatgtctgtcacctacttttaaaaaaaaaaatgcaaataaaacccatttgaactcatcttcactgatttatttctgcccactggatcacactcttggaaaaagttagctatgcttactgttgccacttgctcattcccactgtccgttcagctcttttctaatcagactttcttccacaccgttgcactggaatattccttacaaggtcatcagcctctatctagtgaaagaaagtgttccattctctggtctgtcactcatccttttaacatcatttgtcatggtcagccacatcacctttttaaaacctcttttcgtctctgggcttctgtggtactacctgaacatgttttgttttgttccccactcccctgccttccttgcctccctcactggctgtttcttcttaggtgccttgggctcctcttgccctatttgaacatcagtgttgggtgctccaacgctgtagcctcagcctagctcccttcttgtctactttaactttctgagagctctcattgggcttgtggctccagaatcatctgtatattgatgactctggctcagacttctccttgagttctcaatatggatagccagctgtctactagacacctatacttgttttgtttaaatctatgaaacagaaccattaactcctccctcccctttcctcctaattcttcaattctcaaaattgcctgtcttggaatatgactaccatccacccacttaagtgcttgaagacccctccccctcgcaaaaaaaaacaaaaacaaaaacattctttccctttcatcctacatccagtccttaagtacgttgtctgatctccttccaaaatacctggcaaatccacttatccccttctgcctccacttctaaaacccaaatacaagcaccatcatctatactttataagcagcaacctcccaactggtctttttccttcaatcttgctctcttcaatttccttcagatagcaatttatgtgatttttctaaaatgcaggttagttaccactactctgctttaattgttttcattgcactttaaggtgagaatgccattctcctctccctagcccccatgttcttacctttggccactttttccattttgaccctctcttctttcctccagggtcactgggttttactacagtggctttgcttctggctagtaaatcttctaatcttgttttgatctctgggcctttgtatttgcttttgctgctgggaatgttctgctcgaaagtcttctcacccttgacccctggaagttcagacagaagccaaatgttagctccttaaaaaggctaatgtagcccactaagagagttctattggcccttttttattgtcttcattgtacttgtctgtagttattttaattgtctactgtctacctccaggatagtataaacttattgaatgttcttgttcacactgactcctcagcatgtagaacagtccctagaagtagtaaatattcagtaaatatgtattgggaaacagactattgttacaaaactgttcgttttattatatttagattgtgtaagtttattaatagaaattaattgtccccaaaattgaattaataactatagtgttcagtcagtttataatttgtgttccacttatttaacttaagagttgccctgtttatgatttatgaactgtgtataccttctcttttggttcttcaaaacaaccttgtaagtttggccaactgatattagtgccctcccttgacccccaaagagttaagtgacttgcacaagatttcagtaggtgaaccggaacctaggtcttctacttcctataccagatagttttattggtatagtgtcctaggtgtgtgcttttgtgtgtgttagtagtttagaggaattataatagcatttaagacctttacttcccatatactctccaagatacgttttaaagctatctttagctctgtggctgttcttttcagtggtaacataaaatattggtccctgttataaccaatatgttaagatttggccaattattttttagtggtgataattatcaggtgttacaggtatgtcatatgtatgcaattaatggtagtctttatacagtgtgagttaggctcatataaccactatctccatttttttttctttttgctggtaagagcattcaaacacaagacaagacaaacctacgcatagactaatctcatccttattactgcagtccattgctgccttgctttctattgactctgtcttaaagattagagctctttggaagctttcaactgataagtcttttttttttctttttttttttcaactgagaaatctaaaatactttccgtattgcccagtatggaccctgttatagttgcaagtgagatcattttctgaaatctttgaatcttgttgaatccttcaatgaagtaaataattactttaaagctatatgttcatttctcattatttattctaatgtatttatattccctcttctactctttgcctgcctgagcagtgagattaatagttaaagcacttaaagctgagagccttaacagtaatctactgttttcctgtcttcctcctttgatgttctcttggaataggctcttgccaaaaaaacaaattgaagttaggtttaatatgagaagtcaaaaatgatgttatcctggttatctctgccttcttctctagcattctttttctttctttctttcttttttttcggaaacagagtcttgctctatcccccaggctggagttcagtggtgtgatcttggctcactgcaacctcagcctcctgggttcaagtgattctcatgcctcagcctcctgagtagctgggattacaggaacccaccaccatacccggttaatttttgtgtttctagtagaaatgagattttaccatgttgggcaggctggtcttgaactcccgacctcaggtgatctgcctgcctcggcctcccaacctcaggtgatctgcctgccttggcctcccaaagtgttgggattataggcatgagccactgtgcctggcttctctagcattcttaaacagacaaggaaaaatatcatttgtcactgctgtctgtactgttacattcccacaataatgtacatgtgtacacactttgcattaactaattgggatatatctgggtttgacaggatcaacaaggttaaagacttacttggtagggtgaaggaatggcaaaatggatgttcatccaactagctctgtcttaacctcctcatatctttctaattccatactccagacaataaatgttacatcctacagtatacctcctacagtataccttttaccttaagtgacaataggtacattcaatagcaccacctattacttctaagaaagatcatcctaagtttcctgttatatcaatcgaagtataacagagacattttagtagagaagcttttagagtttgtgatagattaacttttcactgttactcagcaaatgagagtaaaaaatcagactttcacagttgtccagggtgcaataactaaaccaaatctgtatctatatctatataactgaaccaaatatatatatatgtgtatatgtgtgtgtatatatacatatatatacgtatatacatatatacacatatacacacatatatacatatatacatacatatacatatatacatacatacatatatacatatacacgtgtatatacatatatacgtgtatatacgtatatatatacgtatgtatatatgtgtgtgtgtgtgtgtgtgtgtgtgtatgtatctttatatataaacttcccagttttgtgggggcaatatcctcaggtcagggaaatgtttaactccaatatgaaaaccatcagactgtcacaacagttctgattgctaacatctacaagatggtataagatagtacgatcagaaataagcagttctggccaggcatggtggctcacatttgtaatcccagcactttgggaggctgaggcaggtgcatcaccttaggtcaggagttcaagaccagcctgaccaacatggtgaaaccctgtcactactaaagatacaaaaattagccgggtgtggtggcatgcacctatagtcccagctactcgagaaggtgaggtaggagaatcacttgaacctgggaggcagaggttgcagtgagccgagattgtgccactgcacgccagcctgggtgacagagcaagactctgtctcaaaaaaacaagcaaaataaaaaacaaaaaacaaaactaagcagttgggaaagtgaaaattcttagtgcagtcctaactgatctacttaaagtgttcttttaaagacctgcacatgtttttcagtgatttaaattctgtacacttaaagcatgaaagtaaacattttggtagggtctagagtgatgagttgaggtattttgaataaaactatatattttcatttgtaagaagtaaaactgttcactgaaatttgtttctttttattaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcacgtaagtaaatggggggaaaaaagacatgtctgatgctagttcagctaattcatttagttaatgcacaataataatagctggccagcatttattgatgtttgctatgtgctaggcactgttctaagtaccttaaatatattatctcagataactttcacagtaaccctatgaattagattgtgttacctcccttttacaatgaggcacagaggttaaataacctatccatatatgcttactatgtgtctggcacagacctatgccatgtatatgacatggtctttgctatcacagtttttaagtttttttagaacactatactgtgaaacaatttcagtttttagtttttggtttcttttggaaaatgtcattatgaaagcaaaattctgttctcttcccaaattcattacttgtcaagttcttaaagtgttttgctatgtacaccatttggataatttccttgccattatggaaaatgtccttgccattatactataggttgaacatccctaatatgaaaatccgaaatactttgaaattcaaaatttttgagtgccgacatgatgccacaagtggaaaaattccacacataagtacttaccacaaattttgtctcatatacaagattattttttaaatattgtataaaattacttttaggctatgtgtataaggtgtatatgaaacataaattgatgtttggacttgggtcccatccccaagatatctgattttatatatatgcacatattcccaaatctgaaaaaattaaaacatttttggccccaagcatttcagaaaagggatactcaacctgtacagagtatcctaaccaatagagaaatacattatagcgtggtagatttgctttaacttgtggctacaaatgtttttttctcctgtctttccctttctcttttaaatttctttatctgccttttaaaaaatttgtttaaaattaatagttctgctggtagattctgtaactggtaggaaatctagcatgcattttggttactatatttaagtagctgtaatataaaacaaaccagtagtattttatgtatcaaaaggctgattcaccaaaatatttttgtgaaagcttcattcctataccctttcgagttgtgaagagatacttgctaactctaaaagttgggtaaggtaattatgttagtctgtttgcattgctgtataagaatacctgagactggctaacttataagaaaaggttctgcaggctgtacaggaaacgtggtgccagcatctgcttctggtgagggcctcagaaagcttatagtcatggcagaaggcgaagcaggagcaggcagaacacatggagagagagggagcaagaggtggccttgaggggccaggatttttcaaggacctgctcttgtgtgaagtagtcaccatggggagggcaccaagccattcatgagggttccacccccatgatccaaacacctccccttaggccctgctttcaacactagggatcatatttcagcatgagatttggagggggaaaagcatccaaactctatcaataattatgtaattatttataagatgtacctaggctcacgtaagactgtattctttctctttaaagaaatttggacacagcataaatcagtttttctgagattggtatagattaaggtttcttagaagcagcacgactgacatattgagcggcaaaattatttgtcacaatattcattctgcaccccacccccagtgaggcaaccaaaaacgtctccagattttgctgtgtgtcccatagggggcaaagttgcctctggttgaaaatcactatagataaggagaggcttagacaatattcttgtcactgttgagctaaattattttttaaacttttatttatttttgctaaataagtagtacctattttactgtttaaaaaaaataatgggggtgggggaagacagtccaaaggaaataatattcactggaaatcccatttcttagagattcctgctatacccttttatgtatatatcctttaagattttaaatatgtatccgtggtctatgtgtctatgagcactaatatatgtaaaggtatgatggtgcatagatacatgtgtttatctgaaaaggggagtcatatcatcttcagcaacatacagctgaatttttgtcagttttccacctgtctagctgtcactatcaaatattgggtattggttttctagaattgagttagcagattaataaaagctttttactttgaacattttagttttcttagaaaacaaaagaaaaaatactttcaagaagtggagtttattaccagcaaggtccaggacaaatctttttggaattcaaactgcttcctttgtaagatgtagtgacaggtcctttcctaaatttgttaaaggagatacaggtattaaaatccaactgagaagataatctagagctgtcggtgttctaaggcccttttaaaagagtcagagttcactagaagttcttaatgaaacatataaagatttttttgctccatggtgaaaagttatttagtatttgcattttttattttttatttttattatatatataaaataaaatatgtatattgagacagatatatatataaaatatatagagagagactatatatatattgagacagagtctcactgtgtcgcccaggctggagtgcagtggcactatctcggctcactgcaacctccatctccaaggttcaagcgattctgctgcctcagcctcctgagtagctgggactataggcatgtgccaccatgcctggctaatttttgtatttttagtagacacggggtttcaccatgttggccaggctggtctcaaacccctgacctcaggttatctgcccgcctcggcctcccaaagtgctcagattacaggcatgagccaccgtgcccagccttgcattttttaaaatcattattagtacactacatgtatctttttgtctcgttacatctcaacactgaggtgtggtaacttgcttaaaaggaatctatttgtaaatctacagtcatagaaatctaaatgatcaaaatgtcttcctaatattacttgatgtgaaaatatatgctatagcccaaaccataaataaatctatagttactggtatctgcacttaacaggagttctcaaactttttggtctcgagacctctttaaactcttcaagtattgaggactccaaagagcttttgattatgtgaattattcctataaatatttagtatattctaaataaaaatggaaaaatttttgaatattaatgtgttctcaccacaaaagtaactatatgaggtgatggatatgttaactgattgtggcaatcttttcacagcatatacatatatcaaaatattttgctgtatatcctaactatatgcagttttatcaatcatactgcagtaaagctggacaaaatatttatcagtgcatttttaaataataatctattgtatattcacatagatagcattttgatgaaaaatgttccctcaataatgaatttttaaatgaaataatgtaaagagtggtgtcatatctctttaatgcccagctttattgaagatagctcggttctcctgtctgcttctgtatttattatgtcacattatcacatgcagtgtaatctttggaaaattatgttacacattaatgaaatatgagaccaataattatgtcttcaaattatgaaaataggaatccctctcaggtttcacgacagcactttgagaactacttctctgtactgttaatgtacaaacttggtacatcacccaatgaatagctcaactaggaggttttaaaatggaatatttgccttgtggtagagagtattgactgaatttagattgtgcatgtctctcagttgaatatatttacaagagaatacctttgataatacaggtttttattattatatttgagcttggactttactgaaaacattgttaaaattctttatatatttatacatatatataactgtaagctgtagtcattttgtaactttgatcctttttcccctataacttctctaaaaatttgtaatcattgtcagtaggtaggaaaggatttatattttgtactatttcaagattattttggtcttatctgtatgatgtagagtagaactatatatgaaatgatatatgtcattaatttgcttcaagttctcttttgaaatattcagtagtttagtgatggatatccatgtcagattcagagctgaaaattgtataattgtccgtaattctttcccctccttaacctctgttgtgttggtctttaaacttttttggttatttactctatcaggaaaaaaatgagcacatacctccaaatgatgcatttattaattatatttataactatataatttgtatattttcagcatatagaaaaaatagaaattgaaagtaaaagataaagctgggcacagtggctcatgcctgtaatcccagcactttgggaggctgaggtgggaggattgcttgaggccaggagttcgaggccaatctgggcaatgtggcgagatcccatctctacagaaaattttaaaatgagctgggcgtggtggcatgcgccttgtggtctaagctacttgggaggctgaggtaggaagattgcttgagcatgcagtgagccacattggcaccactgcactccagcctgagcaacaaagtgagactctgtctcaaaaaaaaaaaaaaattaaaatttaatgtttgctttcttcttgtagccataaaacattattgttaacctgatttaggtctaagtttaatttcagaagttggctttaatgtctcgcagctaaaagaaacacaacattatataaatccaagtgggaaaagtgtagttactaaatcatactcattttcatgatacctacccaccagttatgcaaaggtatttgttaaaatatgactggtaaattccattgtctgatgtcaatctgttgtttttatatgctgttataaagtattgcattttttgtgtaataaatgacatcaaaacccagtaaaatgcttcacttggataatatgttagctgtgtttccaagttggtgaaagtggtcagcatggtgttctatcatctgattctgagtccagagttgctctaattcagagttaatctcctgtcttctggctagagggaggaatggagcggggagagtcattcttacagccttgactgttaaacagaatgtaaatcataaaatcactttaactggttattgtacacaatgacacatggtgatttcttgagcttgaaaataattaaaatagaaattctggtatttgtgttggagggggttctgttggattatcctgcttgtacctcacagttgaatcctgctggtggttctcaggatattttttgtaactgttcacgtcaagtcttccatttcatccccaattgattttacttcattccctgtcttccctcccagattgctttttagtcagcaccctcacacctcagattttttcttcagtctgtactcaccatgctagaacacgctttagtcatttctagtgtcatttatttactcattcttttcttctgaataatcctcctgctttgtctgtttgagagaaccaatggctttcagacatttcaattcaatttaaaaagaaataacttcacatagcaacccagaagcctgtattccttcatgcgaatttataagtaatcagcgtttcaggaaataatacttatccttactacatacatatcctttctattttgttttgttccatttttcagaatgctggtcatgagccactgaattgattttggactcacaactagattacagcccgaagtcaaaaagcactgttctgttattcttcaccattattgactatagagttttggctcattctctcccccctccccacctcccaccccacatccttttctgatctctattctgccatttgtactgattttaatctctccctggattttttttttcttagatggctggttctctaccaatatttggtagctcaaatgtcatgcatacctcaatggggccttctctgctcactgaacctcagttatccctcttttttcatttaatagcacatcactatgtttttcttcatggcacttgtcgatatgtgaaattaattatttgtgtattattatctgaattctttatataccgtccccagtctgagtatggattccatgaggagagagagcttgtgtgtcttactcactactgtatttctagcccctaaaatagtgtctggcacctagcctgtgctcaaatggttggaataacaagtagcagtttgcttaacttttcatgttataaaagccaagttttaatcacatttcagtaaaaatgacatagtaaataagcatgattcatgggtttcacgtaatactaacttctcatgtatatcttgtctatcatatgtaataattaatatggttagctcttggttgagtgcgaagaaagccttagccactgctgtacctactttaccagtatcctcacatttaatcctcacaataactctggaatagctggtggtatcataatttgacgatgaagaaaccaagtctcaaaaattaagtaacttgccttaggactgatatttcatctccttcagtgtccttactcttaactagtaccctacctagactgcctccctctactgagattaagaattacagaagcagggaacttgaaagtgacatagagttcttatggaatactttgaatttaataaagtatttattgctataagtaaaattgataaacataattaacacaaaaatatgatttagacgtactatatgtatgttgtcatcaattcagaatctttttgataagcattttctttctttccaaatagtttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtaagtaagtaaaaagagcagtacatctgacactaaacataaaattactgtaatcttgtttataagtttagtatatcatgctttttattttaggtgatcttcttccagctgacggcatacttattcaaggcaacgatcttaaaattgatgaaagctcattgactggtgaatcagatcatgttaaaaagtctttagataaggatcccttacttctatcaggtaaaaatttcatttatatctttgaacactttcctctttcgcaactatgtaccattgtcagcaaacaccattttcctaagagtcaataatataaagaggaatctgtattttatgctaccttctactgttgtaatccttgcagactttttttggtaagctgacaaaaacattagaaaactttgaatgcagagctatattttacaaatgagggaccagagtccaaaaaatcaagagatttgagattcagcattcatgctagtgtaatgataaaactgaaatataggcctaatgatatctcttgagttggtctgttattctgtatcatgactatttttaatgcctattgaagtataaaattaaagaatgaatatatgtttaaagcaaattaatgaattctctgtgatgctctacaaaggacaggttgttttttcttaagaactggtaaaatccttaaagtttacctaatccaactcctttaactgctgaagaatgagtttgagatataaactatttagtattatatgattaaccaagagtaggtctagcagtcacacctccatctagtcagaattgaatttgcaaatggttaagatatgttctgggattggagaagggaaggataggtgaggatactgtttgaaatggagggtgacagcttgggaggctcttgtagtaacctcattgtgatagcttgaactaagttgaactaagtaaatatgaaatggaaggggtggtgggaaaaattacaagttcgcttccaaaacactgaatgagagaaagctatagtatcacaaattgacccccaagtcatattaattattctaacttttaggttctggggttcctattcttattttcccagtattctatatggaatttatgaaattgtctatcagaactgtacttgtcagattgaatttatactagagttttgggaaagccaaatgtagccttctacatgtagtcttctgtcattgtcaggtgttgatagattgccaacattttatacattgtcagatgattgctgctgaaaccagagtcaaacctgtgatatccacaagggtcagttaagttagaatcacaactttagagcaaaacctaagtttaaccataactttttaagatttataaatgcatgccaaaagaagcttattgcaaagaaccagacacatttatattggccagaaaatcctattgcaaaaaaatcagagtaattacatttataaacaccattataaataggataaaagttccaattctaatatagacttaacgtttcatcaaaaaaaaaaaaaatcttgagatgtgtataccttcagtatcctgtgccacttagaacattaggagatatacgtaatgctaaatgacgagttaatgggtgcagcacaccaacatggcacatgtatacatatgtaacaaacctacacattgtgcacatgtaccctaaaacttaaaatataataataataaaatttaaaaaaaagaaaaaagaacattcacaccctgtttggatttttctttgtattggtgtggttgtcatttataccaaatagccagaaagagcttggatatataaatataatgtatttaagtataatgtgttaactcattctacttaccttgccatgcttctaaggaactgtagttaatgttaaccaaataaaatctataacctttccaaaggagagggaagctatctaatcataccttaccatcacagattaaccagaccacaatgtgtaacaaactaagatagtctcctgtttgctatgtatactgcatggacttttatgtacatctcacttatttacatagtgcttagctcttcaggttgatttcctttaactgaactttggtcctttctgttttaacagagatgactggtaagctttatgtagactcaggttcctaacacaccaagtataccaggagaactctataaattttccacatttaagaaaagactgaaataactttgtagagtcccttatcgcagtatgggtgggaaagtttttctgcatttatttccctattccaaaaatgtactaaaaaacatgacatgcatttatttttaaatttactctcatgatgccatctctgactgctgttcttggcttcttaagtttagatttttaaaagcagtattcagttagtggtggggatatgaccaagacttaaaactgtttactttgcctgagcacattcactgccaacatctgattacctgtggtaaggcaaaatagaacctaaacaattggagtctggagaaaaccagaattgttaaaagaaataaattatctactttttcactatcttgaattatatttcttgttttccctgcactttcactggcaaagaagctaataactagtgaaataatcaatatggatttttaaaagcaaggaagcaaaggcctaaaaaacaatattggataagttactcagtaattaatagccaaatatggattcttaaatacttgagtaagtacatatattttatgagcgtacttagcaaataatccttgagcatcaacttggttcataagattatggtagatgctatgttcactgtgctccagaagattgtaaacaaggaaataaaatacaaatcaatgataacgtgtaaaaaaaaaaaagttgctttaaagcctgcttaaaactaacaaaaagattagacggattagaagccttttagtgaataagaaaagatatagagatgtggatgtacaagtcggagaaccgtaagcagacttatcagcattataactgaagaagaatatactctttatcctctgacagagctggactgaatctttgccttgacatttaatagttgtataaccttcaggccgagcacggtgactcgcacctgtaattccagcactttgggggctaagacgggagacaattatggagaccagcctgggcaacacatactctgtctctacaaaaaaaaaaaaaaagttgtataaccttgggcaagtttctagaaaatgagaatagtaatgcctgccaacttgcaaaattgttttgcgggacatagaatttaatccatgttcccatctctgattcctagttttctgtaatgaaattttatgttagagtagtggatgagtaagtttgtaagattgggtcggtctcaaggtgaggactttggactcaatccagtaggcaacgaagaatcagaaatttttgagccatgagaagtatatgatgaaatcacaattttaggaagattaaaatggatttcaggatgaactgggaagacacagagactaggtagggggctattgcagttacaaaggcgtgctggaatgaaagcttgtgttaggtagaggttatgaggttgggtgtgggaaatgtgacattggttgtcattgatacatacgttgtttctttataagcagtgtttttctcagagaagtgtccctcataccttaggttacaattaatgagcattcattgaacccctacaaattctaggcagtatgctaagcactttacatttataggtttatatgagaaatgtaaatctcatatttctatgaagtgtacagacagggaactgagttgttaaaatttacctaatattacatggtaagtgagtagtagattgagctttgaacttggatatgactgattagagttaaaaccttaagcacaagaaataagttttatttaatgtcttgctaaatgtattttattgatcaagacatggtggctcacatctgtaatcccagcactttgggtggccaagacaggaggattgcttgagcccaggagtttgagaccagcctgagcaatatagtgagaccctgtctctacaaaatttttttaaaaaaattagcagagtgtagtggcgtgtatctgtggtcccagctactcgggagggttacttcagcccaggagatccaggctgtagtaagccatgttcacaccattgcactccagcctgggtgacagaccaagaccctgacttaaaaatatatatatatatttatatatatatttatatatttatatttatatatattttttcctaaatgttgaggctgttaaaaacaatattactgaagtttgaaatttggtggtagcaaggagatctatcagtatttttaaaaacaaactatgtttttggttataggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaagtaagaataacaattttctataattggtatttggaaatagggcaaataatttgtaagaactagtaccttctttcaagagattctggtatgaaaaattctacaaaaagttaaaagaagatttttctattagacttaatagcatgggcctttagagaatacatcagtcccctttaccatggccagagaaattcagcatctacttgaatacttccattggcattcttgcatttattctctaggtgtagaatctcccatcatctgatcagcaaaatgaattgaactctcacggcggattttttctgctactttagcagtggctttctttatcagccatattatattttggtttcactgagctttcttttaatcttcttcacatttctattctactatacttaatgtgcttggtttttgaacacaagactaggacttcactttgacaccttacatttctcttgttatattcagcccatcattagatatcaaaatctttttaaaatgttgatccattgtatctactgtccctccaagtgttctgttatcagaaaacttgataatcatacataccatttatctgcaaggatcttacaagaaactgttatacacaagagacatctcagaatctcctagttaggggcatgccacttttaaaaagccctccccaccctgcttctaagtgtctgctataccacccttccttcacactcaggattacccctctggagtcttttccctttaggttgacaacattttacggtggtttagccacttagatttatttgatgttatttaggatagtaaacccatattgttgtttctcacatgaatattttgaaacattctaaaataactgcctggctaaaatcctggtttgctataactacagcagtgtttttaatatttgagtggtttgttttgttctttgagttttgctgttagctataaaatctctatttcgaaacaaaaatgtatgtgaaaaattctggacgcagatccaggtggcaagccccccattctaggttttttttctatgtcctccttgaagcagttctcaatgtgcttccatacgtttcttaaggctgagtagaacgcagtttgaaaaccagcacagtaatgattccatttattgaatgttttacatgcactatctcattaatcctcacaactgtacaaagtaaagacttattatttttttactgataagtaaactgaggcttacggagattatataatttgctctagatcaaagtgctagtaagtgacaggtcacaccctcttctctggctcaagagtctacccttttatgctgtgctccatcctaatccacaagagttgaaagtcattgaacgctgaagggaagtttgcatcctcactgtattccacagtgtcttttccagtaagcttcttttccccctgagtcttatacactggttttattaatctagtctagaacattccccagaaattaacatctaatttgttgactccctttttttgttgttgatgttttttttttaaagaacagggcaacattttttcttctgtgggcctccagcccttctcccattcccttgactgccttagcgattactcagaagcagtccggggtaatgtgtctcagttccctcagtggcctggactgtggccgtctggtctctccaaacttgagctcattaaaagtagctaggtattatcttactatctcctcatcaatcttgagcttctattccttcttgaccatgtttgttccatgttttccgtttgaagatagttctcctcgataaagaagctagaagaatataggatgaatggttctcctgctctttggcatttttaatattgtagtgcctactccagacaataggcctgtcccttcattactttattgcttcagatatgctcatccttctgtgttttccaaatataagctgatttggagagctgccttacctggtagtcttactggcttattctatacattcgtattctagttttactaagttacctctcctatcttttgtacatattttgtcctcactctcatcaacactctcctgtgtgccagttgtctttttttttttttttttttttgagacggagtctcactctatcccccaggctggagtgcaatggcgtgatcttggctcactgcaacctccgccttccgggttcaagcaactctcccgcctcaacctcctgactagctgggactacaggtgcatgccaccacacccggctaattttttatttttagtagagacagggtttcaccatgttggccaggctggtcttgaactcccgacctcagatgatccacccaccttggcctcccaaagtgctgggattacaggcatgagccaccacacccgactgcccgttgtcgttttataacatcccttcctcctccctctctacccctgctcttcctcctccctctccacctctgcccttttctgctttcttggggttatatttgtatttagttttaaaactttttgtatcatatttaggtttattacagcttataaaataatgaagtcctatggaaaaataaaacaaatatagacaccctaaattattttgcggtattctcccgtaggtaagacttagggagtgattgacccagcaggtcatcacaagtcaaatgttttctaatctgtagacacacacaccattgtgtaacaactgttatagaaatgtgaactacttctgcataatttagcatggctgtattcatttcttttggaaagctttaattcccattttgttcctacagataagaaacaagatggagctattgagaatcgcaacaaaggtaaatttaggaggacaaaagtacagtgagcttgttttcattatatccaaaaatctactgtataccatatttattcaaaagtaagatacatgtggcagggaaaatcaacaatatacgttagcttgggttaacctttcttcctgccggtgtcttagtcatgtcgtcactgcaatgttaataagattttaagtatgatttgtggtacaggttgagtatcccttatccgaaatgcttgggaccagaagtgtttcagatttcagattttttttttttttttttttggattttggaatatttgcatgtacataatgagatatcttggggaagagacccaactccaaacacgaaatttatttatacattgccatatacaccttctacacattgcctgatggtaattttgtacaatatttttaataattttgtgcatgaaacagttttgactattccgcatcacaggagatcaggtgtggaattttccacttgtgtcatgtcagtgctcaaaaagtttcagattttgaggtattttagattttcggattagggtaaatttatgtagattgactcaacttaagtatttcaagtatttgaacgctggttattatatagttagtagcaaaaatgcataagaaacaaaatatatagcataaatgttactgcatttatttaagagtcatatatgcatatttctatatgcatatggttatacataatctctacattatggtcataaattataggggagggattatgttgtttagatattacctaacataacacacaggaaaagaaatttagtattctttagttctcagtttaaggaccctgtatgcctcatcctcattacctagcacaacattttcaaatatggtacaaagtttcacaacctaacgtcactattgtcttattttctctgtgtagacacacacacacactcacaaagctgaatgcttatacctttactggtttctgtaagaaactgatttttaaaatttctttaaaatgttaatagtgatatgtgcctttaaagtatagtgaagttctatttgctcttaaatgtagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtatgatatagagaagaaaataaagtgttttatttttaagtatgctttctgcttaaaaattgtcttttgacacacttaaggctggaaattgttgctttgtgaatagaaggggagtttgaaatattttcagttctagctacaatgcaccaggccctttgagttactataggtacttataatttgctaataagtggtcgggttaggattagtgcctaagtctgtccagttacaagcctgtgcactcatctctgaatttctgcattaagtggagaaaaggcaacctgtgaggttatttagtaaagatgaactaattatattttaataaaatttcatcacacattttgctcatctttttactggttatgggaatttttagttatgtctctaatgttaaagttctgcactgaatggagtcgttgtagtgcggctgaagtttctatattactgccatcactagaaaatacctgttaatacagccattctttaagggaaaaagcagagctctgaggttagaaacagcatgacctccagcggtagcatctttttggaagaacactgtgtggataaataagcatatattattaaaattgcttaaattgcatcattttactgctctctaggagtatgatggaaaaagtgacgtttttgcttctgtcctcagtacacttattatctaatagcaaatatttgctctttgtaatatgtagccaagtggtaatgctgactcatgtagtgttgggggaaaaggtggatttgaggtggtaaatccacttagtagacattagattgggatgttagaaccagatatgtggacttacacctttttttttctttttttcttttcttttcttttttttttttttttttgagacagggtctcactctgtcagccaggctggaatacagtggcatgatcacagctcactgaaccctccacatcccaaggctcaggttatcctcctgcctccacccccgaagtagctgggactacagatgcacaccactacacccggctgatttttgtatttttagtagagacggggtttcaccgtgttggccaggctggtctcaaatgcctaggctcaagtgatcctcccaccttagcttcccaaagtgctgggattacaggcgtgagccactgcgcccagctgcctctatttttgggggcggggggtgttgagggtgggagacagagtcttgctctgtcacccaggctggagtgcagtggtgcgatctcggctcactgcaacctctgcctcctgggttcaggcgattctcctgcctcagcctgagtagctggtattacaggcacgcaccaccatgcccagctaatttttgtatttttggtagagatggggtttcaccatgttcggctggtctcgaattcctgacctcaggtgatccacccacctcgacttcccaaagtgctggggattacaggcgtgagccactgcgccaagccagctgccctattttttaatacatatgtcaaagagcagagtatcccacaagatacatggttaactcttggtttactaagttaatgaaacagtaaggatagagcaaaaaaattgaagaaataatactttgtgttatataattttatttattataatgttatttttttaaaacatgggttgagtatttaattcgaggtctccccattgatgagatttttaccagtttctctttaagcatcagggagcttgcctcttgaacatataaagcaccagtttattctaagctttggatacttccttatcattgcgtattattttgtcttagtttcagtacaaggccaaagatataattaagtctaagaaagaatcctaagtgtttttctcccagttctcctggggacaagactgtacttggaagcaaaaaattaaatctgacaatgtcaagttataaggtgcaagaaagaagtaatttctcagagaaattcaatactatcaagcaagttataactctttacagtgtttaatttatatctggcaagggttagtgtctggaaatttaataatcacatttttctttcatttctattctgaaaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaagtaagtagaaaatagttcagtagacgttgttatgtttaaagccttagctggtatagaaaatgcccatctagttactccttttctgcttctgaaagtgaggactttcatataaatgtacactattttctctagaaatgttgtcattgatgccctgtacctcccaccagttgaatatctctgaaggagacctgtgcattccacatagggcagccttgacacaatactaagcacgactctgctgggcaaagttctagcataattttctctacgtgatagttatattgtcaagtcatgtcacctcctctttcccgtctgtaaaattaaggtgagcgtgttaggctaatgtttctaaaaattaaaaaaaaagttaaaaattatgatttccatgtgtaaaacctttcagtcagttctcatgacaattagagtaaaatgcaaactccttaccatggcctgcagggccctgccagtctggcctttgcttacctctcagtgctcaattcccttctcctttggcccagtctcaccagccttcctgatgattttcaaacatctcaactgtattcttacttcagagcccacttgttccttcctttgagtaacctgctctctttctttattcaggtctcttcaaatgtcaccttcctctgaccacttgatttacagtagctcagtccttcttgttttccaagtagaatgctaagaaatgagctttgatggctttgcttactgctgtttaccttaaagtaataatccttttgaagattattaatttatttttatcaattttctatcttacggaaaaggtggattggaaataaaaaaaaaaaagatgtagcttggacaattttgaactttttttttttcaaaatgatcttgcaggtaaaaaattataaccaaacaaagaatgctgcttttgtaaattttcaaatgttaattactagttctctttaagaaacactgctgacagtgagcaatattaattaattagtcatcgtttctacctttgcactcttcattattagacctgtcttgataagaattttttttgcttactgtttgagtttattttcttttcaggcatttaacaactttcatttcaaaaataaagtggtaaatgtatcaaagtgataagatacagtataatcatctatctgtcctttgttgatattttaaagtaatttgaaatatttggggtaaatacaagttttggacacatagaacagtcattttaccgaactgccattagttcattttgagtagtcattaatgatactaatttttcaattgattagaaagatactggtaggattgacttatgctttttgaatagaaaattaataagaacaagttaactacttttttaagcctttattagatgtttatctagctctgttaccaattactgttcttttcacagaggtatagtctttatggattctctgttagtgtttcacaaaactgaacatggtttctttactgcagaacttcatttttctaatctttaatatgtaaatcacaagtaatttaggaaatacacatccgtttttcacatattttttcaaggaaccagtttttttgcagtatcttgcaaattagtcatcacaaaaaacactttgtaaaataactccatatagtttttaacccattccacattaagtgctgagaactaattataaggtattttaacttaaatgccctgtgagactactgtgaaaactgttggttttttagaaatgattttttctgttgtaaatgagagaaagaagtgagatgcagtttgatgctaaggatgaaaatgccaagtctgccagcatatagaatagctaaaaaatgactcattctagttttgatatgttaactctatcagagttaataataaaaaaaaatcaagcaactacatacccacaagctctttattttagctgctaaaggctattttttccttggcactgatgtaagaatcttttgttttccacttaataaggaggcttaatcctttaatatactcttacactactataagtaccactgtacttaacagtacagattgtcattgctcttgcaatgtgaggacattttgcaaaaaccgttggagacatatattcagtattatttgtgtacggatgtaggtacctgaattgattcactaggttatgttatgcagcaataaaatgattgaaaccccagaaagctctggtactgtgtttagcttattttaataggtcaaatatgctaaaaaaaaaaaaatttcagtattacattggtactttatacattgtatttatagaaagctgggagttttctaattttaaaacaatttataatcattttaatgtaatgaggtgattggttttatatgcagcttaactagtttttttttttttggtcactgtagaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattggtaaggtttttgaaataatttatgaaaattaatttttaaatctataatgatcagactatatgtaagtcttcagaccaccattactgtatgtaaactgaactgttaagtttttaaaaggcatatatttatttatataatggtttttaaatttgtgttatgagtgaggtctgctgatcaacataaacattgtttgcttacatttttctcctatattttgaatttcctgtgttcagaaactctccagccttataaccagagcatgtatttaattttaaattcttgttaagctcatttttgagaaagatcaaactgtcttactataggaggtcagctctcaacttacagaaaatttttaagccgatttcaacttaaaataacatgttttatatatggttgccatgtgttctgtttggtttctcagtagttcctacctaaaaggtggtccttagacctttttagaactaatgcagtaaagtaattctagacttgtgccaccatataataaaaaattttcaacttacaagttttaaaaatcttatttataacagaaagaatgcgatgttatgtttgacttaatctcttctagtgatttatggatgaaaatcattaacaaaaataatattgcaagctgttcattagggaaaacatacatgaattggatgattacattggaaagttatgggatcttggttctagatctagctttgccttttactagctgaaagtctgagctaccttctttaattactgagtaaagatgatcacatctgcccttaataccattgtgataattatgtaaagtggtatttctgaaggcactatgaaggaattgaagcttctcactgcatttaagagaacagtattttaatgaatgtacttttaagccataaaaattggtagatttaattttgaatgatttagtataaaagttaagtgaaaacaggaaaaggaaattaaaattaagttccactctgtattaggaaccaactataaacttcatacatcttatatcacttaattttggggtcataagtgctcctattttacagatgctgaagccaaggaccaaagcagttgggtaattgtcaaatttcacgtagctagtaactggcaggactgagattagaatccatgtcattctcaccccaggctcctttctaccttacttttctatatccttctttaaaatgttgatattagacaattgctttgtaattttattttagaatatcgcagtctgttttacattataaattaaacgttcttagagaaacgagatactagctactaaatgtttttctcttatagccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtaagagtaaaatgcttggatgaataaattgctgactatagttgctttatggagtatctactgtgttgttattgttgttgtctttttgtgaacatcaggcatttgataggacctcagagttttttagcatattttatggtatccagatatttgcccctgctattctgccattttcacactctagcttctcttatttcttagcattttgttatagggaaaataagctcattacattcaatctggtatgtttaatgaagtatactttgatgtttatttttagaagtcgatttacttgttatttaatatgcagaatcttgaaaagcctcctgggaagaaaatcaagtttatgtctttctttctttctttttttttttttttttttatttgtttaaggtggagtttccctgtatcacccaggctggagtgcagtggcgcgatctcagctcacttcaccctccgcccctgggttcaagggattctcctgcctcagcctcccaagtaactgggattacaggcacctgccaccacgcctggctaatttttgtatttttagtagagtcagggtttcaccatgttggccaggctggtcttgaactcctgacctcaagtaatctgcctgtgtcggcctcccaaagtgctgggattacagacgtgagtcactgcacctggcctcaagtttagatcttcaacgctcattgtggttactggactctgaatgtgataagagaattatgaagtaatttttagaatagcaaagcataaaagctggatcttggaaattccccatttatatcaaaatgagatttatcatgtttatgctgctgcagtgtcgtatttaaatatctcctgtcattttgaatactaatttttcttactgtccttttacagatcagtagctttaattttgttattacatgttcacatataatttccctgatgtttatttgttattaaaggtggtgaaattattttagtttctttaatttcattaaagaagtagagaactggttaaaaaaaaatactggttaagagcaagttgggaaaattggaactcatttgaaattataatatttaaaatattaaagtaaatgtttaagatatacttttaatttgcttacatgtggattataagccagtattaatgaacactttacaattagtttaagagacaaatatataaataaataactgaaggcagcatataataaattggtacaaagtttttgggtgagagatcacactgtagggatgtggcatttaagatagattttggtatgaaatgagaacttcgaggtggggaaaccacagcagaggaaaggagatgagaatatgcaggtcatactggggaggggaatatctggttgtatagttcagctgaatagtgatgggcttttgtggcacacaggccatatacagctttcttcttgccacagtacactcagttacctgatttcattgaaaaggttagaaatctgtttcaaccctggcttgctgggtagtagatagatggtttaggagagaattttttttagtcaaaactgatcaggcattgactctttctctgcaactaactagcttctggatatggggcagatttttcccttacttccatttttctcatctgagaaagcaggtgatgaccaccaactctgtggcacttaaatgaagtaatgcataccaactgtctagtgtgaagcctggtggacagtaaacatacagcaagtgttcccacagtaatatttgcattttgttgtggagactttttaaatgttgggctgagcagttaaaattgaagtaagccagataatgcaaatgaggtatttttttcttcaagtagtagaatcatcaaagctgtgattaaagataattcttgcatcagggaacaaggtgggttagagggaaaaaaaaaatcaactagagacatatcagttaaaaggctattgctattacaatagctgtagctttgtagcttgaagtaagaaccagaagaaagtagtagcaggagaaataaaaaggagtggacacattgaggaggctgttcagaggagaaatgtataggacttaggagctaatagtagagagatgatcaggaaaaataagtattaaggtgaaattttagacttacatcaaaatgattagggtaatgttgatgcacattacatgggcagtgaagaggcagcttccagtctttcatccattaaggtttaggtactgataaaacatctgggtagaatttttcagcagtgatggaaagctttgaaaaacaaaacagaagatgtggatttgggaattacctccctagaagcaggaagagatggcatcatcaagggagaggagtatagagaggcattatgaaaaacaaactttaaataggtatatagtatgatttttattcattatgtaatgaaagaaaaggtagtagtgtcactgaaaataacttttggcattaactctcattctgatagaatgcttattttaacaataagttattttttttctttcatggttaaaacaatataggtgatgaaacaacatctcaggtaaggggttgactacgcttggctttttaccttaaaagaagaaaacatttgtgattttggtattatttcaaactaatgtctgattctgtaccaaaatggtgaagtatatagtttattctcctttgccacccagggattctttatgaaagtttgaaagcactgcatttccaaaagacaaggtttagagaagttctagagtaattgataaatggagaactgtcaaatgagaaccatacatattagttctgttttgtaaaagggagggtgaaaagtgaatttaagtctataaaaatgaattatatgtaattctctaaattccagatatcagatcccatgatttctaggcctgccagttcacttaaatggcattaaccattatttttttaaattattgatgtttggattcaacatttccttttaggtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtggtgaaacattctgtgttctgcatgtgcagaatctcataactatagaggacctaggccttaattgtaaccagttttctagtaaaattcttggtgtttgtgattttttttttttctgtgtgaacccaagataaatgaaataatagtacctacagtgcatatgctagcttttatggtttttaaagacagtgtctctttgggatcctatgtgttcatagcaccataacctagcacagtgccttgaagtgggtagaattttcagttattatttatcttaaattaaataataggtgccattatttgttttcacagtctctagactagcattgtctagtagagctttctgtgataataggaatgttctgtatattgtttagtacagtagccactagccatgtgtgaatactgacttctagttttcagtggctagtgcaactaaaagacaggatttttaaattttatttaattcaaattaaaatatcttgctagtagttgtcatattggatggcatgcagctctagactgatttccctctttaatttttttttgctatttggtttttcaccttttttaagtttgttgaacaactactgtgtgccaggcactatcctaaggtactagagacttaagagttttgagatctgatcaccggcctcaaagaagttactgtcttatgtgggacgaaccaaacacgtgattattgcaacccaagatattactaccttgctgggtatatacagagcatgttatatgagcagagaacacgagttcccaacctagcctaatagcatctttttattgagttctcactgtgtgccatatacttaagccatgtgttttacaagtaattttttaaatgtctacctttatgaggtatgcatattattactcttatttggcagatttttaagaatcaaaaatgtatagagcgttagacatgtttaaaaatacatttttaaaaaatcgagaatgtatagagcatagacctagtgtgttaaaataccagctttgtctaaaacacatgtgcttaaaagactactgtactgtattgaccactggaggggtcaggtaagacttcctagaggttaattacctgatctgattcttaaagaaggaggaagtattatctaaaccaagaaagagagcgagcagttaggtatattctgagcaaagaagcaacataaataaaagcactaacagaaaaccacttttgttcagtgactttatcagctaattgattcaaaacctaatgtgtagcactcttttaggagctggaaatactgcagtgaccagaataggcttgagatttatattctagaggaagaagacagctaagtaggtagaatgatagatacatggacaccatgtcaagtgaaaaatgaattctgggaggaataagacttggtccctgttctcataggccttaagatattctgggtggcagggtggcatatcaggggggatgatattaaataagacaattacaagtgcagaagggctatataagatatgcacggtgtaatgaaataaagtaatggagagagactgcattaagaatttctgaggatgtggcatttgagttgcaatctgatggttcatagtgggtctgccatgtaaatagctgcaagaagagcattccaagcaaaacgagaaatgcaagtgaaagtgagaaaagtagctattttaaaggtggaaaagaggccagtgtggctataaatgtaaagaagaaaggggagacgagatgatctctggccttactgggctgtgaggactctgaattttctgaaattcaggctgggaagtgacatgatttatgttgttaaaatactattttgggtacgtgtaagacagggattagagatgaagaagagtagaagcagggaagctaatgagattattgcagtgatcccaggcaagagatgatcatggcttggcccacagttgtggcataggagatggaaagaaaggaatgatttcaaagtaagtggagatagaaccagtaggaagtaatatgttgggtttggatacgctgtttttgacattgttgaggtgtctgagacatccaaatgtatgtcaagcatttggacctcagagcctgaaagtgggctagtctgaagaaatcactgatgaaactaaagatatttagagaaagtgtgtagctagggaagaaggcttttatgactaagaggttgccacaattagaagtcttataaaggagatggtcgctaaccatctctgtacaagttagagaaccagtctgtaacttggtggctgatagagggttaccaatgtaataagagaaccagaaacagcagcctgttgagagattaagataaatttggtttggggttttgtaatttcaaatgcttataaaatagccaggtgggtaatgtttgccatgtggtcacaggagaatcattcaaaggttgtttttttattttgtcttgtttttgttttctttaaggaaggagtcttcctatgttgcccaggctggagtacagtggcttttcacaggcaggagatcatggtgcactgcagcctcaaactcctggcctcaagcagcctcccacctcagcctcctgaatagctgtaattacaggcatgcaccactgtgcctggcttttcaaagttctatacattgacttacggtttaaactttaacatgaaatcagggtatctgcaactttcattctttggaagacatcagtctattatcatgctcttggcattgcagttgatggagagttttatcttttttaaagcatgtaaatggcacttgtttttcagtatcacaaaatgagatgggtatttatatactaaattgagacgatgtaatatgaaacagttttctctgagtttattttgtacagtgcaattctggtggagggattcttgaataattagatgtctagaacaaatccagtttttattacatatgtataagtacttggccttgctttagtttcttatatgtaaaagtagagatagtttgtaagttttaagctgaaagcatctggtgactagtaggcagttaataaatgttagtgtgcctttcttatgtattatttgccacatagttttaacctgagaccaatttctcccttttactcattgtttccctgtccagatgatcctgggatactacctaatcaaggactgcttagatacaaaaatttaagatagattttatctcaaatgagataacaggagatatatacatttataaaacagacaagtgtttttagtgtcaaatattgatttttttgaaaaaataatctaagcaggccctgtccttttgctcatcactctggcactaggacctaagcacagtgcctggcattcagtaaatattagtttgagtaaatgcacgtgatgtccccctccaatgatttgaatcactaagagttgactgggtagagggaaataacttttatgatgtaaatcttaaaacttatagataaatatgtatttaaattgcaattaattacattgcatacatgttttaaaacatggtaccctgggccgggcatggtggctcacacctataatcccattactttgggaggctgaggcagacggatcgcctgagctcaggagttcaagaccagtctgggcaacatggtgaaaccccatctctaccaaaaatacaaaaaattagctgtgcatggtggcgtgtacctgtgatcccagctactcaggaggctgaggtgggaggatcacttgagcctgggaggcagaggttgcagtgaatcaacattatacccctgcactttatcctgggtgatggagtgagacccatcttaaaaaaaaaagtaccttgtctggaatgtgcaccccttaaaaaatgtaccttgctattatcccaaagatatttaattcagcagttcagtaaatacttagctccagttacatgcctggtgcttatttgttaaatgaacaaaaggtatactaggtgttggtgatgcaaagataaggtaaaggtcctaccttcaagaagctcattgaagattcaggtaaacaataactatagtatgacttaatgatctgtaatagaggtatgtataagatgaaggtgcagttttgtctaggtagaccaagaaagctccagataagttagatttacactggatttaggatagacttcacaaacagctaggctgcagttcaaagttagccttcagtcaagttatctttgttgggcggggggagttagaaacattaagtatgaagagattacgcacaaatctctgtttctttcttttgcagttacaggttctgttaacactggggtctcattccatcatggcagaaataggctagagctaaatagctctttcattaggcatttgtctcgggggtttgtcattttcagcatattttcttcatgtatgttacctccgtgatcctttaggcattttaatttgcaacccctgctccagtaggatccgtgtggattttctggttacagaaaagcaggaaaagattttctaggtgaaaggaactgtagtagcacaggcacaaacactgattgtgttatactgagaactttgtggtttgtgtataacagctgaggaatcatcgtatattttaagaaagtgtatttctgcttaaaaaataaaaaactctaccatcaagtatatcatatgttttaaaggaggaacaaacttaaaggcagggtaccttataaaaagccattgcagtaggttgggcaacaagcaacagagacatgatgcagggcaagtttgaggtagaatccacaggacttactggcttctaaggatgtaggataagagagctgaaagaagaggtacaggtgactcttaggtttctgctagacaggtaaaggaaacatggtttcacttttagacacctgaatcgatacccactttacaggtggaactatgactctcctcttacagtgaggtaggggcaggatgtggattctaaagtcattagaatatgatggaattagatggaaattgaaggtatgggaataggtaaggtaacacttaaaagatatggattgtgagccacccttaaccctaaacaaaagaataccaacattttactcgtgtaatctgggtagtaaaaccagaagggtagaaagccaaccagaaaagaattgcctaatggttgcctggggaaatggtgctttaaaaagccttctgtaaataaatactgcaaacaaattagtagatgacaactgaaaacgaagcctgagctaagtctggcagtggaattggaaagagattattgaaaatagtgcaagaaatgttgagtattggaaatgaaatcaatcattattaagtcattgtatcattgtcatcatttgggggactataaattaatgcagtcgtgtgcagtgaaatatttttccttctaaaaataccaaattaactttgtaatttttttttttaatgtaaaccaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagaggtaaagatttattattattttgtttttggttgacagatgtttaatatattaggaatttaactcaacaaacacatattgaatatgcactgtgttaggcaccatgcatgaaataaatgcagtctataccttaggaagcaaaatactagtgttctaagggataaaagagagaagtaataaattggtactaaagggagtaagcatttcttgctatgaatgctatataaaagtagcagcagtgaatctaggccaatttcagaagtacagtatgtataagggagtaatgggagatgagttggaaaggctgatatggagcatattttagggggccccaaactctctgaacttcttatgctaaattaaggaagttctattttcataggcagtagggggattttttaaatttggtctcataatgatatataaaaacagtggcttttaaacttgagtatgcatcaaagtcacctagcaagattattaaaacacagattgctgggcctgccccacagtattcgctaagatagatctgggtccatgcccaagaattcacgtttctaacaagttcccaggagtttctgattgttctgtggaccacactttgagagctactgataaatatgccagatagctcattaggatttaagaaactatgtttgggcatattttaactttgataaacacttatagattgagcaagagaggatagacaagatttggccaaaacttcgagtacttgcaagatcatctcctactgataagcatacactggttaaaggtaagtagatttttcagttatttcacaatttcttaatacagaaatgtgttctgcttcccagaatagtaatagatactgaatattagattgagtcatggatatcatctgttttaataaaatctaaatacatttcctttgataccttaggtaaattgtgttgttaagtgattatcttaagtgtttaaaacaggatattgctctgaatatacccatagtttctgaagtaggttctcacccaacatctaagcaatttccatttttatatttgtttatttatttttaaccttgagtctataaaaccgacgtcaggatattcttcagaatcatcttattaaagagtaatgtttttataacacaaatatttgcttgtatttaaggtataattgacagcactgtctcagaccaacgccaggttgtagctgtaactggtgatggtacaaatgatggcccagcactaaagaaagcagatgttggatttgcaatggtaagaatttactcattcaaatatccaaacgtaatttactgactggtttgtttgtttgtttgtttgtttgttgactaaattactatggattttaaacactgtccctcaagattagttcgagggataattaataagcttaaattggtttataagtctaattagtttatgcattagctttatttgatgtcatgaaatctgactagattgtttcttttgagcaatttaataatattgtatgttggctttgtattctgttaattttttaatgtctgtcaactcaactgaaccttttaataaccctttaatgcaggacacaggcttagaatagttgtgtgtatttaaattaaaaatataattgaaactcttccattcatctactcagttactcttcagttatttaaaaagtaattgaataccatcattttatatataatctttttttattgaaaaaaatcctacctacttgttttccccaaagtcctcaatttaagtattttattttctttgagtttcattttatttttggaaaatactggttcataatcacaattctcaaatctagaactatcaggaaactgaaatttttaacctaaattttgcagcagactcatttgattgcaaaatttgttctgaactgatgtgaggctgttatttgtcctacttagtgtgaatattcatagccattgtggagattttaatgtgatttttatggggtgctaagctcttttgggaaaattgagatataaggttatgtgtctcattatctttccaaactatgagagactgaattccgaatcacagtctggccctaaggttttcagatgagagattgtttttgtgtacaaatgtttatttgcataatttgtccccctgatattttgctgctaaaatggaaatttagaagatctaccatggtggcagcctttcaacaggagtgagagagatgaggaaaggaaattatgggtaaatttccctcaatcaaaagcagggaatccaaagatcccccgccctaccccatcccaaatttaaatggttggcagctgcattggtaggagcttctgaagacatgtgaagcatagctgaagaggtctatggaataattaagtgctcttccttttgctgtaggcaaacaggctcattccctttaggaacataggatcactcactgctgctcttgagcatttagcaggattcttattgctatttacattctgacagctgaccagaaaggcagttatgtaaaatgaattttaaaataaaaaaagctttcttcccaaaacttgaatgtaagacagatacaatgggctttaaataaatacaggtaaatataatcaaacaaatacacaatacaatggcttgttggttagtgttttttaagctcttcatggttttaggcccagttataccactttttttttttttaaatgataacatcaaaagtctaaatttagttcaaaaacaggctggccatgatggctcacacctgtaatcccagcactttgggaggctgaggcgggcggatcacataaggtcaggtgttcaagaacagcctggccaacatggcaaaaccccatctctactttaaaaaaaaacatacaaaaattagctggatgtggtggtcgcgcctgtaatcccaactacttggaaggctgaggcatgagaatcacttgaacccaggaggcgcaggctgcagtgagccaagatggcaccactgcactccagcctaggtgacagagcgagactctgtctgaaataaataaattaatttagtttaaaaacatagagaaactgtaagtacttggtagcttggacttgaaactactcttgttaaagcttgaatttactttggttttgcatttgtacagttaaaacttagacaaacgtattgtcttagagttttttttttagttacaagaaatcgctgttgataatttctttctaaatgtatctcctattttcaggcagatatagcattttagagcatactttcttgatttgttgatctatagataaagtgtgtgttctgcttgtacatttggccctttgtatccatggattctgcatccgcagaatcaaccaactgtggatcgcaaatattcgggacaaaaaatatggatggttgcatctgtagtgaacatgtgcagactttttcttgtcatgattccctaaataatatagtgtaacaattatctacatagcaagttttggtcgaaggagagaatccttgtcacatgaaattattcttgccaaaaattagttaaccatgtatagagatactgctgtcatcaaagactgaatctcatggtgtaatccaataatcaaatacatctatggtagtaaaacctaaggtaattaaaatacttttatttaaattttatttggattaatgcgggactccagatattgagactgtgttcagtattccagtcccggaacattagaagtgaagagttgctgtctcctaaaaattcacagcacatggaaataattacaggacagtgacaagtgtctcaggcagaagtccttgactctgcctgtagagactgggaagggttttctggaagaggtgccagtttagctgagggaaggagaggaaccaagaggccctcattcatcagcgaattatgtacaagtttttcaatctaactagaagaggttgcggtgctgtaatgagatacgaagctagaagaattcacagggggccacattaaaaaggccttgaatgccatgataaggaattttttttctcttatcctgtagatgaacatttgccaagcctacttctgatgatgtaagtttagagacacactatgcgatatcatatgactcctagaagctcatttttaaaaagcagtttaacgttttgtgattgaaagttttccagacttgtttcatcatagaactagtttttatttgaataccaattaacaccatagagttacttttagaaattttaaggattttgagcaagggaatggtgagatttgcatttgtataatatgggtatgatgagaatcaagaaatcccattgagtttaagtgtgttaaatatatgggacattggccaggcatggtggctcacacctgtaatcccagcactttgggaggccgaggcgggtggatctcttgaggtcaggaattcaagaccagtctcgccaacatggtatattaaaatcctgtctctactaaaaatacaaaatagtgggtgtggtgatgtgtgactgtaatcttagctactccggaggctgaggcaggagaatggcgtgaacccggaaggcagagcttgcagtgagctgagatcgcaccactgcactccagcctgggcaacagagcgagactctatctcaaaaaaaaaaaaaaaaaaaagtgggacattaaaagtaaaatattcacattgggagctggagactaagattctaaaataagattgtttcttcattgagtattttgagaaaggtttcatctgaacttcatgtttatcaaaacaatgtatgcgtagcatttaaaaggtcaagtagttctataagacttaatagcaagttccctgccacataccaaatttttggctcccaaaggaaactgttttagctgcttcttttacttagttatgtacctttatatctctgaatcacatgattctggtgctttttgatttttttaatataaggctttaactactgactttcattaatgaaggtgaggacttagtgctttcacaagcatatagaccacattcaccgcatataccttcatgctcactacctatcccatcatctgccagcagagttatatcataatttagatttgatcaatattcagtccttactgtgactgtaaatgctgtttcaacctaatctgtgtggtctactgtaattacttttccttccttacacagctttttatgttccctataatttgttgtcttttacttgctttcttttaatttttatttggtttgtttgaatttttttggcttagtttttctatgtacttaactaattcatccccaaattctctgtttcatacatcagagacctttagcactcttaccaattttagtgtctaagagatacgtctctcagcatctttcaacatgctttaatctgcactcgctgtttgctagccttgctgcacagctgtcttcttggtctccatacctgaggattttctttattctcctttgtgttggatcttgtacttcatgaattcagtggcatcatcttctttggtttattcccttatctggtggagtcatcttctccagctgcttcctgagaaagggtttgtctttgtccattttgtattgtgataacagaatatctaagacttaataattcatgaacaataaaagtttatttgacttgaggttctggaagtgagtaaatccaagagccagggtgccagcatctggtgagggccttcatgctgtgtcatgtcatgggagaagggcaagagaacaccgcaagtgagcacaaaagcaagagggggtcaaactcacctttataatgatgtcactcttgataatgaaaccactcccaaaataatgatattaatccatacatgagggcagagccttcatcatatcacctctgagtttccatgtctgcacttggttgattagagattatgtttccaacacatgaatttggggaacactttcagctcgtggcaaggttcgtgaggttaagctttttgataattttttagtgaatcctactcccttctaattactgccttgtctctctgcaaagataaccagtatcctgaagattattccttttgcctgtttttgaactttgtacagaagagtcatacattatgtgttgagttcatcttctttattcagcattatgtttgtcagatcatttatgttaatatagttgtagttcactcattttattaatccacaatttattaattaccccattctcctgttgatgacattgttattagtttgaagcttctaaatgcgtcttcagtagactttcaagagatcttcctttttttattcctaccttcacccctacttccagtgccacgtaaatctgccaagtctggagctgacaggggggttctgttgttggggggaaagggggctacttctactttctctacacttggattaggattcagctttcttgtgtctgctgagttacttaccatttggctgtctgctttctagcctctaaggttttatgggttttttgtttgtttgtttgttttttggtagaatctccttttcctctaactttgtcttcatagagtttgtttgctttttattaacagatacctttttgtgtggcttttggaaggaacttgggtaatgtctttgttcattcctccatttttaacccaacttgaaccttatttttaatacttcattctttgtttgatttctgctaaaccagaatgtctttcctagtaatatcttagaataactctgttaccttcttttagtgtaaatttaagtaatatttattaggtataatggtaaactttttgtttattaagtgtgtattttttgactatttgaaagttatacttaaaacatttagtctaattcacaaaattttttttaacagggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagtaggtgatgacttgtctatcaaaacttgtttactttaaatttaaaaagtatattaaatgcctcttaaaaaatacttaatatttaagctgaagcttaatattttaggttagttaatataaaaatataatcctgttctgtttctcaagtttttaaaccctaaaggtttcctgagaattgctgagcccctgagtagttgtgaatgtctattaggaaacatatcttttctaggactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggtaagaattcagtgtctaataaagcttcagttaattgtttcttttccaagctaatcatccaagatgttataatgttacaaattttcaagagcctaaattctactcctgacttcccatttatctttaatttcttcttaatcagtgagtgcttagtaaatttgggaggacaataagctagatagtagaataaacaggagaataaacagtcctgatgtcttaccctggctctccactaatttagatatgtgatcctgagattatcaccatagttttgggagcttctgtttccttgcctataaaacaagagagttgtactagataatcccaggtttctctagctccttccatgctgccatttcagatcaaataaaaggtctagctaagttgtaatttgtatacctccttgaaatctaatttggtatgataattacaaaatagtcatttttcattctttcaggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacaggtgggtaattggaaaagatagtttcaaatttgcctgttaaatgggagacattaggtaaacagcttgttctagcaatcacttgtgtggaacatgtgtggaactgttgccttggtgacatatataatatcatggtgatttaaggtatatgttaaagaatatgggaactgaatctcctgttcttagaagtaaatgccacaaccaactagacaaacagttttatttcttccaactgtaaagtgaaagatattatttcttaggaaacaaagtcagccaatcaattaattgtttcccagcattttagtattctttttacatcccacattataccaaaaaaaagatcaggtttaaattttaaaaaaaattaagatcacttgtacaaatacatattgaattcttcatgctcattattttcttgatttataaaagaaaattacttcagttttatatctctactaaaatccagacctgattgtcaaatcagttgtaatctaattgggctactaacaaagcagttggaaatctatctgtacaagtgcacaaattaacttaaaaaatagtggaaccgagaagtgaaaatgacttgaatttgaataaagtagagctaaaaagaaaggaattgtaactttaaggttttaaaatgttaactaccaaaattatttttgattttaatatttgggaactagttaactgccatatcaaagagaggcctgtcagactcacaggagggtggatattgttaattgattctttttttaaaaaattatttattttttaattaagacagggtcttgctatgttgcctaggctggtcttgaactcctgggctcaagcagtcctctcacctcagcctccaaaagtgctagaattacaggtatgagtcaccacacccaaccccagttaattcttaatatttccatgcacactattttaggccttttagaataacaagcaaaacataagcactgtattatgaatttatattcatcatcagacctcactcttttcataaaggagagcaaatctgagatcacctcacctgagttagcccatatttcatagaactttccaagttgcctttcttctcatacagtctgtgtttatcttagtatgtctaaatgttaactagaaataaacagctatgtggaatttttttaatattgtgcatttttccagtaacatacagtcttttctacaaaagagtactatattttgagaaaggcacagattatttgaagagttgtactaaatacaggggaatgtagttgcttggggttatattggaaacagtataaaattattattcttggtcataagaattttactttttagtaagcgtaatttaaacatgaaatacgcatgcatcaaaaatattgggcagagattttactttatttcagttgtctttttttctaagaggcaaagtggactggaggggaaagaggaaaggtctatttcagttgtcttattttcagttgtgactaatataatacaattcatcagaatagtggttgttcaccttgttttagaggacataaatttgatatttttttaagtatatgaattttaaaatttaagatttaagtaaatttactcttgattattcctccagataataattgtgcagtttggtggaaaacctttcagttgttcagaactttcaatagaacagtggctatggtcaatattcctaggaatgggaacattactctggggccaggtaaaaatttcatcagtttttgtttaaacctaaagtgatttttttttttaatttctagtgtgtattttctttaacagtttcattacttgattctaaatggttaatgtggtgagtaaagagagggcattcaaagataagtttttttaatgtcgtattagttccagtatgtcacttgttcattatgattatgcctgtactataaaatactatcctaactttttatgtgtttttttaacttgttttttagaagttttgtagcggtttttaaaaatgatgtatttataactggttaggatgctaatatctgtatcttttactctataacctatttttacattttcagaaaaaaattttttacaacaatgtaaaaaatacatggccgggtgcggtggctcacgcctgtaatcccagcactttgggaggccgaggcgggtggatcacctgaggtaaggagttagagaccagcctggccaacatggtgaaaccccgtctctactaaaagtataaaaattagctgggcatggtggcaggcgcctgtaatcccagctacttgggaggctgaggcaggagaatcgcttgaacccaggaggcagaggttgcagtgagccaagatcgcgccattgcactctagccagggagagaagagcgagacttcatctcaaaaaaaaaaaaaaaaatacattgtcattttgttctgtaatttaatccaatatgcagcataggaaaaactgaccttagagaatgtttttataaaaataatgttacctggaaaaaggggtcacaaaatgatgttttagatttgaattgaatagctttaacagtgtatatatgaaataaagtgcctgaaataagagatatacctcatatttactataggcagcttacttgcaaatgcatgtcattattttttaaatgtgacagtgatttatgcattgttcattttaagcccattactataaaactaatttatagaaaatctaacattttcatagatgaaggttaatatatattatggcatataatttgcatgagctaatttattgtcattctgcaaatcagtgaaaccagactttcaggttttccttaaatgtagcccaatctttacatctttgtgtctcttctttttcttaactatgtttctagattctgaggtttcttatctattttgagtacctcattaatagagatcatcttttaagtaagacccatactaagtgtaccatggtagaacaagcactgcctttggtggtcaggagacctaggttcctagtcactccatgagcaagtcactttatgtgccttgaagcctatttcaccttggtgaaatgaggtgggtgtactagaagttctccaagcagaattctgtagctgactacatgcttgtttctccctgataaacccaactgctgccttagagaatggatgttaacacataagctaatatacgtgtattggtgtttcttgtatcctttgtgttttctagggcatctgtttttgtttggcgtcatcaatcagtactaatccaattttaaactgttgcattttaaaaaaaatatgtaacaaaactattttcagtgtaaccttaatgatttttttaaaaattttatacattttttctcattgaactctgacagcattaatgaaatgtaaacgtgttttgcatctagtaagaccacctgccattttcattgtattcaaaataaataggactttttaagtaaatacatatatcagagcatggttttacaatgtactgtcttgaatgtcctgatgaaaatatgaaaaatgtaatcaggttaatttccatttaggaaaactttttatccttcaaactcaaatcttttgtgtagctaagagaagaatgtattttgctctgggagagaaagactaatcaacaggatcccattacttcattggtaaagatagtcggatactctcaccacttttaatacctttagtattacagttgatcagcttacctttacttgatatgatttatttctaagttcattcccctgtgttgtagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacaggtatgggcctggtagagaggtaggagagatgatgggagccagggctttttgacctggggaggaggttcgagtgtgctccttaaacttcctctctagccttcccaacccacaaattgtattctcttgaaaagtaatactggtgcctggaatgagtgagacttttaactgattatgaaagaatgtgtctatatgcccctaagctccttttttcctagctcccccatcccccacttcatctcaaaatgctattcttgcctatatgctgtgtaaaaagtgcctttttctttttatatgttgatagatggaatggtcctttctcttgttctctctctctcttgctgagcaagctgtcacaatctctgattccttgcagatggatgtagtgaatgctttccagagtggaagttccattcagggggctctaaggcggcaaccctccatcgccagccagcatcatgatgtaacaaatatttctacccctacacatgtagtgttttcctcttctactgcttctactactgtggggtgtgagtgtgtgttcctaagtgcatgaaattaacatttcctacttcacacacctaacgtttctcattttctccttaatgtttgaattcattgttcaggctttttcataaagctttcttttcgtaaagtggattgagacctcaaagtgttgtcgttgttgttttatttcttagagggctagataacaggtggaacaattgcaaccaaagattagatgcaatctgtgagcttgtctctgtgctaactctgatagttaatatggggaataaaattgtagcttagaacttgtgaaactactataaatttttgagtatatgcctttaaacatgtttatattgcatgtttcctaaaagcatgtgatttgaaactcatctaacagaaccaggaaattgcattttcaaagctaagaataaatttagcattttgacttttgtccaatttggaaagtaagttagtagcctgaagacaagttttcagtatgtatagccagttgcttgccttcttaacctgaactttgccttgctttgattttttttttttttttttttttttttttgcttggttgtgcagtggtttcaggggaaatcactgtgtaaatttaaaaagtttctgtggtatttatggtttggggtggtttttttttccatttgtatagacaatttagttaaaaattgcatcatagataagaaatgttctgttaagtttcagtagaagtaggaaaagtatactattgattaatcgttgaaccaataaatgttgtaattttcaataattgactaaaataacattttctttcaggtttttagtaaatagcaaactttctaaaagccttataagctataaatcttactgagaattcatggcgcattctcaatatattggaggcattaaagatgtaaaccccaaaatttacagagctacctaaggttagccttgaagtagacagagacctatcttttccatttggtctccagccagcgaaggactagaggaaccttgagaagctgcagagaggatgaattaagggagaaaacagtgcagactttccacttaatgcgtgtttgttctgtatttacttaagtatattttcatttgatattttttaaaatgtggtgaaacaggcacagtaagaactgtccctgttttacaggtgtgaaaactgccttagagtttaaataacttctctacgactaataagcagaggccgcatgatgcaaagcaaagtgttccaagtgactcgctaacattaagatattaaatttacatagagggacagctagaactcttccttttaaaaattacctacctgaataaaatggtaaccataaattgcctagccttaggcctgatacaataaaaatgcctcttcctccctgtatctgtggatttcaaactatgcctctctctctggtgctccttaccacctagccctagatggtaaatgttccacaagcctttatggaaggcctaccatgtgtcagaactatgctggaacctccagaacctgcagcctagtaaaggacaaaaaaaagtagttggaaatttctacatggtagtaaaacacaaactgtcttaacagggtccttagcctaccctggaaagtcaagaaaaattgcctgaaggaggtgactcccaagatgacccttgatagaattcaccaaatgaggcctcagtgattataatctggtactaaaagaggaataaactaagggattgataatagtctggtactgaaagagtaataaactaagggaagctgaaatggaaagtaagtatctgtttataccccacaagaaggagccaaactaagactttatcctgataaacccccttccctcaaaattttaaatttgaaaaattcaaacctacagacaagttgaaaaattaatacatgaaaatctttcacctggatttaccacttaatattttatgacactactttatctgtatattaataaaacttttttctgagccgtttgaaaatggcagataccagtgttttatccctaaatacttcagcatgtacctaagaattcccgtatataatcatactttattatccaagaaatttaacattgataccatattatctaacagacagttagtattcagatttctctggttgcccccaaaatttcctttatagcttttttaatccaagaaataattattgacagtatgtgtgttatgagtctagtctccaacctgtattcattccctgcctttattttttatgacattgacttatgaaaaatccaggtgaattgtcttatgaagggttctacattccagatttgtctgattgattgctactgattagcttcatattaaactttttcgacaagtttatctcatgggtaatgtgtatcctattcgtttttatttaccaatatttaaataattgtttttttcatttagagggatatcagatggctttaggtgtactatacttattatatttctcagtctgattgtgttccaagctttatattaaatatcaaagcaatcataaacttttaagacaggcaggcagacacatatatgcacacacctctgcacccaggcatctttttttccatcccaggctcttttttctgatgcacagttacatatgaaacctctgagtttctgggcccatgtggctaggggagcagatacttcagggaagtaaaggtgcacttaagagagtggcaaaggaaagtttgtagttgttgctttatcaaggtttgagatgtttacttctttattctgtgtcctatgttcttggagttattcagggagtaaatcatatctcgttaatacagttgtcattatacaccaagagttgcagtaattatgttgctgttaccataaatgtctttcaaccttgttggtggagcattgtcttaggtggtacagaacatcagccaaaatatagaactatgttaatatatttaatgaaagatttcattttatcactgtgtttctgccctaatatggaatagttttagaactacctatgggtgtcaaaattatttaacccttattgggtgaccttgcttagctaaaatagaagaaataatccatttagactttgtcaaatgctggactcaaacatctctgaagagacctttttcccttcatttattagtcagatcttcactcttacaggtctctagagaaaacattctgtagtttttttctatttataaagtatatcattctaacaccagtttttaccattagtagatttttttttcctgaataaataaatacacattcctggaaatgagaaattgagagaaaatttggttttctaggtgaaggatcagcaaactacagcttatgggccaaatctagcctgttgtctatttttggaaataagttgttactggaatgcagcgttgcccattcatttaagtaatacctgtggcagatttttcactataagggcagagttgtataattatgacagactgtataattcacaaaacctaaaatattttactgtctggcacttcacagaaaaagtttaccaacccctgttccagatagataagaacattacacaggtgggtctccttttgagaaaatttaatatgcaagtacccaactttggaaaacaatctagaattttgtttctagttgcaaagtatcttttactgtaccattgcaattctttaagttagtgcacatagaaaagtagtaatgaaaacaaatttcagaagtgggcaatttgttgtagaaggtaagatttattggcttgtgattagtattttagagctctctcttctgtacaatgttttaggcagtaaacaatgttattttctgctattaaaagttaggatggtatttagaaaaattggttttgtaggtacatgatcttgtttggatttgttatatttcatatattgtttaccttgataatcattttcagtttcttaaaattcatgattatgataatcacttcagtttttttgtttaccatatgtgcttcatgcagtatttttgttttttttttttctctgttgaacagtttacttttacagaatatttttgacacaggaattactgaatttttcttaattctgataatttcgaggggtataagtatgctccacagagtaggtttaaatagataataaataggaattgaattttaaaactggataaaataaataggcttggattttcaaaagcctgtaattaagtttacttatatttctacttaaattgaattattattaatatagtttccttcctacctaaagtattgtgcacaaaattattattttcctcacagttactgtactgtgagaattttacatacagaaagtaataaagatcagagcaggtgtgagccagctcagtgtcatgccttagatcaagagtgctttcttatgttctttataagtagaaagtaaaacaactctggttcgatgattcctggttaatctgagctttattgtatgtatctcgagaactgttctttgaaaattgaattgctttcgagcattgctgaactggcctagtaacgtgctgaaactaaccagtcatatggcttaaatagatgtgtcagacaaaggaagcattaaccttaatcttatggaatgttttattcaagtgaagttagggataaagtaaatgatcgtatgtttttgtcttctcttgacttccaaggaacctggaattgggagcccagaaacctaggttttaagactctttagcactaattaggagttccttaacaagtcagccacccatcctctctgttgctcagttttattatttatgaagtggttagaaaaaaaaaatctctaatattgttcaacaaattcagataggaaaaatcttctcagaattgaagttttgctaagaagggatttaatctttctttgcctgccaccggtgtatgtgtgtgattgtgtgtgcacatatacttgttgccctcacctttacactctgcccctcttagagcttcactaactctcaaatctctaacttaagtttacacttttcttctgagctctagatattttccaaatttaacatgtttaaaaagtacatttatttccccccgattcttcactgctcacttttataccgactgattacaaagaaaaacagatggaaaacacacacatacacagaaagcttaactgttgttctatcttcagtagcagcagcaccagcaaccttatcaaataagcaacatcttcagggttgtcttgaacagttctcatcacccatcaagtttgctggctgatcctctaatttgtattctcctccgtgcctacgggctgctgataccaacaaatttttttttagaaagttatctttttgcattttaagctttacagtttgttattaggacagtcaggatacttgctgaatgttcacatgtataaaatgtgaattttaagacttcacaataaaacactgaatgaattactataacgttatatttagcaaacattgtttacattccatatgtagaacactttacatcttagtaaaggggaagaggaacaagagcaataaaagaagttgaaaaatatttgctgctattcatcagtcaaattaaggaactgaagtacaagcaatcaaatagaatggaattataaaagatggtaaagctgcaagacattaatagaatagatgcttgctgctccaagtgtggatcatggaccagcagctttagcatcaccttggaggttgttagaaatgcaggactttaggcccctgctgaatcagaatctgcattttaacaagatccccaactaatttgtatgcacattaaagttcgagaagccctggcctcgatacttgtgacctaacattgttttaagtttgtagtgtgctaacgaatttaatctcccacaacaaccccgtaaggcaagtaccattgctatttcccattttatagttgaagaaacctgtttgaccgaggttcctcaggtagtaagtggcagagctggaatttacacccagacattttgcttttgtatttctcagttgactatgctgtactctctatataaagggctaagtgaatatgaactaaaagcagcttacaaatagggcttggcaaataaggaaagacaacttgaaggtgagatgtgggtgcatggccctaaactctacattacatttttttaaacacattcacatgttcatttgaagaaatgtattattcattattgctgtctaaagagatgaatttggtgaccgcatcttttttctagaatgtcaaagtgttatttatttctcttaacaatgagtaaatgatgtctttattactaaacaggatttattagaatcaaagcaaaagcaaacactgtatttgaattgatacatagtaaatgctcaactagttggattttgtccttttttttctaaatctgaatgacgcttgagttaatagcacttaatgtcagtgtgtgcactgatgtttttaagtttgattgcccactaatctttttcatttatacagcagactgagaggaagatgaattgttgagctatctgcttaggggtgaaaatactagaaaacttttaacactttgtgtcttcttgggaaatttttcacagaagaatcccagaggatttgtttttgtttttgatctattctttccagataactgtagtaattgatttaagttttaatctgttacagagaaaaacactaaaactttatagacaaatgatagacaaatggcatatactcaaatatttatagctgtttaatggcattttatagacatttatttgggttttgttcttatttttgtttttaattaagggagtagtggggtagatgtgagttcattgtggcattcagcttatatttgcttggctttttcatggtcggtgacaccctaattcctagcatgataaatagtaaccctttgtgcttgattttgtttaacttatttgagttgttttcaaaatacattctttttaatttaaaaaatcagctaagcttgtgtatggttaagtttttgttttgttttgtgtttgatttgttcttttagggaaaaaatcctataaaatggctattaaatttttagccaatgacaatgagattttcttaatattactttgaattctttacctcttaattcttagagtatgtggttttgttgttctgtagtgtcttactaaaatattcatttttttacagtgtattgcaagttccactgcattacatgcaaatatgattcactcatacctagctgtttgtggattcaaactcataaatgaaccatttttaagttgttaatagtgtactgacatatttctgtattttctgatatttacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaat

SEQ ID NO: 15340 - DNA, 19567 bp, Human
aacacgcatacggttaaggcattaccacctacttcgtgggatctaaccatcgtttttgaaatggtgctgggaaaactagctagccatatgtagaaagctgaaactggatcccttccttacaccttatacaaaaatcaattcaagatggattaaagacttacatgttagacctaaaaccataaaaaccctagaagaaaacctaggcaataccattcaggacataggcatgggcaaggacttcatgtctaaaacaccaaaagcaatgacaacgaaagccaaaattgacaaatgggatctaattaaactaaagagcttctgcacagcaaaagaaactaccatcagagtgaacaggcaacctacagaatgggagaaaatttttgcaatctactcatctgacaaagagctaatatccagaatctacaatgaactcaaacaaatttacaagaaaaaaacaaacaaccccatcaacaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgaccattaaaaagtcaggaaacaacagctgctggagaggatgtggagaaataagaacacttttacactgttggtgggactgttaactggttcaaccattgtggaagacagtgtggagatttctcagggatctagaactagaaataccatttgacccagccatcccattactgggtatatacccaaggattataaatctgctgctataaagacacatttacatgtatgtttattgcagcactattcacaatagcaaagtacctggaaccaacccaaatgtccaacaatgacagactggattaagaaaatgtggcatatatacaccatggaatactatgcagccataaaaaatgatgagttcatgtcctttgtagggacacggatgaagctggaaaccaacattctcagcaaactatcgcaaggacaaaaaaacaaacattacatgttctcactcataggtgggaactgaacaatgagaacacttggacacaggaagggggacatcacacttcggggcctgttgtggggtggggagagggggaagggatagcattaggagatatacctaatgtaaatgacgagttaatgggtgcagcacaccaacatggcacatgtatacatatgtaacaaccctgcacgttgtgcacatgtaccctagaacttaaagtataataataaaaaataataaaataaagaaaaaaaatctataactacatttcttgtaattttgtcttttgagagtatacatatcttatttcctttcccagaccagaacctctttgagggcaggaggaacccggttttccctactttacacatgacacataataaccactcattcaatgtaggtttactggatggataaataggaatggggggtagataggcgggagagtgagtagacaaatgcgaaacaggaaaagcttgcgccaggaaaaacagtgaagagcgaaatctccagacccccgattaaatggtttaaagtgaagccaagcaagaacctccagtcctctctgcggcagagaacagcagatgatagcggctcgccttcaactttgctctgaggacctctcgttagtatcccgcgattgtccttcctaacgcctgactgaatcctgaggctagccttcagcgaacatgtacaccgccttgcccttcacgtgaagccgagcctgtgactacacttatccttccgtcgccggcctcatttctccttccccttctccgatctcgcaaccactgctagtaaggcgcgcgtgcgggcagccctggccggcaggggagggagggtcctgcgaccggaagccggaaaccggaaggggggctgtgaggacgtgttccgaggaagccagagccggagccgtggcctgccgggccggcgacatggatcccctgttccagcaaacgcacaagtgagggccggtcggggagcgggcaggggctagacgaggcgaggccaggtgagcctggcttctggggctgaggcctcggacgtcagccagggtagaggccgagtttttccgccagggcactgctggggatgcctccgaagtgcttaatccttggcgggactcccaggtcagccacagacagtgggttcaggctggggcctggagacgtggggcagatgactcctggggtctgcaagttcgtgactacctgctgggtagactgggtgacgggaaactggcacctgcaggttataaaactttgtccagcacttgtcaactcggtgctcctggttggtagacctcgagaggagacacggagtaggagacacggcccctggccgtaggagtgtactgtttaattggagagtcagggcacgtacgggaaagtatttgtattcttattcgatttatactaaagaccacatttttatggtacaaagaaattgctgtccacgtagcattcactattattacttgttaatcgtatctggttacaggttatcgctaagaaaatcaaattgtaatttagtttctcataacttaaattccttggtagtgtcctttattcgcatcgtcctgcactttcggaattgctgagatacgtagttgagtattaatggggccatacttaccctatttttgggggcggggggcagaattatgatttttaccctgttttggagggacggaattttatgatttttattttttattgtaaaatatacacaacataagatttactgttttaacaatttttaagtgtacaattcagtgacattgagtacattcacaacttacatcactacgatccatttccagaactttttcatcatcccagtgtgcctgttaatcagtagcacttcatttcttccttccagaacacctagtaacctctgttttacttctctctatgagtttacctattctagatacttaatataagtggagtcatacagaatttgtccttttgtatctggcttatttcacttaatgttttcagggttcatctatattgtagcctgttaccagaatttcattctgttttatgacggaataatattccgttttatgtgtctaccacattttgttatccattcatctgttgatggacacttgagttgtttccaccattgggctgttgagaataatactgctatgaactctggtgtagaagtatctgttttagtttctcttctcaattttttgaggtatatacctatcctattgagaactttcaaacttatgctgtagttttgttgattaaaacacttaaaatcacactcccaaggcctggaaatgaaatgccctgaagcatgaggaataagagggtgatgatcctctttctctttcattttctaagtttatgggtttcttttattttggcgatgaggtgtttcatttggacaggcgaaaatacagaacctactttgtaatgacagaattttcttttacactggggagccctattctcacataaacgttataggaagggacttaaaactagtctgtgagtaatttagagaaagaatgaaacgaaattatgttcatgttactaagaaagggcctatctttcacaatagcagggcacaatgggcatagtagtgccttgaagttaatctgttatgtatggtcttatctagttaatttagttaaaggatgttgccaagaaggccatgacccattttatattcaagaataactttatttagagagtcttagactacctgttttcagtgcagctaatcacagagaaaactgcatggctcagaagaggaattctaaatggtaccccaaacaaggtgtgtggagtgtagatgctctgtaggcctccaacaatgcacccttggactctagcagcttgccagttttttctattaagggccagatagtaaatattttaggctctgtgggctatacggtctctgtagttactactctgctgttatattgggaaaacagccatagacaatatgtaaactaattgatgtacctgtgttccagtacaattttatttatcaaaacaagcagtgggccagctttgccccacaactattaggccctctgctaccccgacactcattaattcattgaatatttattgagcacctactatgtgctgtgcaccattctcagtgctggcagcacagccctgccctcgaggagtttaccttcttttatgctgcagtatcttgtctatctttcctctccagtgctgaaccaggagtgggagttctggttctagacctccttactttatttttcctcatctgtagaatgatattataatttgggctggttaaactgtaaggctcctttcagttccatgataacagaactgatgactgaatgactttcacaagaaacacgtggagtccagtgagcaccagcaatgaactttcgcaactgcagaaattagtgattgtagctgagttgacacaacagtagctgaacttattaattttactggaactttgaacccagtttgtgattatctcttgccgtgtcactgaatacattgagtacattggaattagattgacatattaaagttacttgaaaactcctgaacctacctgaacaatgaatgaatgaaaataatgaatgaatgaaaacaataaacattttacacttaaatgtttaatttagatgaactttatagaggagctaatagccaggcttctatttttgagatcccaatggttgtaaaggtgaccacatttgtcccctatgtagtccaagatcagtctcctgtcctggaccttatcgtatgtccaggacacaagaagcactacatttaacaagctccctaggtggttttgatgagcaggtaggcttaagaactgttaccttatctcaagaccattttttttcctgaacagcggagcttaagaactattaccttatctcaagaccatgtttttcctttatagattttgccctttaatgagcgaaatgtaaaggcaaagtgagtgaaatgaaaatgaccagattgttgccactacttttaagtaaagttaacaacaaacttacatgatgctgtgtaggttacacagcgttttcatgttcatcatggtcagaggcagcctggatgcaaagtggatgttatggggtggtggggggcggtgagtagtttcatgaacttttaaaaagcacttccattaaaaaattcttcctagatcttctgtaaaccttttttaaagacggctacaatgaccctggcttatttgctactatttctctgctttgttatattatcacccaagcccaccatggaccccatgctagagagggctaagacttctttttcctcatgtccacgctcccaagtcatgcttgtgtatcacctgtttcttatggacttccagtgtgttatgttgtgttagaattcccagttcagtttgagacagattttgcacttggcatattagtagttcccaccttgccattcatacttgctttgttgtttcatatttatgttttcttagcatgaaatgtagccgctggaattgtattattggccacattgtctctgattggttcaaagcaaatagagatttgatgggaaaagtcagtggattatgggcctgtacaaaagtgctttgatgaacgtcctgccatgtacatctcctcagggtatgccagaacctctctaggacacattcctcaaactgctgggtcatagcatggacacatgctttattctactagttattgtcagaaagcatttaaagtgttttaccaatttataatcctaccagctgggtatgagagttctagtttccctgtttccttattaatgcatatgtccccaaactttaaaatatttgtcagtttgatgggctgaagaaatgtgatctcattgcttttcatttgtgttttcctagttgagtgtcattttgtatattgattgaccatttgggttttcttttctgtcatttgcccttttttcatttaaaaaaaatgccttgtttgactttttgtattgatttgtaacaattctttatatattttctgcacgtcaatcctttgttatctgctgcagataccctccagtctgtgccattcatttgtttattttgtggctttggtgtacagaagttttttgttttcatgttgtcagatgtatccatctttttctttgtggtttgtgggttttgtgggggtgggtagtttttggattttgtcttatttaagaaatcttctgtaacccgaggtcatttatgcacacctgtattttcttcagaaagtttgaaagctgctctgctttttccatttgggttttaagtgagcttgagtttatttttatgtgttacctgaggtggcctttttctgtacgggtaacaaaccggagctgttggcatttattgtagtcccttctttcaaaagctcccaaataacgtggggctgtgtctaggctgtttctttcctcttgggccagctgtagggtttgcctttccttgtctgtctgcacctgcactgccgccatattgtttccattgttactgctttgtaagtcataatggcaggtgggacaagtcattcctccccctccttcttcagagtggtcttggctattctttacctcccccctttttattatgtcactgttcgtgttgatcatattaccaactttcagatttttctgttaaatcagcattgaaaatttacctcacagcctgcgtcaggacttccttagagtcctaattctcctttctgtccccgttaccctccggtcccctgtacctgttcccttggttgccctgcttcaggtgtcggctacctcaggctgcattcctacatcagcccccatacctccacacccccgcatcatcccacaatatcccagacttactttccggaagcaacggcctggtctcggactctagcagtgatttctagttgcttctcagggccacaggtcttgcctaggagcaccctggggagtcatttgacagctcacccagcttcttttggtgcccgagggcatatctggaggccatagggaagccctggaaaagactgggcacaagctgaagccaaagttgggtgcctggctggcattggtagatttggggttctggtttgcattgctcacgatgcagaatggttgctgacctttcctccagcgttggggatgatgtgagagtccagcaggcccccttcatgtgggccctaacttggggaaatctccaccgtgagcaccaggaagtggatggtggggccagcataagcagtatcccgaggactgatcatggaggaccattaggaagggggtcttaaggatgaccttggccagaccgtgggaagcctccagagagtgttacccagatccagggtacagtgttgcatttccaaatgagatggcagttccttcgttccttgatattgtcggagaaggatgtttaccaaacaggaggtccctgtctcagggtcttcctctgaatggtttcctccagtgagtcacttcagcatcctctcccccaacccgattccctttcaagcagcccaccctacttgtaatccacatgtcttgaatgaatttttgcatatcattttcttctatcttccttcaccaaatgatgtctcccttcttcacagcgatgctcagaactctttccatccacataacttacctggtttctctttctcagccccacccctctgtctgcttgcctgtgacaccactgtgcagagctgcccctctttctgtttgtttatacttatgtgtattgcttttctcgtgaatcttcccagggcttgttcatgtctgtttagcctgtcattcctcattatgttgtttctcaaggacaaggattatatctccctcgccctttgactcttcctggtacaggccagtgcttagcacattaggtcgtagaacagaaagtaggattggccgggttcagtttgaggtttatcacttgctgtgtgatcttgaacaagttacataacctttctgggcttcagtttttataaaatgaggatgataatggtactttcctcatagggttattgatttggcagagtatcttggatatggtaagcacccataatctgcctatcagtgttattgttagtagttaagatattagaaaccatgccaaaacgtgggacctaaagtgccacatacaaattttacagttcagtgatgctgtcgatttaaatcagttacatgttggcatcagaaaaattgtctttcctgactgaagcgctgttgattactcctgtctcactcatttcctccctcttcctttgataggcaggtccacgagatccagtcttgcatgggacgcctggagacggcagacaagcagtctgtgcacagtgagtaattaactgtggagaccagagtcctttctctgatgacagggtgctaatgggctgggcttcctgactgcactctgccttgggggcttaatgattcagcgtggaatgagttttgttgttagggtggacagaaaaaccctatggcaaagtcactgatttccctgagtgtgccctttggaatcccacaagtcttatcccccattacccctccactcaacctgacatggccctatgggaatggaagcgcttgcctccatctatcttaatctaattacctagtccttagaggaatgtactccataaaaattcagagatgtttaactggaattggccatttcttctgagctgagaactgtggctttttaggaggattattcagaaacgaacagcaatattaattagtttagttcccacagcatggtttcttttgagaagcatgctggttttttgttttttttcattttttttttttttttctattctgaggaaaggtcctttttctgagttggtcatatggacaccacctgcgggggctgcctacccaccccactgctgggctccctcaggacccattcctcctgttctctcatgtctcctttcgcagcttcaaaagcagctctgttcttggttctgtgccccaccttgttctaatctcaactgtctttgttcactgtgggcacaaagggctaggaaggggcagtgtcactgctgtcacttctttatggggcaagaagcagtctggatgctttcttttgtgcacagtttagcttctttgttcatcggactttgtttgccttctcagcaatctcattgttacatgattagaaatggaaagaggtcattttgactgtcttatcgaaagggatagggaaaatgaccgtatttatcgtatctctttacctctgtggattctttcctgggcctttcctattgatatttggtttattttggggacgtcaacattgctcagcccacccattcttacagaaagctttaagggaagaaagccttaagggaactcttctctgtatgtttcacatactaatcttccccttcctttatgcttttttttttttaaataaaaaaaaaaaactcattactatagggaattcaattggcagcctttttctaggtatttataatccacgtctgagaatcccaaaggaaaagagacctatatcagaaaatttagcttaaagtatttatttggacaacctttgcatgtttattttctaaaggtaggaaatttatttctacagatttaccttcagcttttttaaaaaattggcattgttatgtcattaacagctatatacatgtacttttttcaaaacaacatttacggcctaacttgaattttttctgttattcattagtgtatacatttttctccttttgaaatatgtagttctagtttattggatattgaaaaaaaaatctgtgatttatcattgtaatttaagttcactatctcttttccagcaattattcttttttcttttttgtacagtagtagaaaacgaaatccaagcaagcatagaccagatattcagccgtctagaacgtctggagattttgtccagcaaggagccccctaacaaaaggcaaaatgccagactgtaagtgctgacctctgacatggctctgatactccaggcccatcaagacaggcttttctccctgggggaggtgatagaatattctgaaaaccaacgtacatgttgaaaaactatgactatgcaaagaaaaagccccctcaaagggcacaattctatctgagtgatgccgctcaaaataaatagcctgtgaggtttgtgactcagaaaccttgtgaccccttacctctttggtgtcattttgaaattttgcctccagttctgttttttgactagatccatagccacctgaagcctaatgttgccatggagttttgttctgctctttggttcctgctgggttcttcttgggttgaaatgaaaaatcacttcaatcagtccacccataatgaaatgctgatctaatgtttgatactccagcatgaaattaaaatgaaaccacccttgccacctccacccccagcgcctgtttccaaaagttttatgaaactttgtggatgctttacctcaaagatgcccttgggcttcttccaggagagccatataatccatagaaggtcaagaagaggtcagtgagcctgcttcctgtcccctgttctctgtcatgcatccagaatcagagcaacagattctgaagtcaagctgctggaatcttgtgtgctaccatctcactttaaccacaagtttcttcttgactttcaacatcgttgatcaaaattagatcttgtggtgagggggtatagtgtggggtggtgtagggagaagtaaggaaacgccgtctttcctcagtacaaagcctggccccctcagattctgctgccctgagttcctggaatttaatctctctctccatcaattccagtcgggttgaccagttaaagtatgatgtccagcacctgcagactgcgctcagaaacttccagcatcggcgccatgcaagggagcagcaggagagacagcgagaagagcttctgtctcgaaccttcaccactaacgtaagccaggcccgtggtgagggtcggcctgcacttgacagatcgtgggggctggagttcagatctctgagcgccatctgttttgggggtgtctgaagaagactgatgatgaggaaaccaactggaaatgacaggaactttgtgcattgccacagagactagacctagacagagaatccctttttctaagacaaaaacctgaagaggaagcagttaaattgaaggggaataggcagaggtgaaaattacctggttgggctggtctgagacagaaaggtggaagttcacatggtggaaacgtttttctgatcagatagagacagatgattagaacttaggccatttgtagagaaggcagcatttcaaagctgcctgcgggcagttgccattgtgccgagtatgtgtgtggctccagtgtcaggtgcattaagatgtttttgcccctagtctgagcagcaatttggaggaatttgttaacagatgtttagggttagatggactgcttgcctgagtctgtctgaaagtgtgttggtttgcatgtttgatttttcagaacccattgtccctgccctttagtcttaaccagatcatttcctgcacatggctgtagaacatactggccttttctgtgtcctgcataatatattccactaaatgaagtgtgctttggctttttgtattttgtttttttacagaggattattttctaaagagatgttagctttctaagccagttgttaaaattcacatcatttcctgctttgtagatgtttaaccctcaatgctgcatccttgctttgcaataaattttcccaagtgtttcaggctgtgccaacatagtttttgcttccccagactaagcagtcaagtcacagtgtttaacagttcaaaaatttaatgaactataagacacactaaaagatgtttggattttagatcgttataatgtagtattcaggccttttttaggccaaggatgatcgcttgggattattttgttttttgccagcctggcgtgatgctgtgcacaccgtcagttcttaataaacattgacttgccagatgaaacttcttcctggtcattctaccatatggagctataatacatttttctgagagataatggcccatcagccatactgttttagatgggagggtaagaaagatttgtatgtgaatggcatttcataagtgctagtcaaattactgaagagaagtctctgagtctttcaaacgccagcatcttctgacacactgggcattagctgcatgcagaaaactagttaattcaggcactaggagtaaagcacatgatgaaattaaaagacctgacgcctatctgtgaggagctcccctgttagcaggggcagttgaaaacacgtatgtgcaaaatgattccaaatctgagcagcaaagaaacagtggcataaccttttttttttttttggacaattgaaactggaatttaggtggtaaaaacagcactagtggagcagggcacaatgacacacgcctgtgatcccagcactttgggagaccaaggcagtggattgttcaggagttcaccatcctgggtgacatggtgagacattgtctctacaaaaaaatataaaaattagccgggcgtggtggcgtgagcctgtggtcccaactactctctggagcctgaggtgagaagatcacttaagcctggtaggtcaaggctgctctctatcctgggtgacagagtgagagcctgtctcaaaaaaaaaaaaaacacgaaacaaaccccagcactacttggcaggagagcttgtgattggcagaaaagagaagggaacgctctcacagctggcgaggacttggctcctgcctatagtccactttcagagcaaaagtagagccaccaggatgggcgttggtgtttccctctacagtgtgggtaacagggcaggccctgcgctcagtacccacattcccagctccactggacttccagctctgtgatcactggacacacttccagctgtgtgatcttggacaagttattctacctctctgggcattttttcatctataaaatggggaggcctgtggacagattccttgagcacaggagttggagaccagcctgagcaacatggtgaaaccctgtctctaccaaaaatacaaaaaagagaaagaaagaaagaaaaaagctgggcatggtagcatgcacctatggtcccagctactcagaaggctgaggtgggagaattgtttgagtccaggaggctaaggttgcagtgagctgagatcgcgccactgcactccaccctgggtgacagagggaaaccctgtctcaaaaaaaaagaaaatgcagaagcacagcctcctctatccttagttaactctcagtctacttggagaggtaaactatagataaaatagctaaaggacacgagcaaacatttaacactgcattaaggggaagccatggaaaggaacatttggaaccagctaggttagtgagtagtcagagaaagcctttaggagacacccaatgaggtcttgaaggaatagcttttcctaagaggagatcatgatacagagacaagtatcgttggaatgaacgatacttgtggagtggaactcatttggagagtgacagatctgaggaagttcctcttctgtgtggacagaggccaccccaggcctttgcttggctttttcttatccattagggtccgctgattctttcaccagcccctccggctgttctggcttggccttggccaaaagacagagcagtgagaccccaggaactgactgataagcaaagttaatcaagtgcctgtgtttctttcacaggactctgacaccaccataccaatggacgaatcactgcagtttaactcctccctccagaaagttcacaacggcatggatgacctcattttagatgggcacaatattttagatggactgaggacccagagactgaccttgaaggtggggtccctgctgggggacagagagaaggcctcttgttttagcctcatccaacagtttagtaactgtgtttatattttgattacgtgtcctcaaattgtgatattttgatgacaagacagagcccttgagtttgggatcctttctgttggagttgagttattgtgagcctgaaagtacccagttcctttgccagtgcttgaaacaaaccatgaagtggcctctcttaggatccaggtcttttcccatttactgaacttatcatgaaagtgagtgctactacgaggggtccaatcacaggctgagaaattgtgttacagaatctactcttggaagaatgaagacgtggctgtcctttggtacctcgctttaaggtggctttcccttaggacccctactgtggactgccttataactaaaaccttttgtattttagtaactgaatccccactgtgcagtgttagggctgcctggttgtttgcagtagattagagctttagaagcttctagagcttctaaagcccgtgctggtgatcccagcgactcttcactccctagccttaggtattcctagaagccctgaccagttggcactgctgagactccagcccctgggagtggtttacagaaacattacacagactctgatgtcagtcatgatgtttcagcctctgcccttttcctgtatcaaccctgatggataatagggcgtgggttctgtctgttatcagggtgtggtcccctgtgaatgaagcactcccagccactgagctgtgagaaacagtcactcggaagtgtgagctttatcttagtttttgttggatcatgttgagtctgtcagctccacaggacttcagtacgtttctgaacagtccctgccatctctacgggggagagggtcaggcaagctgcaagtgacactcacctcctgctgacagttgcagtgtctcagatggcctggaagggtggtctccagcagcctgctgggcgctcccctttcatgagagccacctgcagtgacctgaactgatacatgttgattagtctgccctttctttagaaaactgctactctccttttcatatctcagaaaaacagtagaggccttttaggaccaaactccatgtcacactgatgaagagccagtgggggttagagcgtcctgttaaggcacatgctagcttcccactcaagtctggcagcgctggggcatcagcacacctcttgccacccacactgataccagaggggaaggctgtgaggtggctgggggttgagacttgaggtttctaactttcctctgcacacctgtggctacctggtgtttgtctcttgattccctccacctgcctcacaccctgcctccgtcgggattttccacctacaccattcaaaaggaacataggagagggcatgaaggggctaggctgaagcactctgatgactggggccaatttgtggctgaaaatgaatacattttttgaaatttatggtcattttcaagtgatttagaaggttgatccttagcctcatacagtgatgaaataatctgtgtgttcagagccaagcaggactttagcaagagtctgattgtattgtcactatctcggggaaaaaaaaatacaaatacatttctctgatctctgatggcaatgaagtttgacttgtaatttctctggctgaggcttcttaattgctttctgggcagaatgtagattttggattcctgtccatgatgcctaatgttgatctcactttccttgtttctctcagttgctcattaatgtgtatttattaaaaaaaaaaaaaaaggatatggggcatgaggttagatgccatgcatataagttgcagtgggtgatatgtgctgagtgacttggggtctgccccggcattcacttatacttgtttcttactaagaaattgaatgtgctttaagctgaaaattagaaagcagtagggaaggacaggctggatggtttgggttgttggtttaggaataaaatgcccttttgttttggtggtgggtgatgccatctatagaagggttttaggtcattgtgttggtgtctttccgtctttcccacttgagaccctcttgtaaatatggacttgacccacccattgtactcagaagaaacctcaaagattgtactctacaaagtaaataggttggtatcaatgattattggaactagagagccgaggacaagttttttgatgttgccttctttttatagtataaaatattctaattttaagtatttttgttgagatataatttacagacagtaaggtatacagatcatatttttacaattcagtgaatttgggcaattgtatcagcctttgtaactcacactcccatcaaggcccggaccatttcacctctgaaagatccctcgtaccccttcccagtcagttgacccctctgccccaggcagccactgttgtgatttatttcaccatagatgaggttttcttgttattgaacttcatataaaggtattcatgctactcttttctatgtggcttcttcctcccagtatgtttccaaggttcattcatattgttacctatttaattccatgttggtagtcaggtactttttattgcaaagcagtattccattggtacaggtttaccatagtttgttcattcatcttgtgattagtgacaccattgttttcagtatgtatttatttatgtattttttgagacagggcctccttctgccacccaggctggagtgcagtggtgtgatcttggcttactgcagcctcgaactcctgggctcaagtggttctgtcaccttagcctcgcaagtagctagaaccacaggtgcacaccaccacacctggctaatttttttttgtagagaaggggtcttcactacgtgcccaggctgatctcgaaatcctggcctcaagtaatcctcccacccacccctcccagagtgctgggattacagggatgagtccctgcgcctggcctgtttgcagtttttagatattctcctgtgtttttttctagaagctttaattgtggctttagcttttatgtttaattctatgaaccatctcaaattaatttttatgtataatgtgaattgaggttcaatttttacacacatatctgtaagagagatacatatatataaaatacatacctgtgatattatatagtcagtcgttccagcaccatttgtggaaaagacttttctttccacttagcgttgctctggtaccttgatcaaaaatcagtcgacgacatgagagtggctctatttctggctgatattgctttctgtgtattctgggcatgaccaagagaatgtctgttggcaaagctccatctcctgatgccattcacccactcttggtaaagcgacttgatgtttgtttttttttctgttctcttctgccccaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacatagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcctacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagcc

SEQ ID NO: 15341 - DNA, 126254 bp, Human
  misc_feature (1)...(126254): n = A,T,C or G
tgcatatgaagaaatttaatcacaattttttttttttaatggggtctcactgtttcccaggctggtctcaaactcctggcctcaaagaatcctctggtcttggcctcccaaagtgctgggatgatgatgatgatgatgatgatgatgatgatgatgatttgagacggcagtttcgctcttgttgcccaggctggagtacaatggcatgatctcagctcattgcaacctccgcctctcgggttcaagcgattctcctgcctcagcctcctgaatagctggcattactggcgtctgtcaccatgcccggctactttcctatttttannnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttgagacagagtcttgctggttgcccaggctggagtacagtggcacgatctggactcactgcaacctccgcctcctgggttcaagtgattcttctgcctcagcctcccgagtagctgggactacaggcacgcgccacaccaggctaatttttgtatttttaataaagacggagtttcaccatattggccaggctggtctcaaactcctgacctcgtgatccgctcgccttggcctcccaaagtgctgggattacaggcgtgagccaccacgcctggcccacaattcttaaaagaataaataatactttgtccaaaagcaaaacaattacaacatgactttaaaacaaaaatgacttcaaccatttttatgaagaacaaaaaggaataagggtttggtttgcagaaggctcttttctggttcagacagctttgggttgcaagatgtgtggcacttcgaagccttaattgatacttatgtatcacctacacatacttctttgttaaatttgttcttttcatacagttgaattctaaagagaaaaccattgtctaaagcctgatgtttatgatttcttccatttcttctgtgccggttgtggcactataccagatactttaaagatgttatcattgatgttactaaggatttctggcattttttgaagacctttacatttacaagtgtagattagtgagtctaggattggtttcttaccatgttccttggtgtttagcaaagccgtcaacattgtgggaagtttgtgtagtggctgattaaactggaccatggactgcacgtgtttacacccttttctgcccaactttgagttggagggacagcattggaatgcagggcagcttgacccgttcggtcaacaagaatttcagcaatcttgatggccaaaaataaacttttcaagattcctgtctagatgggcgggaaagagactttggatatatcttgaggtctaatgtggggtgtgggccgagatgtcacaggtctctagggtgtttctcaggctgctgcctccgggtgcccatgacctcatcaccagtttcagccttggcagtcggcgccggtgaacgagagcaacgcttctgaccctgccggagctcctcggagatgaaagccatgacgcgccttgcagaaaatgcattccgccttccgtgggaacaacgccgaggcacgcggtgacagccgtgaccatgctgtttgcccagtgaaggaaacaactgtcgggtatcggctctgccggcctttccagccgcactcatgcatggggctcaccccatgatgtgcgtggcttgtcgaggagcaagtggacaagtctcttaaggaaagctttggtgcacaggcgctttctccttgggggcgaattctgccagaccttggataaaaacaaacaggaagactcgcacggcagcggaaactgtcttccaagttacttgggttacccggcttttccttccgcgcttggggtcgggaccccggccgctcgtcccgccccctcccccgccgcggccccgccccctccccgcctcgcctcgcctcgcctcgtccagccccgcccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaaggtgagcgcctccgcggccgccagggccagaccgggccgaccgtcgccgcccgcccaccggcatctggcccgcgtcccgccctccctcgctggcggctgtctgggccccggggcggcggggtgggcagggctggcgcggggccgcgggccgcgggccgcgggccgcggggagcccctcgggcgggggcggcgcgggccgcactgggggcggccggggagggggctgcgggcgcccggccgccgtactgggcaggtgcatagctgccggcgcctgtgcctggctgcggctcgctgagggcggggacacgcaacaggtccctcgcggagaaactcggctccagtgagggttcgggggctggaagccggctctcagcgggtcggggcttggggtgccacctcctgctggccgggagctgctgtctttggaggagtggttggtccccggcgaaaccctgtagtttcgatctgatgtcactccctgcggtatgcgcacgccagcgataaggctttgagactgcaaaacactccactcagcctgtgaggcgtagtaggtcgggttttctttcatgctgtattacttatttaaggtaactttgaaaataacctctttaacatttaataatttaacttgaattaaactttcacaagtaatacaaagtattcctacgaatggacaataagatgagcacttaaaaattagtaaaggccggtgagttcagccgaaaaaagtaacgtttttcctgttacttttcctatgtgctctgaaatattattgcattttcccattgctttgaaactaacttgtgtattacattaaaaagccaaagttcctgaaaaacagctaggatgctcctcccattttgtatattaattttttcatcataaaatagtacttgttatttcaaacaaaggaatacagaaatgtgaggagtaaaaaatctcccctttaaagaatatcaattcattacttcaaatagtatcgagatacttgggcaggtagtggttttctgtgtgtatttttgtttgaaatgcttacccgtaacatctgggagcaggaatactatgcctctgaaacttttgaactctcacagaagcttgtttgctggctgggagaagctagcggttacacttattaatgaatagattgttttaagggatatagtattcttcgtttaagaaaaatttaacttgcaccttttgaccttacattgaggaagaacaatctaaaggtaaaacttgatccagagatttaggataaaaggcaacattttgctttggttttaaaataagctcccattatttgtcttttctggggctttctttcctaggaggaaaggctttgtttccgtattacacagaatgtcactttgttcctgaagtgtgatctctggtacttaatatgcaagacaacacactttttaagaggttatttcaagtatggagagaaatacgttttcaatggattgccacagtaaggtaggaggagtacttctcctgaattatagtattgagatttgtatggcatattgaaaagcatcactcgttaaatattacgttgtagggacttttttgcattgtaaacatttgcgagtaaagggcaagttgaaagcttttttttaagatgctgtattatggagccacttcagaattttatatagagcaaaacaggccataaatgaataagtgaaatgaaataatattcagtgacctgtttccgtaagtcacatttaatttttgaaggtgattaaaatgcttactaagagccaggctggactcagtgctttacatatgatgcgtttgttttccccaccctcctttcagtttggaaaaaaaaaaaaaaaaaggcaacattaatttggaagctcgctgttactgttttagcatgatagtttgggaaactcttgtctaataagccagtgcttttgattcggttttctttataatggttgaatagtttgtcatcctatgaatatgctgctgtttagattatctttgctttcttgatagacatttgtttccaggattttgttcttggaatagtagcctttttatatctgtacacatatattactgtatatcagattcttaaaaatggaattaccgaggcaaaggctatgtgcagtttaaattctgatatatactactaaatgtttctctaaaaagactacctagaaataaatataacaaatattggtgagctactggaatcttaatgaaggacataaagtgagatctgaataaacgagatgaaacaatgtattttctggatggagacagtcactgttgtagaatttactaattttccccaagtcagtgtcttctagtgttgtattgtagaaaacttgacatattgataagaaaacctacatgataaaatgatagcgacaaaattttggaaaaagaaggccgtatcaggaaacttgttagaaattcacagtcatttaaagcagcccgtcagttcaggaaccagggaggtccagaaacatctgtgcatttatgggcttttagtaattatgatcatcagtattattgcatgtcaggtattgttctaagtgctcaatttatttaattctcacagtaaccctatgaagtgaactattatctctactttttggtgaagaaattgaaacacagagatacgataacttttaagttcatttagccagcaaggtggaaaactacgaatatgtggtaaaaaataatattgtagactattggagaaagtggcttgttcaatgtatggtgctaggactattggttatccattttttaaaaatgttttctgcctcataggctaaaaaaaatcaaaggaaatctaaatgacaaagagcaataaaaattctaaaatagaagaaaatgtagaatactacttaaaaatatgtatgtacctagattgaaaagaatcctccgtgcatgatactaaagaagtaataaaggcgggtgggtcacttgaggtcaggagttcgaggccagcctggccaacatggtgaaaccccgtctctactaaaaatacaaaaattagccgggcatggtggcgcgtgcctataatcccagctacttgggaagctaaggaaggagaattgcttgaacctggaaggcggaggttgcattgagctgagatcggggccactgcactacagcctgggcgacaaagtgagcttccgtctcaaaaacaaaaagtaatgaaggaaaaaacgtggccgggcgcggtgtaatcccagcactttgtgaggccaggaggggcggatcacgacgtcaggagttcaagaccagcctgaccaacatggtgaaaccccgtctctactaaaaatacaaaaaaaaaaaaaaaaaatagccgggcctggtggcgagcacctgtaatcccccctaatgggaaggctgaggcaggagaaacgcttgaacccgggagtcagaggttgcattgagccgagatcgcaccactgcactccatcctgggcgacagagcgagacgctgtctcaaataaataaataaaggaaaaaaacgttttttatatgtgtgataaacgtctgcgttcgcagtcagaattttgtttactggtgtatttgatttaagattattagaaagttgaaaaacaagaattagggtggttctctgcgtcaccaaagaattgtttaaatgtgtaagaaagtggtatgaatcattgttaagaaacgatttcattggttgaatcacagaaaagtggctgaaggaagtttcagtggcttctgtgttttcaagctgttttcctttggaggaagcaataaaatttaatttaagattgtgctattgtatatgcttattagattttgctgaatacttaaatgtttttgttaagtctcgggaatagtagtattgcccgctgtggctatctgaaattataatgtaagtatgaaaatgatttatgtcattttttactgttacactgatttacatgatacccaggaattgatttattgtatcaagtggagcacagtgggcttttttttttttaattaagttctgggatccatgtgcagaatgtgcacatttgttacataggtatacgtgtgccatggtggtttgctgcacctatgaacccatcatctaagttttaagccccacatgcattaggtatttttcctaaatgctttccctccctttccccccaccaccaacccgggtaacaggccccaggtcctggtgtgtgatgttcccctccctgtgtccatgtgttctcattgttcaactcccacttatgagtgagaacatgtggtgtttggttttctgttctggtgttagtttgctgaggatgatagcttccagcttcgtccgtgtccctgcaaaggacatgaactcattcttttttatggctgcatagtataccatggtgtatatatgtaccacattttctttatccaatctgtcattggtgggcatttgggttggttccatgtctttgctattgtaaatagtgctgcagtaaacatatgtgtgcatgtgtctttataggagaatgatttatattcctttgagtatatacccagtaatgggattactgggtcaaatggtatttctggttctaggtccttgaggaattgccatactatcttccacaatggttgaactaatttacattcccaccaacagtgtaaaagcgttcctatttctccacagcctcggcagcatctgttgtttcctgactttctaataatcaccattctgacgggtgtaagatggtatctcattgtggttttgatttgcatttctctaatgatcggtgatgatgagcattttttcatatgtttgttggccgcataaatacctccttttttttggcagcataaatgtcttcttttgagaagtgtctgttcatattctttgcccagtttttgatacggatatttgttttcttgtaaattagtttcacttccatgtggattctggatattagacctttgtcagatcagtagatggcaaaagtttttctcccattctgtaggttgcctgttcactctgatagtttcttttgctgtgcagaagctctttagtttaattagatcccatttgtcaattttagcttttgttgcaattgcttttggtgttttcatcatgaagtctttgcccatgcctatgtcctgaatggtattgcctaggttttcttttagggtttttatggttttgggttttacattgaagtctttaatccatcttgagttaatttgtgtatacagtgggcttttcttgatatcttaacgtttttgaaaccttaagagctgcagaaaatggccaagctaatgaacaaaaattaatgacaagagtcagtcattacatatagggattgtttcttgagtgagtgatgcagtgttttaattatgatagttactgatcaatgcatacttgcttcatactgttttaaaagtgaaaaactcactgtagtttgtgagaagtcactgaagtttggctgccaacttttaatgatcctcactgtagcaataatttttgtgtgtgtttggcattttagaccatcatggttaaagctttaatttatatagttggctgataatcctaactacattttacaactcttacatttgtttcaggacagcttcataagatagttatgtttcaaattgtggtgttcttcccccccaggttatatattggcacaaattacattatattattaggaaagacaccaatttgccagactcaagcatgtaatccctgcactttgggaggctgaggcgggcatatcacctgagggcgggacttcaagaccagcacaaccaacacggccgaaaccccgtctctactaaaaatacaaaaattagccgggtgtggtagcacatgcctaaaatcccagctacttgggaggctgaggcaggagaatcatttgaacccaggaagcagagtttgcagttgagccaaggttgcagtgagtcgagatagcaccactgcactcctgcctgggcaacagagtgagagtctgtctcaaaaaaaaaaaaggaaagacaccaataaataatgaggtggaaaccaatctgtggcttcgagggctgtaacgcagtatatgtagtactgcttcccgtttgatttgaaggaaaaaaagtacagtagttccactccctttttcccctccaatcctggaaacaaggtctggctctgacttttacttgctctttaatctcttttctgtttagagaccaaatgtaaactctgtacagttctaagaataaaactgtgtataaatatgatagatcaccatgctgctaaggaaaatgtctttaaaaataatagttttggtggaaaatttgaagacgtaatcctgttacttgacatacccctgatatgataaaaattcaccttactgaaagaccatgagtccagctgtaaattcatgtgtagtgccacccatctgtgactgctcagtcattgctcatttcaggcctgcctgaaagcattcacgtgctcagcattgtgtatgactgagcattatagtagctgaagacaagctagtggaatgagccagtcatttctaattagcaaagttttgatatgttaaataaaaagatagtttatgtctagaatgatcctcctggaatatttgactggaacttgctttgcacctctgaattttgaaagcaaatcttgaaaaacctttttactttaacaacttttagtcttgtagaaagaaatagacattaggatagtttacagattttaaagttaatcctataaaattggtgtgttgcagtatttcttgcataagccagcaataaaaataagacttttgctctctctgacctagagtgcatctttatttatttattgcagagaagagtggcttcaggttgctcctttatgggctagccaggtgctttatttccattcctcttaaacagataaattcttaataatgagcagtatgtggggaatacgtgggtagggagttttatcttatatcctaagcatggatgaaaataaatggactctgaatgattgcctttaccacaagaacacagctttagatcatgagaacaccaatgttaccaaactttgtactgtaaaacaccatttgaaatgtgataacaaaaccctgtcatatatgtagtgctcaatactgaatctcaggtggccctcactttgggatagatcaagagataaggttttattagtttgtgttgcggatatatttcagttgatatactgaaaatactgggaagtgagttaactggtgaatgatctcaattctagtttatcatgtccggaaaggaggtaaaacagaagctgatattactttctgtggattctaattaggaacataagattagcgtatacctggtttaattaattttttttgacttaccgaaatattttttcctttttaaaaaaatgtaaattcccaaagactgaaaagttcatttttcttcttggttatcttaggaattttcacgcttttggaattgtcattatcttggagattgtacaacagtttctggtaactgaatatcaccagttaaacttaatataagattagctcacttaatttagtatgtaattttaaaattcaggaggataccagtaatgactaattctttttgttagcttaacacatattaaatgagtacattttgtttgggatcccgatcctagaaatttacagttttcaactgctatacgctgtaatgatcactttgtgaattgtgtaactcattgttgaagaaacaaaggatttgcattgtttactcttaaaaatacgagcaaacttatggtcatcctgtaataacagagcattcttgtgtgctttcttcgttggaggaggtgacaaagtcattttctaaacctgggcttgctgtttagcagagtttctgtatttttccttgttaatgtttttaaatgtttgaattgaatctggatacattgatgtaagtgttttctgcatatgtttggtatcaatatctcaataggagggagacattaagaattataaagtaattggcttatatgcttaacagctccttgaatatactgacaaggcaaatgaacactatactagctgttactgttacatttagggttcaagaagctgtgaaatatgtaacaatttggattcctaaagcggaattttacattcagcagatatttgttggttacctcgtgtgtaccaatcactgttgtaggtgctggagatgcagcagtgaacacatctctgtactgatagggcattttaatggtgcgggtagagagcagcaaataaaattctgtccataatgataagtgctagaatccctaacatgccttttctgggtcatatcctcccttcttcaaagattgcatgtatcttgtcttctaggtttctcattttctagtttttctttatagttaccacctaattatgcattctgaaagcactagttttgactctctgaactttgcgcatacagaatcttctagtgtgaattctgttgtatatggcttcttttgctcagcattatgtttgtaagattatgttgtggagaactgtagctcattagttttcattcagttcttgtacttcatggtattccattgtatgaggactttattggtttcgggagaaaatagtttcagttagacttctgtggctttttggagaaaaatattgtatatgtctgtctgaggggcaagaattagatatgcattatgaggcagtcattggagtaccaacagctgagcaaaaggtagtaagcttcttttggtgttcctatgattatcttgaaaaatcaagttggtcttagtttggaggatattttatgactaagatgtttgtcatactaaagtatgttttagtagtaagtattgaagtatgttttagtagtaagatatccacttacctgactgatcagaccaccaaaagccacaatcaggggaaatacatgaatctggcaaaaatgagtctgcctttcaaaatataattgtggaagtttttcctggtaatgtcatataaaggtactaaggaaggtttatttactgattttttttttctaacagtggcagttattggagtattaatacttactggagtgttaatacagaagtacactattttgatgctgtatcacctataaaaatcaagtcagtagccatggcaagtaggcttacattttagttataagtgtgagaaatatgtgtcaaaacaaacagtagccccttatattgcatgctgactctgtgacagatactgagctaagtgttttatgtgcattatcccatttaatcttcacaattctgttagatactacgattatctctgtttttacaggtgaaggatctgaggttaaatttacttgccataggtaatcatacatctacttacatgttctataagtcatacattcacatccttttatgttcgtgtgttgtaagagagcaccagggagaagagtatgggatggtgttaggtaagtcttagaccagaaaagcagcatgaatcatgaaagccagaagagagggcactgctccatcagagcacaagccagtttgtctaaaggaagcagctcttgctcagccccagctgattgttttcttggaagaagacaggccagatctcccagtttttcaagaggttgcaaatccggattttcatgtaagttaccctgacttaagtcttgctagttgacttagttttttatatctttttattgtgaaatatattgccatgtgtacaaaagtacataaagcaaatgtacattaatggattattataaagtgaacacccgtgtaaacaccattcacctgtcagcaggccagatcctgcacagagaggtcaagtaaaataaggactgaaaagattatcaccgagcaactcttaagttttacttatatgtgagtttagcctctggaatctgaatcctgagtctgccactaaatggctgttttctcatctgtacacaaaatgcaaatgtaaaaatgcaaacaagacccatctcagagtgattgtgggctcagcacatactaagctattatgttagctgtgtcttctaaaaacattttaagtgaagcctattttaatatcagagaggaggcatataggaattttatttatttacttgtttatttatggacaaaggttggcctgtagattatttaagacattcattcattcattcattcattcattcattttggacagagatcagcctgtaggttagtagttttcagcccagcaagatgttttgtggtttcagaaggaggattcatttatttatttctggacaaagatcaatcagcctgtaggttagtagtttcagcccagcaagatgttttatggtttcagaggaaggttccttgggttcctgagatacttttgaaaaaattattacaatggcattagataagagatacagtccttagtctgatggattaggcaatagagttgaaagactattccaaatccagggtacctggctcaatttggatgtctacctagtatggtgaatggttgattagcaagttctattcagctttgatttgctgagcacctcaggtctttctacttgttttatccgtactttcaaccatttacattctcccctcccaccacccccccacccccacccaagtaatcctccctctggattcctgtaatagcctcctaagtatcatacccccctcttccccttacaatctgtttttctgaaataatcttttcaaaatccaggtttgattagttttccgctctcccccgccccgctacacacacatgcgaacactcatcctaaaattcctaggctgcttaactacctttagagtaaaagatcaaaatccttaatatggtcagtaagctcctagtggattatttggcccctgcctacccctctagccacatcgtatctttttcctccttgtttcttgttctcaaactgtgctttcctctttttggttcctagcaagtgtacttcctgtcaactttctctttgagttcctcatggcactgtttttccttctttcatagtacttatttaactttgtgactatatatttagccatggagtttttcgatcatttggttctcctgctagactgtaagctccttgagaacaaaggtcatactagttgtgtccagttattcgtgtagtttaacacagtgtctagtacataggaaactctcaaaacattatttgaatgaatgagagatgcactttcctacactaggctcttgcacgtgctgttttttctacccggaaaccttgccacctccatctttcatgcacctcatagctgtctcttctcctcaaggactttgcccagagcccagaaactaggtcaaaactctgtgctttaaactctgtgtacccctttatagcacttatgataacctgtacttagttctctgctattatttgattagtatctgttaccccttctagacaagagttgccttttcaatgctgttaactcacttactggtaatgttagaccaccttaaattcagcttagcagcagaaggaaggtactaatccatctccaggactagttgcatttttcttactattctgaaaggggaggggaagcagttgctggaatagccagctcatggaaatactacttaatatcctggcatcatggtagctgcattcttggtttgggtctttcctaaatcagtaattaatttctagtcccctcaagttaccttcttttaagtggaaaattttcaaacctatagaaaagtggatgtggggaatataatgaattcccacattactgtcacccagtatggttaacaacttacagccagtctcatttcatctatacttcattcattgtgtcttctcttccccattattttgaagcaaatgccagatatcttttcatctgttagtacatagtgaacatcccaaatctgaaatgcttcaaaatccagtactttttgagcactgacataatgctcaaagaaaattctctttggagcatttcagatttcagatttttggattttggatggttcaccctgaaatcggaaacacgtggtttgaagcatttcagagaagagatagaatggaatactcaacatgtgtctgaatatatatctctaaaagatgtcttttttaaaagtactataactacattatcattagcacacttttaaaataaactccaaatcaagtacttaagtgtttggttttttttttttaagacggagtttcgctcctggttgcccaggctggagtgcaatggcatgaccttggctcactgtaacgtctgcctccctggttcaagggattctcctgcctcagcctcctgagtagctgggattgcaggcatctgccaccatgcctggctaattttttgtatttttagtagagacggggtttcaccgtgttggccagcctggtctcgaactcctgacttcaggcgatccacccccgttggcctcccaagtgctgagattacaggtatgagccaccgcgcccagccatgtttagtgttttctaattgtgttaaatgtcaactttccttgatgaggtcctcttactgtgattgtttaacatttctcttaggcatatgaggtcccccatttctgtctctctctttcccctcttcccttgcagctttattggttgagaaacaggattatttgtagaaattttaacagtatgaattttggtatttgcttccttgtggtgattacaatggtggttggcccactgtatttcctgtaaattggttaactgtagctagagcaattctgtctaatgtagtagccacaccaaaactttaaggtaaaattaattttcatgttttatttaacacacatatccaaaatattaccattttagcatgcaatgatataaaattataggtgagatattttaaattattttccatattcagtctctgaatactgttgcatgtatattttacatatcatgtatattttgcacatagcatatcataatacatatcacatatttcgtatcatatatatattttacatataccatgtctcagtttggactacccacattttaagtgctgagtagccccatgtggctggtggctactgtactggatagcacagatctagagccttgatcagattcagatttgatttttttgtttgtttttacagttctacttcataagtggcattcggtcccagggttttttctgttgtttttggatgatgtctgcagccattgatgatcagtgtgtagatcccttaattcactaggtgttacaaaatgatgatattcaatttttattattcctttttcattggttagctggagtgcttctaaaaaaagaaactctccttcatctactattttgatcgcccactggtactgtttgtataggaaagacagagtaaatatcttattctttccctatacgtaccagtttctcaaaataatgagttctgccagcacttatcattttttaaaatcactgtgggcatatggatggatggaagcatatttgatttattttaatccattgcagtcaaattacttacagttctgtcaggttactttattttgaatttttaaataacataatacattaggcaaatcataggtgtacacagattgatatattttcaaagtgaatatgcctatttgcccacaactcagatcaaggaagaacatttactttacgtcccgaagctcccccacctccatcccttcgagttacttcatacacaaaggtaaccctgtcccaacttctaacagtgtagatcacttttccctgtttcttgtttatgtttttgttttaagacagtctcactgtgtcacccaggctggagtgcagtggtgcaatctcggctcactgcaaactccacctcctgggttcaagtgattctcgtgcctcagcctcccaagtagctgggattacaggcatgtgcccccatgcctggctaatttttgtatttttagtagagacggggtttcaccaggttggccaggctgatcttgaacatctggcctcaaatgatctgcctgcctcagcctccaaaagtgctgggattacaggtgtgagccaccatgcctggccacttttgcccattttttgtttcgtaattcagatgtgatgtttaccagttttcaaggattatgaaattcatgtgttcattgtaggatgtataaaaacttaaaatatacaactctgaaaccaagttttttttctgagtacgtaaatattttttccaaaattggtatctttctgcatttttctataccattataacttttttaaactttttattttaaaatattagatttatagaaaagttaaactcttctttagtgtggttacattctccatctgtaatatagttatgttcatttgttactgtttttattctgtttttgatttcctcccctcccctcatgtctttttggttttaatagtttaattttttgatctgtgaagggtaatgtcatgaaacaatactgtggtctaagaaagagagttatgcaaaaagatatactcagaggactgtcactctctcttcatctctgctatgccattcccttcctcctcctgtctacctgaataaattgtgagagatctttgtatctatcttcaacctttagaagatgctatacctaaaaatagttttatttttgataacttgaaagcactctagattttaagtttccaagaatatttgtaactgtccctactgagattttctcaatatttaatgtacacataatggtaacttttaagctgatgttctttcactcttactttatagctaatgtagcagcttatctgtgaacttaatgtttttagcagaccttcagctttgatcaaccagaaaattacaggttcactgtgtctgtctttccgactaatatttcctaatcatatccatctcatcatttgtttcctaaactgttaaccaagggatggacacagtgatacatttgtaaatttaaccagtgttgaatacagtggggtgttggatgctaaatttactaaatttctattgagacttttatcctatggttgctgccttcttattttgatcattattttaattcttatgtttcctgaatttttatcttctattcatgaagtttgttgaatccctgaatatcgttaggacccttcttcattttattttagagtgatcttttttactacctcctggacatttctattttgggaatttaaatgacggcccatcagatcagtccaaatatacatattttgccttaccttttaacatgtagcactattccctttgtacttcatttgtgttgcagtgatcacaatttgaaattatgtaattgaaacttcattgaagggcaggggtcatctgttttattcactgaaacctaccttgtccttctccttaagttcctggctcaacctcatctccatagatgatcttgctttcaatttggatggaaaaaagccaaaaagaccaaaacagaaacactttggagttcagaaggaatgagaagccgttcagtgtagcagctttgctcacagaaggaacttggagggttcacagagtgttcttaatacctttactattggttttcctaatggggaactgcatgtcatcaagaaagggtgttccttgaagatttgtggaaattttattattttatgatgtcagataaatgaggtgtattgatctaaaaaattgagggatcttaagctttggtgtattctctggacagtaagtagtgttttgtattagctccattggttttcatgtatcctcattgtctgcttcttctcaaattcctttggttgtccacagggttatcttagtccttgggtaattacatcttttccttttgacttcagcactgctacttggttgactactcaagagccattttgaactccacccacacttctcactaactttctaactggtttccctttctcaaatcattttcccattacagccttcaggatgaattcttatatcatttgatcgtcgaaaattctttagtgtcttccatttgagtttaaagtccttggcattatattataaagcctgttgtgatctggtacccttgcaccttctctccttttactctctccttgttccataaattgtacaacttagtcatatcaaagccagcgtcatgtgtagcatcacacaatcttgctgacatgctgtttcttctgaaacatctttctccacttttttcctggacatccttcaagcttgatgaactcaaaacgttgctgtctcagggaacagatctctgatcttcacagcagacacagtccttttgcatcttccataacagctcttatctatgtggtgcaaaagttatttattttggtgcaaaaagctcatatcttttgatgccattttaatggcaaaagctgcagttatttttgcaccaacctaaataccatttagtgttctcagctgcttctttgagcccctagggagggagagggacctttttttggcctccccaacacttaccatgtctgatacatgtttgttgaatgaatgaatgaatgaatgatacatggattggttttgaaattacagccataaggttagtaaaatttaactggctgtgtatttagataatgttaaggagttcttcatttggagtatactttatatcttctcttttggatttgttcttctcccagttataggctcatcctgtcttttcagttattgtgccctcctatctttccccattcagtaatcagtcctgaaggacagtgaaactgcctagaactgggatctgaagttttggcaggaagcccttcagagttggtgatctgagtagtgtctttgccagctggagcttagaacaaagaaactaaacaaactcttggcagattgtgaaatacagctttttgcttcttcagaaattgtgattctagtcagttgatgctgacttagaaatgtgcgcagaactcagaatccagcaaccatgaattgcagtcacttttgatgcctgcagtgcttcactaattattgaatttgtagcctgttcattggaattatagtctgatagaattttggagctagaaaagtcttttcatttgagataatttcacccatttccctaattgtgtaggtgaggaaaattaagatcacgtttctagttgatgatacctttcggctctggtctccttatgcctggtctagttcatttcctgttcaccagcatctgtctgagttactagggaatggtagtgctagaatcatgcttagaggagtaatacattttccccttggtctcctacaagcctaaatgtcttgaacctgagactggtaatttaccagaagctttttgtgcaagttatgcagttatcccttgtgcatgtttgaaatgagaaaatgacaagcaagtttacaataaggatattaagttttaaaaataatttgataagtaatagatgaatgtaattaaaagtacaaagggctcccagtgaaaagtgagactcctcctacctggttttcctttctccactccagaagccatgcgtttcttaggtattcttccaaaggaacctccacaccccttgcttttctaatgcatcaaaattctcagtcattagtgaacattttttctttatggaatgctcattaaaatagtggttaataaatttactggtactaaaaatgtctcatatcaattttagctttgatttctgagtgatttactagaaggatttcttagtttttcctcagcattttattatgatcactttcaaacacgtaacaagattgaaagcagtctgccatggttacctgaatcccaaccactaagattctaccattatcattttactgtatttgcattattacatatttacgtgtttgttcatccttccattcctcattcagaactcctcatcagtactgcctggttatataaacaaccatggatagaatttgctacttttgccacagaagcaaatgaaaggctagagaatggagagagatgacatggtccatcatttaaactaggaatatatttttctgttttttgttttttttttttaaagataaggagtggtaaaacatagtaactcacttatattatggattaagttggtttagtggctggtcaagagcctaaccacttcttttgatgtttcattctcaattactttcttctacataggtcttccttcagataaatcaagctataattgatgtttaacagagaagttttttgagatgtggacttttccagtcctccaaagaaaaactatattgattttgatgtggaatggtgagagcaattatgttttagtattttagtcttctcccttgtacaaagcaagtttctcttattgcactcctcctggagactgtacattaagaccttaatgtatagattgcttactaacaggagaataaacattttttataattaacaataagaacattaatcctcttaagcattatttgattttcctaaaagccaagtggaaaaacagatacagatgcttctcagctcacttagaacaatgtcctgattaaactcatcgtaagttgaaaatactttacgtcaaaaatgcatttaatacacccaacctacccagtatcataagcttagcccagcctaccttaaccatgctcagaacacttacattagtatatagttgggcaaaattatctaacacaaaagcttacttcacaataaagtgttgaatatctcatataatttcttgaatactgtagtggaaatgaaaaacaatggttgtatgggtaccatcgtaaagtcagaaaatcaagttgacccatcctaagtcagggactgtctgtattcgaaatgtcaaataggaatgagattttgtgaatatagtttaaaatacattgccagtttgttctgatggggaatggagaaaggaaagcaggaagataaaacacctgatagaaaaatgtcacccacagtccctttactttgaaggtgataaacaatgttaacattttgtttatcctttgagcctttattccctactaatgtttaaacaaaattaggataaccatgtacacgctgttttacaacctgctccccccttaatgttaaataaattttcccatttgattaacatcttcttacaaaatggaaaactgtgttcattaagaccttagagaggatgatgaactgtttcataccatagagtatgttatcaaagagagttaagtgcatgttatcacatcacttgccatttggactgataggaaaaagattaaaaaggcagtaaaacaatgtcactggttaatgaaatagatcaagaaaagatgaactgagagctatgcaagcagttctcattcttaatatcagctgagattggacaaactggcaactcttgcagatacttttatcatgtgtatgttagtgggactgttgatgtttagctgatttactcatactattgttgcttctcattgatggaagaatttttttttttagtgcattatcccggtcaatgtttgtttaaaaaaaaaaaaacagctttgtttccagtggaggtctcattaaagggaggttttggtgcacttcattggaagattgaaacaaatgctggtgaggttggcagttcttatctatgggagtgaacagagagatcctttctctctcctctcttattcatctggcaggataatctagttgctttgaatttagggaagcaggctttctttatagggacttactttctaaaatggcattaatcttcaattaaagtcgctgtgggaaaggagagaatgggcccatggcaccttggtaggcatattctcatgatgctaatgacagcagtaagagaaaacagacctcacttatgaaataggcatttatagtaatgggtgactagtgatctgagagtgtcatgcttagccttctccctttttactttaccttttgataactctgaagaatcttttttaaatttacttgtaaatacattttaggagtcccagtttcataaaatggtaacattaagagagactgaaatattttaagtctccaagagcaattaaccccatttaaaagaaatttattttgaattccttactgctaattccttagatcaaccttgtccaacccgtggttcacaggtcgcatgcggcccaacacaaattcgtaaattttcttacaacattatgagatttttttttttgtaattttttttttaagctcatcagctttcattagtgttagtgtattttatgtgtggcccaagacaattcttcttctttcaagtgtggcccagagaagccaaaagattggacacccctgccttagataataatttattttcggccgggcgcggtggctcacgcctgtaatcccagcactttgggaggccgaggtgggcggatcaggaggtcaggagatcgagaccatcccggctaaaacggtgaaaccccgtctgtactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaataataatttattttcctctctattgagaggctcatgacaggaggtaaaactgaagtacgctataatttgggcaggacctgtattggagctcttactgcttttattttatgatgattcttgggggagtttgggagattgttcttttttgtttttgtttcttgtgtgtatctacgtgtgtgatacatatactagaaaagctgttctttttcttttggttataaatgaagcttgagaagtaattctgtagcaaaactgaaactaggtagagtagtcatgtttgtgacgttaaagcagccatttgccaaacctattaatggttttatctgttttcctgtgacatgtatatttataattactgtgttcagaggcatttaactttcccttcgtttgtaaaacataagagatgcttttaaatgtttacgtgccattagatattttaagataataccgctccaacttttattcttttctaagtataaagttgcagaattagcttgaatactgatttcagcttgcatgaaatgaatatagagcagctgtccaaattaagttaaaaacaaaggaagttcctgtgtgtcgtttcctgtctcttaaaagcaaacaaaaaactttccataattattaaggtcctttcagagtgtctctaatattaactgtgaattttggtatttcagtgtgctgaattgttggatgttcttgctcaccttattaaggacattttcttaaaaggtaaatgatttgtttttcttttcctttatcagagcacagcaatggaggaaacagctatatgggaacaacatacagtgacgcttcacagggtaagtttgtgttgcagtaagtaatctgtgtataactcaggatactggcagctttgaaaacaatagaggaaagccagatgtcaggaagccagagggaggaggaaactttttctatattcttttgtttaaaattagagttacaataattttttattaaggtcaaaagtgagcatgattactttttcatatatccttttgagtatttgctgtttttattcctgacttaaaaagtgatttgcttttaaaattttgagtgatcagataaaagactctgtacattagtataaattattataaactgcttcaacctttctgagtatatatgcatccattgtgggagtgaagtttgaaattaaaccaggttgtatgcataataaaatcctaaaagatacttaattgatttcaaacatgttgacccaagctgttgcttaaacaattgcagatgcgagaagagagatgagtagtagtaagagatgagttcttacttggtgggactaagaactttgtccgaagtgagactgctatcaatttgaattctggttctgcctttctcttgctttagaaatggggaagtgattcagtcaccttcgaaaaccttggttttcacaagtttaaaatggaacaagttgacaccagttcatgctttaccaatttgtaaagttaagtgtctctcaaaattctctttcctctctttcaagagagctgaatctactgattactccctttcttagagaatgtatggaaagagagaatatttaaatactggccttgcactttacacttactatttctaccagctatatccattattaggaagatggaaaggggaaagaatcatgttgctggactctgcccctgattatctcacgaatgtttggatctgcacatagtagataatgggtaaattaattattaaaaaatagttgtttttggctgggtgtggtggctcacgcctgtaatcccagcactttgggaggctgaggcaggcagatcacgaggtcaggagattgagaccatcctggataacatggtgaaaccctgtctgtactaaaaatacaaaaaaattagccaggcgtggtggcgggtgcctgtagtcccagctactcgggaggctgaggcgggagaatggcgtgaacccaggaggcagagcttgcagtgagccgagatcatgccactgcactccagcctgggtgacagaggcgagactccctctcaaaaaaaaaaaaaaatttttttttctgataagatatagtcaactttttaatgtttcattattaaatggtgaaggaaatcattatctaatactaaccttaactttcataaacctgcaacatggccttcctttgtttgaaatgtattgataggtagcatatttaaatcagatacatatgattaaacatataaaataacttcttaccttatgactagtggcgatgtcaatgatttggtattttttttatcatattacatttatttttattaagacttttattgtttttattggtataatttacatacagtgaaattgacccttacagttctgagttttgacaagcatatacagtcatgtaaccaccacaattaaaatacaagacaacttcaatacaaaaactttctcttaacacctatttttaatcatcccggtcccctcacgtccacttaaccaatgatatggtttctttttgtacattcttgccttttctagaatgtcatgtaaatggactcatacaacatgtagccttttgaggctgacttcttacacttagcctaatgcatttgggatttctccatgatgttactctatcagtagtttctcttattgcatagtagcatttcattgtatgaatgtataattgtgtgttcgttctccagttgtggtatatttgtgttttgcagtttccattgattatgaacaaacctctagtgtacaggtttttgtatgaacataactttttatttcttttgggtaaatacttaggaaaagacttgctgtgggtcccatggtaattatttaagttttaaagaaatggtcaaattctctgtaccatctaacaccaccactggcagtgtataagagctcccgttgttgcgtatcctcatcagcacttgatatgggttgagcatcccagatctgaaatctaaaatgcaaaattcaaaacttttcgagtgatgacgtcatgtttaaaggaaatgctcattggaacattctgaattttggattttcagattatgggtgccgaactggtaagtataacgcaaatattcccaaatccaaaacatttgaaatctgaaacatttctggtcccaagcatttcaggtaaaggatactcaatccgtattgtcagatttagaaagaaaagaaaaaaaaaaaaacgctgggcacagtggctcacacctgtaatcccagcactttgggagggagaggctggtggattacccgaggccaggagtttgagaccagcctggccaacgtggtgaaaccccgtctactaaaaatacaaaaattagctggacgtggtggcaggcgcctgtagtcccagctacttggaggctgaggcaggagaatcacttgaacccagtagatggaggttgcaatgagccgagatcacgccattgcattccatcctgggcaacagagcaagaccaattgccattcagtgggtatctagcggtatcacacgtggttttagtttgcttatctctgaagattaatgatctcttgatgtgctcatttgttgtccatatatctttggtaaaatgtattcaaaccttttgcccatttttaattgggtttttcttattattgagattttataaaattgcggcaaaatacaacatagacttcacgtattcaagactgttgcccatttttaagctctatgttgcttgttttttagttgttgagttgcagtagtctttatatattttggatattaaccagttgttaaatatatgatttgcaaatatttttttcctttccatggattgcctttttactctgtgattattctttttggtacacagaagttactgagttttgagattttttttttttttttttaacgtattcaggatacagattctttatcaggtattattttgtaagtatttttttcccattctgtgatttgccttttctttctcttaatgacagtgtcttttgcagtacatgctttaagttttgataaagctctggccaggtgtagtggctcaagcctgtaaacccaacactttggtaggccaaggcagacaaattacttgaggccaggaatttgagaccagcctggccaacatggtgaaagcctgtctctactaaaaatacaaaaattagctgggagtgttggcatgtgcctgtagtcccagctactcgggaggctgaggcaggagaatcgcttgagcccaggaggcagaggttgcaatgaccctgacatcgtgccactgcactccagcatgggagacagagtaagactctgtctcaaaaggaaagaaagaaaaatttttgataaagtccagtttgttaatttttgcctttatcaatcatgtttttggttttgtatctcagaaatctttgccaaacccaaaatcaagaataatttttcctctgttttcctttaaaagttttatttcagttaaattctgtttgtgccatgagatacgggcagagagattttttttttttcatacagatgtccagtgtttattttgaagaagcattttgtttgaaagattatactttgtccgtttaattgcctttctcgctttgtcaaaaatcaattgaccatatatttctggactcccttgtctggtctgttgatctgtgtgtctgcctttttaccagttacttatgcatcgattactgtagctttatattaaacgtggaaatcaggtagggcaaatcctccaaatactttttaaaattattttggctattctagctcctttgcctttctgtataaattttagaataattttgtcaacttttatcttccttccctcaaagaaaataaaactgctgggattttattgggattgcatttgaatctacaaatcattggggataattaacattttaacaatattgaatattccaaactatgaatataatgttatctcctcattgttttatttctttaatgtattgtagtttttggcaaatagatcctgcacacatttttgttaggtttatagttaaatatctcatgtttcttggcgctattgtaaatagttttttttttttcatttcaatatttgattgttccttgttactgtgtagaaatgcaggtttttttttgtttttttttttatagcaaccttgcagtcttaaaattactagttgtaggaactttcttgtttagattcctgggtgttttcctatgtgtaggcagtcatgtcatctgtgtatagaggcagtttttttccctccttttgaatgctctttatttctttttcttgccttattgcactagtttggactttcaggatgttgttaattaggaatggtgagcaggcatacttaccttactcttaatactgggtaaaagctgtctttcaccagtaagtggttttttttttggttgatgccttttatcaggttaaggaagttcccttgtatttctattttgccatttgttagattgaggaagttcccttttatcttagtttactgagaggtggttgtttttaatcatgaatgaaagttgaatttttgtcagtgcttttttttgtgtgtgtatgactgggattatatgggttttcttcttaatctgttgatatggtggatttcttgttgtttgttgaacagccttgcattcctcagataaattctacttgattgtttacatgttatccattccagatgttgctggattgatttgctgatgttttgtgaagattcttgttttattggtcagtacttttttttaacattgtttatatctggttttggtatcatggaaaagctgtacctcaaaacaaggagttgggacgtgttccttccttttgtggtttctggtagagttcatgtacaattgattttatttttttcttaaatatttgttagaattcactagtagagttacctggtgctagagttttctttgtgggaagggttttcattacaaattcagtttctttaattttatataggaatattcaggttatgtattttttccttgttacagtttgttttgttttgttttgttttttggtagtctttttttttttttttgagacagagtcttgctgtatcacccaagctggagtgcagtggtaccatcatggctcactgcaacctctgcggttgaagcgattctcctgcctcagcctctcgagtagctgggactgtaagcatgcaccaccagcctggctagtttttgtgtttttagtagagccggtgtttcaccaggttggctgggctggtcttgaactcctgacctcaggcaatcctcccacctcagcctcccaaagtgctgggattacaggcgtgagccaccatgcctgactggtagtttgtgtctttcaaaatatttgtctttatcatgtaagttgttaaaattatgagtataacattgttcataatattcccttatttttaattttggatggttctataatgctgttttgttttgtttcattatttatattggtaatttgtgtcttatttcttggtcagtctggctagaggtttgacaattttattgatcttttcaaaatacctacttttgttttcagtgacattctttattctgttttctgtttcattgatttctgctcttattttaatattttcatccttttgtttaccttgagtttaagctcttttgatagttttttttactggaagcgagattattcattagagaccacagatgcaatttgctattaccacattacatcttttccttactaccttttcagttttttcaataagcaaaataacataagacacctttaaattagctaaagtatgtttccctttgtatgctcttgcttggttttgttaggaattcatgtgtaggaaaatactaaatgtatttgccacagacctgtgtctcattagctcagggaaagtgggaaagatcctcaatattaagaaaacagaatctgatttttctgaccttgttagaagtgtcataccaattcattgtggtaagtaatggctcaggcaagtctgttatgataatgccgttttagatgattaatgtaggttccattttgtacctggcttctttctgtgcctcagttatttttttgccatgagagggcagcccagaaaatgtcatcagaagatacattgagataagagaggtatataactcacaattcttcagttgttgaatatgctaactgttgtactaggaaaacagctgggtttcctctgagcctcatcacagagagactatgacaaaatcaaagtcctcaccagccatccctccaggaatggttttttggttgttttttgtttgtttttggttttttgaattaaaaaagaaatattttcagagcaagcagtaataaaagaaaagaaaaaaagaaaatcatcaaagaaaagcccaggacctgatggcttcactgctgaactctaccaaacatttaaagaagaattatatcacaaaagctaagaagagaatacttccaaattcattccaaagggccagtatttccctggtaccaaaaccagacaaagacgcaacaaaaaaagaaaactacaggccagtatctttgaacagagatgcaaaatccttaaaccaaattcaactacatatttaaaagatcattcattgtaatcaagtgggattcatcccagggatgcaaggatggttcaacatactctgatatggtttgtgtttgtgtccctgcccaaatcttacatttaattgtaatccccagtgttggaggaggggcctggtggaacgtgattggatcataggagtggagttctcatgaatggtttagccccatctccccttgctactatatagttagtgagttctcatgagatctgattgtttaaacctccctgctctctgtctctctcctactctggccatgtgtgttcccctgttgccttctgccctgattatgcatttcctgaggcctcaccagaagccaagcagatgctgtcatgcttgctgtacagcctgcagaatagtgagccaatgaactctttttttatataaattgcccagtctcaggtatttctttatagcaatgtgagaaccacctaatacatattcagatctgtaaatgcgatacatcacatcaaaagaatgaaggacataaccatatgtccatttctatagatgccaaaaaagtattcagtaaaattcagcatcccttcatgataaaaactcaactggatgtagaaggaacatgcctcaacacaataaaagccacagacagataaacccacagctagtatcatgaggggggaatctaaaagcctttcctgtaagatctggaagaaggcaaggaagcccactttcaccacctttcttcaacgtggtactggaagtcctagccagagcaattaaacaggagaagaaaagaaaaggcatccaaattggaaggaaaaatttagattacccttgtttgcagacaatagtatcttaaatttagaaaaacctaaggactctaccagaaaactgttagaactgaggtttagtaaaattgcaggatgcaaagtcagcatataaaaatcagcagcatttctgtatgccaagagcaaacaatctagaaaataaaccaagaaaataatcttatttccaatagctacaaataaaataaaataaaatacctaggaataaacttaaccaaagaagtgaaagatttctacaatgaaaactataaaacactgatgaaagatattgaagacggcaccaaaaagtggaaagatactccatggtcatggattcagtattgttggaatcagtgttgttaaaatgtccacactacccaaaggaatttacagattcattgcaacccttgtcaaaacaccaatgacattcttcacagaattatgttttagggttggaaaaacaatcctaaaatttttgtggaaccacaaagacccagagtaggcaaagcaatcctgggcaaaaagaacaaaactgaaggaatcacattacatacattatgtgacttcaaattatactccagagctatagcatggtgctggcataaaaacagacacagaccagtggaacagaatagagagcccagaaaaaaatccacacatttacctccaactcattttcaacaaagccactaagaacattggggaaaggacagtctgcaataaatggtgctgggaagactggacatccacatgcagaagaatgaaactggacccctatttcttgccgtatactaaaacaaatcaaaatggattaagcacctgaagttatgagactactagaagaaaacattgggaaacactaaaggtcattggtctgggctaaggtttcttgagtgtgacctccaaagaacaggcaaccacaacaaaatggacagtgggatcacatcaagctcaaagctgctgcacaacaaacagtcaacaaaatgaagaaacaacccacagaatgaagaaaatatttgcagactacccaactgatgagataataaccagaatatgtaaggagctgaaacaactcgataggaaaaagaaatccaatttaaaaatgggcaaaagatctgaagcacaagagctgaatagatgtttctcaggaagacatatgggtaaatggtcaacaggtatatgaaaaaatggtcaacatcactaatcagataaatactaatcgaaagtataatgaaatatttcatcccagttaaaatggcttttatcaaaaagacaggcaataacaaatgctagtgagcaggcagaaaaaagagaactcttatacgttgttgataggaatgtaaaccagtacagtcactatgaagaatagcatggaggccgggcatggtggctcacgcctgtaatcccagcactttgggaggccgaggtgggtgggtcatgaagtcaggacatcgagaccatcctggctaacacggtgaaaccagccgagcgtggtggtgggcgcctgtagtcccagctactcgcgaggctgaggcaggagaatggcgtgaacctgggaggtggagcttggagtgagcctagattgctgcactgcactccaacctgggcaacagtgccagactctgtctcaaaaaaaaaaaaaaaaaaaaaaaagaatattatggaggctcctcaaaaactgaaaatagagcaaccatatgatccagcatttccactgctgagtatatatcccaaagaaaggcctgggtgcggtggctcatgcctgtaatcccagcactttgggagggcaaggtgagcggatcacctgaggtcaggaattcaagatcagcctgaccaaaatggagaaatcccgtctctactaaaatacaaaaaattagccaaatgtggtggtgtgcacctgtagtcccagatactcaggaggctgaggcaggggaattgcttcaacccgggaggcagagattgcagtgagccgaaatcgcgccattgcactccagcctggtgacagagtgagactccgtccaaaaaaaaaggaaacgagtatatcaaagggataactgcactcccatgtttattgcagcattattcgtgatagccaagttatagtatcaacataagtgtacatcagttgatgaagggataaagaaaatgtaaatatgttccatggaatattagtcaaccataaaaaataatgaaatcctgtcatttgcaacaacataaatgagactggaggacattacgttaaatgaaataagccaggcacagaaagacgaataccacattttctcactcgtgggaactaaaaaaaaaaaaaaaaagaaaaatgaactcacggagacagagagtagaatgatggttaccagagaccgggaagggtggtagggaagtagggatggaagacttggttaatgggtgcaaaaatatggttagaaggagtaagatacagtgtttagtagcacaatagggcaactatcgttaatttattgtgtatttcacagtaactagaagagtggaattgaaatgttcgtaacagcaaagaaatgataaatacttgaggttatgaatatcccagttaccctgatttaatcgttacacattatacttgtatcaaaatgtattgatgtggatcccataaatatatacaactactgtttactataataattaaaaataaaaacatttttaaaatctttggacaatgaaaaagtcttgccagtgggagctgagttatgccaaagcataacttaattgacttcattctctgaggctacagaatggtactttcaactgtcttagttgtttggtgttctaagatgatgccgaataaaatttagactatctagagcaggatcagcaaagtatttatataaagagccagatagtaaataagtattttaggctttgcagaccataaatctctgtcaaaactactcaaccctgcagccgtattgtagaagcaaccatagacaacaggcaaacgaatgtggctgtattccaactgtgggccatagtgtgctgactgctgattagagcagtggctctccaggttttattgtaaagagggatcaactgcacagtccctgcccatcagagattcttactcagtttgtctgggctgggatccctaacacgtattttaaataggcttcagtttgaaatggagggctatggcctctggcatcccacttttaagaaacacagaggaatcagaaagcttgttctctctgaggtgagcaagtgggcttttggcagtggtagtaagtgaaggggataatttgaaactgtattcttttggcaataacctggagtatagatactctgtattgccaaataaagacaaatccatattctttgacatctgacagtcaattttatgaaagttggaggtaatgttataaaaaagccatttaattgatgagaacctaacattttctgctatttactgtctagaataatatatgcttcattctttcatttgtatttccagaagatattttcttcatcttatatttctagaaaccattgaaaccctattcattcttaaagactaagtaattttttagtgttctactgtatgccaagcactgttgtactcttgtgggccctggaattatatcagaaaaaaacaggcagaatttgcctcctcatggattctgatctctctactggtcctcagtgacagttgaatatgtacatcagatagttgtttaccccatctcctactacattataactttcacaagggttggaaatcttaagtccgttttctatctccttagtgcttggtacctagttctgccccaaaaaacttaattccctaggacactaaccatgtcgaataaagtcactcttgggaggtctacaacagcaccgcccagtagcagtataatataaaccacatatgtaaatttaaattttttagtcttcttattaaaaactgtaaaaaaaaagaaaaacaggtgaaactaactttataataggtcttatttagtatgcacaaaatatatttcaacatgtgataagtttaaaaattgatgagttgatcttacaaaattgttcacttttcaatgtcagcacctttcaggtaacactagccatttttgaagtgcttaatagtcacaagtctgatgcttatcgtattagtgtaggtgtgtagcttcagatggtaaccacatgtgttcacctctcctgctgctgtaacacacccacacctttttagttttcagatactcgcccttagaaaatgcatacatttttctaattctttgggaaatgaagtgaattcctcaggaatgagttgctcgtcgttactctgctttttcattttctaaaatagaattatgtaaaagattaaatatttgtatactaaagtattaaaagatgagtatagaaagcaaggaaactagtcaggtaattttaagggtgagccagtgagtgtttaaactagggaggtgattgcataagaggtaaacttgggatggggtgccaaggcaatgcactggagggaagaacagtcattaacagacccaggacagctggttaaccacatgcaaaataatgaatttggacccctacctcacaagatttacaaaaattaagtttaaatgaaccataggtgtaagtataagagcttaaactctaaacctctttgaagaaaacacagggataattattcgtgacctgggttaggcaatggtttattggatatgatgtcaaaagtataagcaacaaaagggaaaacagatacattggaccccatcaaaattagaaacttttgtgcttcaaaggacaccatcaagaaagtgagaagatattccacagaatgggaaaagatacttgcaaatcatacatctgataagggatttgtttctagaatatataaagaacttttataactgaacaataaaaagacaaatcagttgaaaaatagcaaatgatttgaatagatacttcctcaaagaagatgtatgaatgtgcaataaatgcatgaaaagatgttcagtatcattagccttcaaggaaatgtatatcaaaaagtatagtgaaataccccttcacacccactaggatggctgtactcagaaagacaataaaggttggcaaggatgtggagaaattaaaacctttgtacattgctgataggactgtaaaatggtgcagctgctgtagaaaacagtttgagaattcctcatagaattattatgggacatagcaattcctctcataggtatacacccaagagaaatgaaagcaaatgtctacataataagttacacatgagtgttaatggcaccattattcataatagatctggctatattagctgatgaataatgaataaacatgatatatacatagaatggaatattatttagcaataaaaagaaatgaagtactgatacatgccacaacattgatgaaccttgaaaacattatgctaactgaaagatgccagtcataaaagaacatatattatgtgattccatttataagaagtattcagaataggtgaatagagagttatattagtggttgatgaggctaggggattgagagatgatggctaaagaatgcggagtttctttttagggtggtgaaaatgttataaaattttgatggggtccaatgtatgtgttttctcttttgttgcttatacttttgacatcatattcagtaagctgttgcctaactcaggtcatgaagatttattcctgtgttttcttcaaagaggtttagagtttaagctcttatacttagacctatggttctttaaacttaatttttgtagatgttgtgaggtaggggtccaaattcattattttgcatgtggttaaccagctgtcctggcaccatctgtaaccagtgatggttacaactgtgtacatactaaaaaccattgaatcatacactttaaagagtgaatttatgatatatgaattatatatcagtaaagtgataaaaggaattttatcggtcaagcagctccaaactgctgtctgataaagtatttaagctgaagcaaacatgtaatctaagatacactccctttatctggtagaaggctattgtttgtacttagtacattataagtttttcagacccttcattatatttgtctgtgaagtaggtgttaaccatgtgaagtaaggtaagtctcagaaaggtctagtaaaatgccccttaagagcgagaacttgaacccaggtttggactcagcatacagtgctctttccatttatatgtcacgtttaatttacagtttttaaatgtggctggcacagtggctcacacctgtaattccagtactttgggaggccaaggcaggagcatcactctaggccaggagttcaagaccagtggaggcaacatagtgagaccctatctctacacacccccaaaaaatttagccaggcatggtcgtgtccacctgtagtcccagttacttcaggaggctgaggcgataggatcacttgaacccaggagtttgaggttacagtcagctgtgattgcaccactgcactccattctgggcaacagagtgagaccctgtctctaaaaaacaaaaagtttatggaacataatttctgaaattaagaactcatgtaattcacataaactaaacaaaggtctctctatacatgcaataaagtaaataaaataaagggtaggtaatttggcaatagaggagccaatgtttgtttagaacattggtggtgaggctaattttatagagaaaatgacagtcttaaagaaggggacttggaggtattctgtaagaagctggaaataagaaaatggaacaggaatgagaaatgaaaactatgatttgggtatcagaactaaaagaatgagagtaagaataaacaggaagacacacacaatttgactagccaagggacataactgttaaaaaaccgaatcaatctgacagtcatagaagattgaacagcattttgagaactaccaagttggtagaaaatctgcagtgcttggatcttgtgacttctaatctgtttgggcttaccactaactaattttgaaaaggcctttaaatctcttgggatccccatggaatcaaagtatattaaagttgataacattaaaatctctcttattcagatgagggaactcaaatctgtggaggtcttccataaggtcatgattggcaagtagtatagagacacacaggacccaggcctgctgacttcagctgtaagaagggagctggaacagacaattgctgaggctccatctggttttcaaattctgtgatctcagtggccactgtgaaaacaaatggctagaacaggttccattgaatgttcattgaaattccattgaaaggttaataggaagaataagaggagaaaagtaagactagaattagtgaggaaagttataattagcggattgtacaagcctaatatggaaaaatggaagaataaaataaaaggcaacaagtggaatccttaagtaggtaattgggcatattcaataggaacagagaggaatctttggagaataaattaagcagttatttctgaaacaggagcaactttcaggaatttttttttaaggaaccaagaaatactttaaccagtgggtgggcagaccttttgtgtgaaaggccagattgtaaatagcttgactttgtgcaccacaaggtccctgttggaactgttcagtgcaaaagcagtcataattatatgtaaaggaatgggcatggctagtgtccagtaaaacaggacacataactgaaaaaattccaggaccctgtttccaagttctaacataaattcagttgtctagccaggcgtagacatataaacacagaagttattgctgctcatggttgcttaaggtttcaaaagtttgaaatacggcaagtctttgatgctctttcttccatccccagaagctaaaagttatcctgtacattttctcatgtaaacatacttttaaaaatcaactgtcttggcagaactatacaatttttacgttgaagatagatgagaaaaaaatggcacattttccatttcttttgaaaaccccttgggaaggtaccatgatagtctcttagtaagtctaatacagagagcatattattgcctcagagtaatctacctctgtcaactttgattactggaaacagtaaaaatttttttttgcacatgctatcatttatttctctgttttaaaatggtttttaccatatctagatcatatagctgttacatcatttaaccctttaatcctcgtttaatcttggtgttataaataagtacagtatatatgtgatgcttatcaccagtcctatccatgtatctcgtcattttgattgtcagaatattattagattccttaggatgagatcataaagacaatatttcctgtgttcttgcatgttgactggtttatttgtgttttttgtacttgaaggtcagttgtgttgaatataaaatccttgactcggctgggtacggtgactcatgcctgtaatcccaacactttggaagccggggatggatcacctgaggtcaggagttcgagacaagcctggccaacacggcgaaaccccatctctactaaaaatacaaaaaaaaattagccaggcttggtggtgggcacctgtaatcccagctacttgggaggctgaggcaggagaatcacttgaacccgggaggcagaggttgcagtgagccgagatcaagccattgcattccagcctggaggagaagagcgaaactctgtctcaaaagaaaaaaaaaatccttgagttgctatttcttttttcttaaaatttagtcatttaaatatatttttggtattagtcctcctgagttgatattctcagataactcacatatttacagtgatgtaaactctttcagtacctagtttcaattttttcaaaaatagtatcagcgaagttttttttgttttttaaactaatttttctcttcccttcttttgatttgcttctttagggactcctactgttcatatatatcatgctgcttttgcttgtctttagtgtttgtaatgttcctcaaatcctttttataaaatctctggcgttcttttttttaaaaatgttatttgtttatttaaaaactttcattttaggttcagggtacatgtgtagatttgttatgtaggtaaacttgtgtcacaggggtttgttgtacagattattttgtcacctagtactaagcctagtaccgaatagttactttctctgctcctctcccacctcctaccctccaccctccggtagtccccagtgtgttgcctctgtgtccatgtgttctcataatttagctcccgcttataagtgagaacatgcagtgtttggttttctgttcctgtgttagtttgctaaggatgatggcctcccattccacccgtgttcttgcaaagcacatgatcttattcttttttatggctgcatagttatactacatttacttcatctagtctttcgttgatgggcatttaggttgattccacattttagctattgcgaatagtgctgcagtgaacatatacgtgcatgtgtctttatgatagaatgatttatattcctttgggtatatacccagtaatgggattgctggctcgaatggtagttttctttttagctctgaggaactgccatactgccttccccaacgtgtataagcagtcccttttccctgtagccttgccagcatctgttatttttttttgacttttttaaatattagccattctgacaggtgtgagatgatatctttgtgtttttgtttgtttctttgagatggagttttgctctttttgcccaggctggagtgcagtggcacaatcttggctcactgcaacctctgcctcccgggttcaaacgattctcctgcctcagcctcctgaatagctgggattacaggcatgcaccaccacgcctggctaatttttgtacttttagtagagatggggcttccccatgttagtcaggctggcctcgaacttctgacctcaggtaatccaccagcctcagcctcccaaagtgctggtattacaggagtgagccaccacacccggccgctcattgtggtttcagtttgcatttctctgatgattactgatgttgagcattttttcatatgattattggcaacgtgttttttttttttttttttgaaaagtgtctgttcttgtcctttgcccactttctaatgggggttgttttttttcttgtaaaattgtgtatagatgatggatattagacctttgtcagatgcatagtttgcagatgttttctcatattctgtaggttgtctgtttactcttttgatggtttcttttgctgtgcagaagctctttagtttaattagattccatttgtcaatttttgcttttgttgcagttgcttttggcatctttgtcatgcaatctttgccagttcctatgtccagaatggtattgcctgagttgtcttccagggtttttatagttttgggttttacattgatgtctttcatccattttgagttgatttctatgtatggtataaggaagggttccagtttcaatcttctgcatatggctagccagttatcccagcaccatttattgaataaggaatcctttccccattgcttgtttttgtcagctttgtcgaagatcagatggtcgtatgtgtggccttatttctgggctccctgttacgttccattggtctgtgtgtctgtctttgttacagtaccatgctgtttggttactgtagccctgtagtttagtttgaagctgggtaacctaatgcctccagctttgttctttttgcttaggattgtcttggctttttgagctcttttttggttccatatgaattgcattcctgatttggctcttggctgttgttggtttataagaatgctagtggtttttgtatattgattttgtatcctgaaactctgctgaagttattttatcagcttaaggagcttttgcactgagaccatgaggttttctagatacagaatcatgtcatctgcaaacagggtagtttaactttctctcttcctattcggatgccctttatttctttctcttacctaattgctctggccaggacttccagtactgtgttgaataggagtgatgagagagggcatccttgtcttgtgctggttctcaaggagaatgcttccagcttttgcccattcagtatgatgttggctgtaggtttgtcatatacagctcttactattttgaggtgtgttccttcaatttcaatgcctagtttattgagagttcttaagatgaagggagttgaagtttattgaaagccatttctgcatctattaagataatcacgtggtttttgtctttagttctgtttatgtaatgaatcacatttaatgatttgcatatgttgaaccaaccttgcatcccagggataaagcctacttgattgtggtggattagctttttaatatgctgctggattcagcttgctagtattttgttgaggatttttgcatcaatgtgtatcaaagataatttgcctgaagttttgttttttgtgtctttgccaggttttggtatcaggatgatgctgacctcatagaatgagttggggtattgttcctcctcttcagtttttgggaatagtttcagtagaaattgttccagctcttgtttgtacatgtagagcagctattaattcatttggtcctggggttttttttagttggtaggctatttactactgattcactttcggcgtttgttactggtatgttcagagattcagtttctcctggttcagtcttgggagggtgggtttgtccaggaatttatcagtttcttctagattttctagtttgtgtgcatggctgtgttcatagtattctctgatggttacttgtattcctgtggggtcagtggtatcccctttgtcctaattgtgtttatttggatcttctctcttctttgtctagctaatagtttatcttactgattttttttcaaaaatacaattcctgaattcgttggtcttttgaatggtgtttcgtgcctagctccttcagttcagctctttttgttattttttgtcttctgctagctctggagttggtttgctcttgttcctatagttctttttgttgtgatgttaggttgttaatgtatgtaatgttgttaatgtcgtatgtattgttgatttaatgttaggatgttaggttgatttcttttttactttttctcttaagatgttttttggtcttatattcctatctaaaatgaccttttaaaatttcagatttggtctcgaattcttcctcttcatttctacattttttctaattctttcatgtcttgtatcttcttgtgctaataacagttttaatcctctccctcttttaagccttctttcaggcatacttttattgtctgcagagatgttattctgctactcagtatccattatatagtaactttatgtagagcggaggtctccatcccccaggccacagagatgtacggatctttggcctgttaggaactgagccacacagcaggaggtgagtggcgggcaagtgagcaaagcttcacctgtatgtgcagccaccccccattgctctcattactgcctgagcgctgcctcctgtggcggcatcacattctcacaggagtgtgaaccctgttgtgagccatgcatgcaagggatctaggttgcacactccttatgagaatctaatgcctgatgatctgtcactgtctcccatcacccccagatgggaccatctagttgcaggaaaactagctcagggctcccactgattctacaatatggtgagttttgtgattatttcatcatatattacagtgtaatcataatagaaataaagtacacaataaatgtaatgtacttggattgtcccgaaaccatcccctccacctgccggtctgtggaaaaattgtcttcaaagaaaccaatccctggtgccaaagaggttgaggactgctggtatagagggtttgattctgatcgttttttctcatttttgcctgtaatttgtggtggtttttttttttttccttcgggaggtggcggggaggattttgtttgtttgtttgtttgtttgttttagaatatggcttcgttcacatgctaaggaagtctccatagctggttgtttatcccctcctcgttgcattttgcacttcaagggggatacattgaccccctagttttgttgtaaatgttgcacttggattcttggtttgttatgtagtcgactgcctgtttttattcaggaagattcattcatgcctactctcattgctgctaatttttccagaattctgtttttagtgctctaattagggctagtttaaaaaaagagtctctataaagggaaatagaattaaagttaaattgaataatcaatcaaatacttgttgaggttcactaacttcgtgaaccactttgtgtcaggcttctgcagggttgcattgagttgaaagatgtatacgaatatattgaactagcaagccagtcactgcgatgacttgttttggcaaagagaaaagattttactcacaagactgccaaatgaggagatgggagaacaaatctcaaacccacctctccaaagatgggattttaaggatgtttttggaatagagtaccaaggttctccaaggtgtgggggagaaagattgggggtaaggaaaagtgagttagttaggatctgcatacatgtagtcaagttacacagctcttcatagaatgcatgtttgaaaaatggcagtatcaccatgatctgaggaaggaggttttggccctctgacatcaaacagtcacctctctttgggcattcatgcaggcccagttgaaggttcggtggtcttaatcagcttgaagtggacaagagctgccaactggttcctggaaataactttaagcaaccgttactgtagtgacccacattcggaagttatctgtaaggaagttcgtgggagatttgctatgtgacttgctagtggggagtttaaaatagatcaactagaagtaagcgatgaaaaagacaggttaagtttggcgggcttaatcaggttagccttcgattttaaatatgtgacttcctcccaaatagggccttgctaaccgaggatacttgtgctgtgtgttaagtagcacaagtgtgtacatgtgccccagcacatgtacaggatggaccacttctgtgaaagccaagggtagttttatgaatgaggtgacatggaacctgggttttgaaagatgagctgaagcttgcaagattgataaggtagtaaggaaatcctagggagagaggagatgttaagccatagtttgatattgcatgatctccctaagcaggaatcagtatttaggtgggtttagagcaaagactggggtgctgggaagcaagtttggagttgtattcaaaggcactgcatgctaaggaatttggacttggggcaaggatctattggattagggtctttgtgttagagggacagcactgccaacacttgtagtgcagtggaggtgagaaatctgttgaaagggccaaataagacaattatgaaggtagagggaagggaaagtggggaaaagttgaaccttttgaaatttttaatgaactgatcttatattcagaaaacattgaaagctgcagctctcgttcctggctgctcattagaatcacctgggggctatttttttttttttaagtccaccaactcctcttctccatttttacttaattggtatagattgaggatcatgcatcagcaagcagttttgaaattgttcccaagtgattcttacctgcagcctgggtaagaagtcgcagggctcctggatagtcattaagtgaactgtggtaagcactgatgtagcaggattacctgccctactaggtgccggaactgcatttacttgctcacaagtaatttttttaaatgtatgctcgcatccctgccttgcttattgaaagttcctaatgtttttggttttttttaatctttttatgtttttaacttttaaataaaagaggaaaataaaagaactaccaaacaagatgtaagttcatactgtaaaattacatagagtaatttttcaaattactaaattacaaagattagccccaacttctttgaaggagaaaaaaagggaaaggataatcgtttactaaggctggggtgtttaggtgttttcccagcattttgcaattacaaacagtctgcaatgaataaccttgtgcgtttgttacttttgtattgtgagagaggtatgtgtatctttagggtactttctagaagttagtttgctctgtcaaaagatagtacatttgtagttttgttaggttactgccaaattcctctcctgaaagttgtagcaatttgtgtgcccatcagtagtagactgtttgctatagcctcccttttctgaaatatgttatactttaatgtttctgttcttggtgttctttggttttaatttgcatttatctgtgggttttaacatctcatatatcttttgtaaattgtttcattgttttatttatttatttatttttctcccttcatgtttaagtagttcttaatatcgacattttcaaagtatggtctgtggactcctaaaggtccctgaaacctttttaggttcaagggcaaaactctttttattcaatatgaaggtatttcttatcttcttcgctgtgtaattatttgactgaaggttcagaaacaatggcggttaaaactgtgggctttgtagcccaaatcaaggcaggggcaccaaaccgtataatagtcattgtcacacactcgtagattaaaagaacaatttcagttttatttaagaatgacttgaaacagtaagaactgtgtcttgttactttccaacccttgaatacacacgttttcagtagtctaggtatgcaaacaggaagtgtgcctaaagtacttctgccttgtactaaagtacttgtgtgattatttgaattgcagccgtgtattgagtggggggggtggaaggcaggcatcacttttacttgaacaattgtttacttgaaggaatgtatggttatccaaacttgaatatttgacaaacatatttctccaaaatgaatgagtaccttgcttcaaggagaacaattcttgatagtatttgttgctaacaatgaaaactgatttttaaaacaaaatttaaaatttgagaaatttttatctgccaccataagctcagtagcttttcagtacttaaagactcttttgataaccttgatagtgatattaacacatgattttaaaatacactgtgtggtgaaatgtggcatcatttggaagatttacctaactcagggaaccagtattttccgaaagactaaggcatgctatagtaaaattatacatggataaaatactcattcagagtgtaaaataggccaatagataattcatgcaacagtacagacagttgaatgatatggtttcaaactgtacattgttactctcctttaggaaactatcatttattaagtttttggcataaagtcaaacatgaattttcgtaattacctaaaaaggctactaaaataactcttctttttcaatgactgtatctgtgtatgaaaagctggattttctttgtgtactttaacaaaaagcaacatacttacagggtttgttacagtgccttttcacaaactttgttttctcttcagcggtgaaagtcaaattttgtcaaaggctttttcaggatcttggagataatcatataatttttttctctagatttattaataggatatattatgccagtggatttcctactaatcctgcattcctggaattaatccctttttcatggagtatttatgtagtgttggcctttgtttgcttatttttattttgtattttgcactgatacaaataaattatgttgagctgtaatattggggggttagtcattatcatggacagtcatcagctttcagtgtcagtattatacttgcttcataaaaagaatttagaagctttccttgatatcagtgttctgaaacaatatattgtactgaggctgtctggatattgcatgttttggcacaatttctctgggaaatcatttgcgcctggtgcctttttgtgggataattccctcataaattttgctgcttttttctccagaaattgggccgtttaagccttttatttataatagggtcaattttggccatctatatttcctcaggaattatgtttcctttaggttttcaaatttatttgaatttgttctgtagtgtcttatgttttctaatgctgttctaatagtcatttgtctctaattgtttatttttgaagttttagtcctgcttttaatttgaaatttggatattgtctttgaattatgatgagtgtatggttttgtgtacagtagtcccctctgagccatggggtgtatgttcccccagtggatgcctgaattcttggatagtatcaaacccagttttgctgttaattggagcacatttctgtgcctgtcttccactcacaagtttaatgccttttccatcttaaataagcacttaccatgcactgtggcgaaacccttgcaattttaggtgtgacagcaaaaccagcacaaattttgttttccttcacaatttcactaatagaagattccttctccctgtagatcttagtaacctcagcatatttttttttttttttctgtattaaatggaggactttcgccttctctcttgaaggaaacactacagattttctttggtataccgaattgccagcatcactactactgtactttggggtcatgattaagtaaaataagggtgacttgaacacaagcattgtgttacctctccacagttgatctcataactgacagctactgagtaactaatgggtggggagcccctatggcgtggagacactggacaaagggatgattcacatcttagatgggacgtagcaggatggcaaaatatttcatcacactgctcataacggtgtgcaatttaagtcttaccaattgtttatttctgaagttttccgtttaaaattttcacactgcagttgacctgaagtaactgaaagcaaagaacatgaaaccgaggataagggagaaccactgtagttggtctatttttgttctattaaattttgggagaatatatagagaaacagattcagatggttgccattatcttcagttactcagaaatttccctgttttattattttcttttttcatattaacttttttgtgttcgctttattgccatataattcacatgccaaacaattaaagtatgcagttcattggtttttagcgtgttccgagttgtgtgaccatcaccagagtccattttaaaacattttcattactggggaaaaaaaaaacacctcccattgaattatcaccccctccaatccctgtagccctagacaaccaccattcaggtttttgtctttatagatttgcctttctgagcattttatataaacggaataatagaatctattaacctttgtgactggtttcttcaccttagcatgatgttttcaaggttgattcatgttatactatgtatgagtacttcattcctttttacacacaatgtttcattgtatggatatatatcacgttttatccattcatcagttgatggacacttggaatagttggtatttattcatttttaagaagatttttttttttcttttgctacttctataggctttgggatgggaggaaaggtgatgtatgcactattcatggtgaaaatagtctcctctgttgcggactggaaagctgagggaggaagttgttacctttgtcctcaggcagtttgaattgtacagttttatacaaaaacatacatttctggcttaatgattctgtagccttaagaaaatgtatattgtctctttaaactactcttaagtacttcatatcctttctagggaatagtgatttctttgagattaggtaattttttaacaacctggaaaatattttgaattttttctataccggcctgtcctgagtcattgtggtaaagattcttggctctttcagaagtgcgtagcttattataatttagttttttaaaaaggtaattttacaatgttagttcaatatggctaatgtacaccttctattgtatagtgtgcacaaggcattatattctacagagatttttaggagttggcagaagttgttgaaagaagttgaaataactaatacttgattttcaaagcaattgatatttatgtaaaatgacaaagggtgtgtatgctggataagtctgtcatcttctaaatcagttgccaggatggctgatgatcacactgggctctgccagtctcctcaggacctcttctgatcaaaaataaagtcaggatctcagtgttaataatttttaattgtcttttggtttttaaagaacatgtatatagttggcgatttttaatattctgttatgtccagtagttattagagcatgcattcttgtacaaggataattctaataggtaaccatgcaggtgagtgtttatggatcacagatatattaagattgtaatttttatattttggcttctctagattgtagagtatgatataacaattatttttgtccttaatagcaatattttactgtaatttttactttaggctcctggatttggatttggaattgcaatatctggtggacgagataatcctcattttcagagtggggaaacgtcaatagtgatttcagatgtgctgaaaggaggaccagctgaaggacagctacagtaagagtgctgcttatcgtgggcactgtgcaacaagcagtgttcctctcctcaggcactggcgtactgtcttacactgtcttagtgattttgtcatattcacactccacctgtgccatgcttcatatatttttccttaaattaacatatattaagagggaaactggctaggtgtggtggctcactcctgtaatcctagcactttgggaggctgaggcagggggatcacttgagaccaggagtttgagaccagcctgggcaatgcagtgagatccccatctctacaaaagaagtttaaaaatcagctgggcatggtggcttgtgcctgcagtcccagctacttgggaggctgaggcaggagaatcccttgaacttaagaatctgaggctgcaatgagccatgattgcaccactgtactccagcccaagtgacagagcgagaccctgtctccaaagaaaataaaggaagctttatccctatgaaaattggaaagctagtatcactcactttaaatagaatgtgtaactgtaaaaatagtgaaaaagaaaatgtataactccttttgggtagaatctagccttcagaagcctcctccccaagtcttgccaccctttttattccctatgaagattagtaagataaagagaaacacaaaatacactagcaaaatagtggcactataattagaagaattaaaagagaattaaaagatgaaaaacttaaaagggagtaagttttccagctgtatgacttagtatcatttaatgccctgtaactgtactaccaagaatcatttcgtgtatgtgatatctgttcagtcttttggggaaatactttgttaatgacttaaaaaaattaaggacctgtggttagttacttgttaaacattctgcagagaaatctgaaagtaagtcagttgacattattttatcattgatctgaagagaaattaattaattggctcataattagattacattttagaagtacctatcttggaaatatcatcataaacttaccagaatgtttttctctaacatattattttgtgcccttttccccttagggaaaatgaccgagttgcaatggttaacggagtttcaatggataatgttgaacatgcttttgctgttcagcaactaaggaaaagtgggaaaaatgcaaaaattgtaagtatcttttctctgtaatttagtaaaggtaccccaactttattgttgatacatttctggtatttgaatttatccttcccatttaaggaaaactgaaacaatagttccaaagttatttgtttacacttgagtgtttcttctaacactggtgtggtatgtcactggtacgtgtattttctcagtttagataccaggatttttttcaattgaaaaaggaaaggggacagttaaatagttaccttttttttttttttttgagacggagtctcgctctgtcgcccaagctggagtgcagtggtacggtctcggctctctgcaaactccgcctcctaggttcacaccattctcctgcctcagcctcctgagtagctgggactacaggcgcttgacaccacgcccggctaattatttgtatttttagtagagacagggtttcaccgtgttagccaggatggtctcgatctcctgacctcgtgatctgcctgcctcggcctcccaaagtgctgggattacaagcatgagccaccacgcccggccaaatagttacctctttttggcttaatgtttcctcctcttttcctcctctacagtcacatgctacatgacaatgttttggtcaacaacagaccacatatctgacagtggttccataagattatagtactgtatttacctttaccgtgtttagatacacacatagttaccattgtgttacagtcgcttacagtattcagttcactaacatgctgtacaggcttgtaaccgaggagcaataggctatgccaagtagcctagatgtgtagtaggctataccatctgggtttgggaagataacgttctgtgatgttcacacaaagacagaattgcctgataattcacttctcataatagatatattatgttactgttctggatactgtaggcagctgtaaaacaatggtaagtatgtgtatgtctaaacatggaaaaagtacagtaaaaatatatagtggataaaaaaattatatgcctgtttagtgcacttactatgaatggagcttgcaggactggaagttgctctgagtgagtcagcgagtgagtggtgagtgaatgtgacatcttaggacattactgtacactactgtagactttgtaaacactgtacatttaggctgcactaaatttttaacgttttaatatttttaatgtatttaatattttataaatttataaaatttatttaagtcttctttcttcaataataaaccttagcttactgaaacttttttaacctataaactttctaactttttgactctcgtaataacaaacacgttgtacagctgtacaaaaatatttaaaattttttgggttctttttggtttttttcttttttttttgagacagagtctcactctgtcacccaggctggagtgcagtggcgcgatcttggctcactgcaagctcagcgtcccgagtagctgggactacaggcacccgccaccagagctaatttttttgtatttttagtggagacagggtttcaccatgttagccaggatggtgtcgatctcctgatggaggctgtctcgtgatccgccccgcctcggcctcccaaagtgcttggattacaggctgtgtttttttaagacacggtttcgctctgtcacccaggctagagtgcagtagcgtgatcttggctcaccgcaacctccgcctccctggtccaggtgattctcgtgcttcagccttgggattacaggcgaccgctaccaagcccgtattttgtatttttagtagagatggggttttgccatgttagccaggctggtattgaactccgggcctcaagtgatctgcctgcctccgcctcccaaagttctgggattacaggtaggaggcactgcacctagcctaaaattttttatttttcactttttaaacttttttagtaaaaactaagacacaagcacacacattagcctagggctacccaggatcagggtcatcagtgtcactgtcttccacctccacagtttgtcctagtgggaggtcttcaggggcagtaacacgcatggagccatcatctcctgtgacaataatgccttcttgtggaacacctcctgaaggacctacctgaggctgttttctcagttaacatgtagaaaaaaaaataagtagagggagtacactctgcagtaatgataaaaagtttagcatagtaaatacataaaccagtaacatagtcattatcaagtattatattctgtacatattgtatctgctacacttctattccactggcagcatagtagctttgtttacaccagcatcaccaccaacataagtactgcagtgcacccacgacattatgaccctgtggcgtccctaggtgataggagattttcagctccattgtgatattatggggcccctgcagtacgtgctgtccgttgttttacatggtgcatgactgtgtaggtatccacatggccatgcagcatttcactatgcatatatatttatccaacccactcattcacaggcatttcagtgtccagtccgcaagtatttttttaaaattcagctgcaaaaatcatcatattactacctacttgtttagttaatgtttagaataattttctaggagtggcttttcagagtcaaagggcctgaatgacttttgatgtatgtattgccagtttgtccttcagaaaatcaataggctattgagagttcagttttcaacaggtcttaaatctttgccaaactgataaactaaacaagtgtttcaaatgaaacattttaaatcacaagtggatttgatcctctcatggtgtatttactacccatttgttttttcatttacctgttcatgtcctttgcatttatatggtggtgatggtcatactagagtgttttctgtagtcagattattagccttttgtcatacatacctcatgtgttgttatcctctttgcttttgtgaatgcttgtaagttgtttgtgtttgttgttttgtatcattttattacaacattgaaatgttttcatttttattttgtcatgtctgtcagactttcattttattggttctgccttggtgtcatgcttccaaaagccttttaattgcaaaagcctctctgttgtatttttttctagtacttacatggcatcattttgttttattttacctttgagacttagttaagctaaactattttgaagtaggcattttttttcctaaatattttgattccaaatttttcatagtgttaaaatcgagcatagttgtcacacctactaattattattcatgtttataactgttgattcataagtagagaatcacaataggactggttacctttcaataagttaagcacctactagatgcaagcattgcattatatgtacagttaaatgcatggtaaggaacttctcaaaaaactcaaatcttagtgggctggataggtatacatactgataaccatataatgcacgtcatctcaggttgataggtcaggtacagtaggatcccaaagaggtggcgcactcttacaggaatgatagggaaagccttgagtgctcatctgctcaactttgtttttgtttattactagggaggaactgaagattaaaatactaataccaggtattgcttccaatataatatgttggaaattaaatagaagtgagatgtaaaagcaggcagctagcattaggaatgctttacagaaaatattaccctataaggacttcagctgtgggttgctccaataggagaagggcagcctttctctttcagttcataacagggcattggctgtcctccttttcacatgctggcctctgctgtttctcatccttgagcttcagcgttgtttcctcagaatggccctctgctcaggccctcatcctgatcctgaaccagtatctgataataatagtagtagtcataggaagcagtagtattaagtgtagagcagccctttgaagaagtttaggcacatagagaagagagaaaagatgataacatgcaggtgaatagcaagacagagaaatagaagattaattgggggagcttagtaggtagaggacagattttaggtaaataaagagattgaagtttcaggtaacctggagtatggtaattgatgaagaaaaaagtcttagaggtaggtagggatgagaatgagagctcaaatacaagggttttgttcatccagggagaagattgccttggtctttgagaccagaaggaaagaggaccaaataaatgagacactgaaaaaatttaggaggggaaatactgaaaaaatttaggaggggagggggagtaaaatggcactgatcttaaagcaggctgagtggctgggatcttgaagaatggttgtagaatacctacattagcgaattccacagagaggcaacaatatgtagatgaaaggattgctgaacaagagcaagacttctgtaaaatgaatttacagagggcctcatcagcaaagtgtggaagtgaaggtaataataggactggagtttgtcagggcagatgattgaggggtcaagaaaaagtcatttaaatatggcaacaggatgtctcatgcaaacttagggggaatgcgagtgaaaccaggatggaactgatgaactaagatgaaggaattggaaataagatagtgaaaagtttcagtagctcaaggtgtccgacatagaagacaaggagtgatacacaaggagatcctgtagaactacagtgaggtcaagtgtatactattgtgagaaggcaaagtgtagtccacagattacagggccattcagtcagcaggtgtaatacatgtagatcgtcagcttgcagagaatgaaggaaataagtggacaggcaatacagagccagttaccagaatcattgagaaaagaacgccagagggaagaatttgcacctagactgggagtacaaattgaagagatccagagactgaaagcagtttgtgttggtgaagtacggctgagttaattagctccaacatattattgaatgttagtgcggctatagaataaattatctcttagaggtctggggcaattgtgggctttgatattgatgcattctaaaatttttaaggaagcaagttgggcatggaagtttgctgtggttttggtagcacctagagtatatttgatggcattagagtacagtgctgtcctttttattcaaaccaccaacagttgttagtttccctgtaagcttgtgattattacaccaggaagatctttctgtgtgaagtaaataaagaggtttttaggcccactcgttcttatttgtgcttaaccagatctgtttatcaggagaacagaaaacacagcctttatggaaatgtattccttagaaatttgttgtagttgtttgtgtattgtttcttgctggttcatagttaatatgggatgagaagtgtaatattcctttctctttggaactgaacgtacatatatgaaaatcagtcaacttattttttaacctttttaacttgcagacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaaggtattctctgccaactcttgctgtttttttcacatgaaaatttaaaactaattttaatgagaagtacagttgctgtctcttcatgtctttgctttgttgtctttgtgtttgtgttctatcactgtaagtcaaatcctgttatggcaggcttcagggactgttcattttttctgttggaacagataacacttcaagtgaattgtccagggcttggcttttggatttgttgtgatgagaatagccaggtacaaattatgctaacaagaaatgtcacaccatcaccaaatggaaattcagtgtttttcttaactgttagtagtgtaatcatggagagaaatcttgggagtgttgttgttgttgttgtttttgttgttgttacaaggtctggctctgtcacccaggctggagtgcagtggcacaatctcagctccctgcaacctctgcttcccaggctcaagcagtcctcccacttcagcctccctggtagctggaagtacaagtacatgccaccatgtccagctaatttttttattttgggtagagacagggtttttgccgtgttgcccaagctgttctcaaattggtaagctcaggcaattcacctgcctcggcctcccacagtgctgggattataggcgggaagccactgtgccctgctgggacttcttccccctcactccagactgttttttttaaatggaggaatttaaggaaaggaaccccttatagagcatttctccataatgcagtacttctttgaagtttttgaaactgaaactcagctgctttccctcatgcctcattaaatttgataaaaaatggatctgactgtggcttgctcctcctgtgggcatgcatgactgatcattttgatataaagggtgttacagttggaatattatcaagacttactttgatctgctttaccacttggcatatctcctaggtggtattccatacccccattcagtgaagtctcagtgaagttgtcaacatttgctgtttttacttcactacttacccctcaatcctctctggtctggtatcttttccgctctgcccccaaaaatgttcacactaaatctagtggaagtttttcagtctctagcttgcttgccttttcagtatcatttcacatggttaaccactccttattttcaaaaataatgtcttctttggtagtactgtatctttctgtttttttcccccacctttctgtatcttttgcaagctcattctcctcaccctgccctttataacgttctgtcagtttctctcctagaatctttttttccacttaaggtaactttttttttcttttcctcaggttgaataacaattaatttaggcaatctcatctgctcccctgcttccagtcactgctgatgatggcagaacctctttctccagcccaaatctttacactcttgtgttccaactgttaggcatattcacttagatgttcctgtaggtccctgaaacacagcacatctcaaatgaaactcatctccctcttaaaatttttctttgtatttctcatgaagtattcagttgaatgtgtttctattgatccagtttctcaggccattcccagatgacatggtagttacccttgccttctctttttttcccatgcatgatgaatgtcctcactcctgaataccactcttatccatcccactctttctccactgcctccacccttttccaagccactgtcatctcttacatagactcatttggtctcataggttgtctcttggatccctttaagttgattctgcagatttcttcatagatcctctgtgacacttctgtcttactcttttgcccctttctttattagttctcagtctcagctacactagacttatgacttcattaggtccaccaggtttttttcttcattactttgatgcatttgttttgaacttttcagccgtcactcaccccatgcatcccctcccccacaaacatacccttcaggtttaggtctttcttaggtaaagttttaactttagtatatcttcctcagggcggccttctccttccccctagtaagtgaagaacccttgtgtttctgccctctgaactcaccgcatttgggattaccatgctaacatcctttttttcactgactgcaaattgccagagtgcaggaactatctcatttgctgctttctccctaatgcctggtacctagttcatatataccccaagaaatatttagaatgaacgaacaaactaatatacaagaaatattttggggtcatctgtgtaatggtcatttataagtgtttaatcttgaagaacagtcttttaaccaataccctatccttctgtgatgtaatgaccatatggatgactgcctcattccttgcccagatatcctaaaaggccgttttcttcaccctgattctatttctggctgtgagtactctttgtatatttgtcttaagttaaactgtaattctgatgtaatttttttttttttttttttgagacggagtctcactctctctctcaggcttggagtgcagtggcacaatctcagttcactgcaacctctgcctcccaggttcaagcagttctcctccctcagcctcccaagtagctgggattataggtgtgcaccaccatgcccagctaattttttgtatttttaatagagacggttttaccatgctagccaggctggtctcgaactcctgaccttgtggtccgcccgccttggcctcccaaagtgctggaattacaggcatgagccaccatgcccagcctactcttatgtaatttttaaacacttaggtaataggtctgttaatttatcccatgttaaaacagttttctgttttccatcttggtttttgattttgtttttaatgcagtaagactctcctcacagaaccaggggcaatccttttactattgacattatattgatagttgtagtcattgttcttatttttcttaaaatatgtttttctgcagctgttgcaggaacctgggcagttctctggactctgctagtaatttcctcaacttccaacattccttacccacagacggagtgatgttctcactcttggatactttgttggttgtttaaaggaaaggattggcattataactcctgcccacatctgcctggctggttgtaagcctttgcactcatgcttagtacatgctagtactctgagtatgtctatccagtgtcatggggtgtataggatcagaaatatttttggtctaggagctgggaaaaatagaagtagtatatgcatgataatagtcatcaataaaatggtcaatcttttcaaagtttttcaaacctcaagcagtttactctttagaattatatctctagccaggcatagtgtgacacatgtctgttagtcccagctactctggagcctgaggcaggagggttttttggccccaggaattcaagtccagcctgggcaacatagtgagaccctgtctcttaaagaaaattgtattccttaatcattctgaagagctagtgtatcaatgcttggtcaaaaagaaatggtgtcctcttggggattttctccttttcagtaatatgggaacacggtctatcagtccttcgtttgaaccatacactttcccttggctttcacggagacattgcagacttgctaattagagggaatgtcttatttgcaggatggccaagaaatatttcttgttattgattgtacttgaaaactctatgcagtagttaattagtttagttgtatacttgtaaaatctatttaggtgtcttaggatgttatactaaaaacacttacttacattatttcagaatatggtcttcgattggcaagccatatatttgttaaggaaatttcacaagatagtttggcagcaagagatggcaatattcaagaaggtgatgttgtattgaaggtataatcatattcttactttttaatgaactgaaatagaaaacaagttctagagttaccatgtagtctgtgctcttgtttgaagcagttttgccaaagagaattaaaaatcagtgtttgggggagagggatataaattccctttatgcattattacatgtcgacaccaatgctttaggtatcacagggtcatcctgagataattattcacaggccggtactactttgtagatagatatgtctgttcttacacattaaaaagttctgataattgcttccagatactattgaaatgcttatttattcgtttgtttataagtaatagaaagtgacagcctcaaagaaggagttaggggatgctactatgggtttttctgacagcaacagtacagtaaagattttatcatctcaagaaggtggaatactttgacagtttggaaaagtgtagagagaatattttggttttcatagcaaggagtggtttggatatttctgtttataacaaactaagttaacatttgtattttattatttactttcaagctgtaatttattttctgttgcagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacggtgagtgtgattctgtttgaacgttccctctaagtgacctattttcttaaaatactagggagattgaacatctttgaatgaaatgataattttctaccagccaaacaccttcaaaatctataagttttatatacattttttcctgtagacaactcaccactattgatatgattgctggcaggtgaaattaatgcataaatcttccattttatatataattttacttactagcttatcttcattattactggagtaccttatacttgactgtaattatttttgtgggaaaataagtagcacccttttattaacagacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcaggtaagacaccctatttttttaaaaaatacaggggttttgtttgcttgataccagtatctgaaattgcttacaaataaaattaaaagatgtatttcttttgattattcaagattagatctgtttttctcaacttagacattttttaaatctaaaataaccgcaaactttcccttaaagggccagatagtaaacatatttcaatcatgcaggccatatagttcttttcactgctcaactgcaaaagcaaccatagacaatgtgtaaatgaatgggcatgactatgttcccataaaactttatttacaaaagcggttgatccgcagctgcagtttgtcatactattgcattagaagatgctagcaagcttcagaaatctactgcttgggaaagttaactacagaagtcctttaataaacacattaacctggactttgttttctcttttaaaaatacactagtgttggccgggcgcggtggctcacacctgtaatcccagcactttgggaggccgaggcaggcggatcacttgaggccaggagatcaagaccagcctggccgacatggtgaaactctgtctctactaaaaatacaaaaattagccaggtagtgttggcacatgcttgtaatcccagctactcgggaggctgagacatgagaattgcttgaacctgggaagcggaggttgcagtgagccgagatcgcaccactgcactccagccttggtgacagagcggaactctttctcaaaaacaaaacaaaacactagtatttatgccaaaggttctggtatactggtagtatatgacctacctgagtttatctttctttagagtcacacgtacatttgagaatctgaagaaaattatgatccttctctccagaaaaatgtgcatgtgcacatacacgcagcaattgcatacaatttctggagactcccaaggctctataggccaccacctgacccatggttaactgcagtccacatgaagatcacttgaaacatgagtccagggctgaagagacagtttagaagaaaagggaacccttatacgttgttgatgagaatgtaattgatacggccattctggaaaacagtatggaggttcctcaaaaaattaaaaccagaacgaactagcacatgatccagcaattccacttctgggtacatatccaaaggaaatgaaatcactgtctcgaagagatatctgcactctcatgtttgttgcagcattattcacaatagccaaggtatggagtcaacctgaatgtcgaacacatgaatggataaagaaaatgttcacacacacaatgaaatgtgatttagcctttaaaaagaaggaaatcctgccatttggaacaacatggatgaacctggagggcattgtgctaagtgaaataaaccagacacagaaagacaaacactgcatgacctcacttactgtggaacctaagcaagttgaactcatagaaacagacagtagaatggtggttaccaggggttaggggtggggaggaatggggagatgtttgttaaagggtacacagtttcaattataagatgagtaagttctggagacctaatttacagtgtagtgacaagagttaataacgtatacttgaaatttgctaagagagtagatcttaaggcattcttttgacacacactaagaaaagtaactatgaggtatggatatgttaattaacttggtctcggtcatcatttgaatatgtatatcaaaacatcactgttgtacacctttaatagatacaatgtttatttgtcaattggacctcagtaaagctggaaagaaaaagtaaatttgggtctagatctgaagagatgatttaggattagagatgttgaattgagacttaacttgcatagaggtgttagctgaagccatagaagtcactaaaattgctaagagaaacagtttggaaagaaggcagagaactggataacagggagcacgttcttttaggaaggtgaagaggcgagggagaagtaagaaaagggaggcgtacctagccaggagagagcttttttaaagtttgtaaaaaaccgcagtgacagtggtagttaaaactgtaaagtgtttcgcattctactaaaatgggaactagtaagagaagaggataacttgtaagagctatgaatgtggttgctaattcgtatctactgtagtttttatgtatttgtgaagctgattatttctaaatttcaaacctagatttataaattatgagaaccctggtgtttattttaaggatgtaatgattttttaaaggaatattatggcatgttacgtgtaaagttggcttatcttataactgatgatgatttttaattgctgcagttaatatattctaaaaatcttcctggcacagcatagattgttatcaggaaaaggattactgccgcaacacatacacacacacagtgatatagcacctttgatgattcacgggagcagctgtaattttaacatctatttctcagctagaaaccatgcttaagtaatttggacatgatttccccttttaaataacgcaatctgaatcaaaatctcaaatgttgggccattagtttagattgtaaaaaattttcaatcttagaaaattctttttgatgtccactttcttcatttagagttcctcagcacttagaatctgtaaccttaacttaaaagtggagggtttttcccccctaaaattactatttttgtgttatattgtgatttttttttctcctaggtatcttaagtattttcatgggtagcaccagtaatatgggagcttttaaaaatacaaacttctggggcttgctttcagctgatctgagacggaagcaggcaatacatttgaccctcgaacaacctggggtttaggggggaccaaaacctccctctcacccccgacacacagtcaaaaatccacctgtgatttttaacttcccaaaaacttaactattaatagcctactgttgagtggaagcttactgataacataaacagtacaaagtttgtaggttagatgtattatattcagtattcttaaagtaagctaaagaaaagaaagtgttaataagaaaatcataagagaaaatacatttactgttcattaggtgaaagtggatcatcataaaggtcttcatcctcgttttccttcactgctcatttccttcatccttgttttcacatttagtcgtctgaggaataggagaggttggtctttctgtatcatgggtggcagaggtggaagaaaattcgagtgtaagtggacccacacagttaaatctcatgctcttcaagggtcaactgtatttttttgtttttaagctcctggcatctttctcttatgtgcactgctagatgtgggaactaatggttagaaagtatagtgtataaaagaaaaggtaacttcaactacagaaggaaaaatctcttcaggttcttttcatattttttgtggtgagaatttaattcctgaaaatttagtaatctgcctacagacaagatataaatagtaccagttgcttaaaggtttcatttccaccccaaagttgaatcttcaaatcctgtaactgtggagttttaatttagagcattccctgcattttgagaaacaacttagatacattataagagtaaaatgctagtgtaaaaaaacactaaaggacttccatatatagtcttttgttttttttatttaattttggctgtataagtgtctttttgttttacaaattgtatgtaaattatctttaaagaagtgataaaaaaatgacctggtctctgtgagaaaggtttcacttgagtgtaaaaggaagtctgtcttggcaaacatcagccctgccctgttctcttcctagatttctgaatacttttgtatatttttaggatgtgcgattatctgctgagaataataacctcttcatcttcattttgtgagaagtgatagaatatagtgaattcttagggctttggagccggacttcctgggttcatgtcccagcctgcctttggttacttgcataaccttgaaacctctgtgtttcagcatccccatatgcagtgaagcaggcaggtcatacgttacagaatggtgagaaattagttattacaatacctggcacatgtgttcgctactgtaattattatggtgattcatagtagtaataatagtatcataagttagaatttccaaatgtgctttcttatctgcttgtatttaaccattttctgagatttcctcattctatatagttaagcaaactaaaattgagaggttgcaataaagtccagggttatgttgttgacctgggattggggccaggattaaaactgttggctctttgacccaaatctttgaccttactggtgtagagaaagaaatttcatagcttaattactacttaatcttcaggaaactaaaatctaccagcgttccattgttgtcatgacctacttatgttcctctgtgtgatattcttttcttagagagcaaacatatggagagaattctgagaaaaacacacaagcttgttcttcattataattagatgaacaaagtatcctcactgttgtctagaactggagttggcagactgcactgtgtgggctaaatccagcctcctccttttgtaaagttttattggaaacccattccacaatggcataatcaagaagttataagagagactatatggccaagggagtcaattacagaaaaagtttccaaatgctttgtctggaatgttaaaatagttttgtttttaaattcaaaaaatacatatacatagggaaaataattacagtggttttcttataacttgatgcttgttgctgggcttgtttgctttgttttgtatttcacttagtattgttgcagagcccagtctgggccaagacttgggctgtaggagctgggaatactgagagagcccacagttgatggtgacactttgcttcttggtgattactgagtgggtatcattgaaaagagatttcactgatcttcctgtagtccctgcataagtagagagtatttgatttgcagggtatgatctaggcctctgcttggttagattgtattcttcctcatatttacagctattttaacagacccattttatgtttccctctaacattgtatgttagagggaacaacaggtgtttaccttttttattctataaatttttataaaagtgagcatgattagtcataagcaggtacaatattgaaaaaattctattacagtaaaagttcagactaacaggatgaaattgaaatgtgggaaatttggattgtcaagatttacatttggcattctacccatttacatttgttacactcattccctgaaaccaacagagttcatctaaggcctaaactgttttctaaagtgtttggggaatgtgttttcacaaatagaaaaacagtccagtttatatttagcaaatccattttacgaaaatggttagttctgagaaacttaaaagcagtgttttcagaagattgaaactttgtaacagttatttaatctcttcattcattgttcctcctgagaaatgcctctactgaattctaaagtaaaaggtgtgtcagcattgatacagcttatgatacagcaaatacatgacagtaaaattgaattttctgaatcagaaatttttagcctaaattcacgtttggccaagttaagatcatatatttgggatcaaaacctcttatctatacaatccactccatattaggagttttccaagagtgctgagtaagtccaaataaacatgcaggtagagcatataatgtgcagtcacgtgtcacttgatggggataccttctgagaaatgcatccttgtgtgaacatcatagagtgtacttacacaaacctaggtggtagagcctgccacacacccaggctatatggtgtagcctattgctcctaggctacaaacctgtacagcaggttactgtaccaaatactgtaggcagttgaaacagcagttagcatttgtgtatcttaaacgtaggaaaggacagtacaactacagtattttaatcttcagggaccactattgtctgtggggtccattgttgattaaaatatccttatgtggtcttagcttttaaattaaagatctagttttttatttacacaccttttcctctaccttccataattgttttcgtcagcatttgagaactataaatattatttcatcttactgtatatagtttctgtcacatattgcttaattttctctgaaacttacatacaggttgagcgtaggtaatctgaaagtgcaaaatccaaaatgctccaaaatccaaaacttgagtgccaacatgacgctcaagggaaatgcatttcagactttgcattttcagattagggctgctcaatgggtaaccagtatgatgcacatattccaaaatccgaaatccaaaacagttctggtcccaagcattttaggcaagggatgcttaacctgtgcaactttgccaataggctaaaaattattgttgaaacatcctaatattgatgagcatttttttttctatttcaaatgtggagaggtaacgatcttctgactagtgaatttctttttaatttttttgacttttaggtttaggggtacatatgcaggtttgttacgtaggtaaacatgtgtcatcgtgttttgtacgtactatttcatcacccagatgttaaacccagtatccaatagttttctcttgttctccctcctcctaccctcccccctcaagtagaccccagtgcctgttgttttctttgtgttcgtaagttcttaccatttagctcccacttacaagtgagaacatgcagtgtttggttttctgttcctgcattcgtttgctaagggtaatggcctccagctccactcatgttctggcaaaagacatgttcttttttatggctgcatagtattccatggtgtatatgtaccacattttctttatccactctgtcattggtgggcatataggttgactccatgtctttgctattgtgaatagtgctgcagtgaacatttgtttgcatatgtctttatggtagaatgatttatattccttgggtatataccctgattggtgagtttcagattttatttactgatcattggtgttagtcttttgtctaaataaatttcataactccaatttgataagtgctttattctaaacaagaattacatatattgttggtagtgaacatggtgttggtagtactacgtgttcttttttaggctcaccatgaggtcctttacctttgttttttttttttttttctgtttccctttcatctgagaaagatagaaagggtgccagttagaaagatatgattcattaagtatttcaatggttaatcagcgagtcgaatcagtgacttctttcccgtggctcctgtaccttacaccgtgaccaatgtgcatagttctgagtgatcaacaggcggcaccacagtgaatgttccttctgtagtgaaggttgaaagattttaccagtaatgtggatgttatcctgctcattcgtcctttgccaaatacttactaatgtcacatatatgttatcagtgtatggcgataaatatcctgagcaatcttttttttttttttttttttttttttgacacagagtcttgctctgtctcccaggctggagtgcagtggcacgatctcggctcactgcgagctccgcctcccaggttcacgctattctcctgcctcagcctcctgagtagctgggactacaggcacccgccaccacgcctggctaattttttgtgttttttagtagagacggggtttcactgtgttagccaggatggtctcgatctcctgacctcgtgatctgcctgcctcagcctcccaaagtgctgggattacaggcgtgagccactgcgcctggccatatcctgagcaatcttaggcaagatccctgctatcatttggatgtaagctctatatccaaagcaaatacataaatttgaaaatacaaaaagtaaattttcgttagtggttaaatgctataaagagaatcagggtagtgtaatagtgaagcaggaggggacaatattaaataacaggctcagggaagaaagcttctctgaggtcacatcattttgaactgggtaagaaagaccctggcaggtgaaggtcattctggaataaggcaaagcgtgtactgctcctgagatggaaactcgacctactggaagggcagcaatatagcccatgtggctacatcataagagcaagggagaaagtgatttggagatccaagaagtgaattttttctgttttaaaaaatttggttagaacatgaaagtttttttaatgttgtttattacttgaaatgttattaaatgcttttttgctaatatgttttatctaacatttcaaagtgagtggaatatcgatgacatcctgaacttttgtgaacgaactgttattttcagtttgaggggatttcaggttacttcattgaaattccaatgtgaggttttattttcagtgtgcttttgtgaggggccaaaagagggaagattttagttgattaagtttctctagttaatggaaacccaagtgtagtcatggggtattcagtgattgctgttagattttaacccttaagaggagatcatggatcaaatagcagaaaggcaggcttcaatatttatcatatatcccgtttaaaaagtgaaagtaggccaggcacgatggcttacacctgtaatctcagcactttgggaggccaaggtgggcaagatcacttgaggtcaggagttcaagaccagcctggccaacatggtgaaacccagtctctactaaaaataccaaaattagctaggcgtggtggcgtgtgcctataatcccagctactcggaaggctgaggcaggagaatcgcttgaacctgggaggcagaggttgcagtgagccgagatcatgccactgcactccagcctgggtgacagagcgagactccgtctgggggaaaaaaaaaaaaaaagtgtatttagccgggcgtggtggtgcacatctgtgatcctgggtactcaggaggctgaggtggaaggatcgcctgcttgagcccaagaggttgaggctgcagtgtgccatgatcacgccactgaactgtagcctgggcaatagaacaaggccctgtctcaaaaataagtagtacaaaaataaaaagtaaaagtataaagtttatttactccatcagctgagatttgttttcttctacaagtacaatatttaaaaatggcaaatttaaaaacaaactgctccacttgtctaaaatagtaaatatacaaaaaaacttatttgcagattttttaaatgtgagacaattttctgttttctctgagagaatcctaataagatttgtgacattggtctcccactataaaatctaccaaataaactgcacaaagtgctatgttagtcataagtattagtcaaagtacagaataatcattataccaccaatgaaggtgtaacaacacaattctttaagtgagacaaaagtcctcttgggctttcctcagttgtttcttactaaaagttgtccatatccatgaaaattacttttgaaccacagacctgtttttcttctaatgcggatggactagattaatagatgaatgtttaagatgagaagcacttgtacagaagaataagctccacaaacacatacatctaaattattgcctaaaaacaatatcacagtgaaatagactcagattttttcagaagcatgctcatgaacacatgtatgttttagaaagcagattacatgtaaaggacagatttacattgtgagaaattagcttacaaaatgacaaagtggaattaaggtaattattttcctgccttctcagcatacttcctgggcaacttttttaccttttgttcccaagtaccagccctgtatctcttgctttctcatccccagaattctttgggtaccagtgcagagagagaccattttttaatcgttgtgaagggggaacttcaatgtgtatatatttgtttccatataaaatcagaggattagcagtgattgcaacattctaagtatgaaactggagtgtgccttcacttttctgtctttttgcaatagagccttccaggctgaaattttcctgtcagtggaaaaaactttggaatacagttaacttaaattcttagcatatttttattgttaattgtggttgagataatccaatgccttttaaagggattagtagctagcttttgttttcaacctaaactgtggtgttcttgcctaccttatgcaattaatgaacttgtgaaaagtatgtataaatccgtttttgtagtataagtctttaatttgtaatggggagttggctttataaaaggatattctactagagtgaatgttcagcgcttcatttatttcctgtattaaggttatttttaaaataaggcacatcaagttgattggaaaggtgttcatagagctagaagtaagagggaaagggctatgaaatggcgaccaggcatatcttatcaatcaggagacagaaagcacagtttccatgaacagagaaagttgaatgtaaagaaattaaacataacaggagtaatgagggattgactggtaagaactaaagagagctctgaagattaagaaccacggatagggctgggcgcagtggctcacacctgtaatctcagcactttgggaggccgaggcgagcagattgcctgaactcaggagttcaagaccagcctgggcaacacggtgaaaccctgtctctactaaaatacaaaaaattaggccgggcgtggtggctcacgcctgtaatcccagcactttgggaggctgaggcgggctgatcacgagggcagatcaagaccatcctggctaacacggtgaaaccctgtctctactaaaaatacaaaaaattagctgggcgtggtggcacgtgcctgtagtccagctgctcgggagactgaggcaggagaatggcgtgaacccgggaggcggagcttgcagtgagccaggatcgcaccactgcacttccagcctgggtgacagaccgagactcagtctcaaaaaaaaaaaaaaattagccggacacagtggcatgctcctgtaatcccagctactcaggaggctgagacaggagaataacttgaacccaggaggcggaggttgcagtgagccgagattgcgtcactgcactccagcctgggtgacagagcgtgactccgtctcaaaaacaaagcacaaaagaaccacagatagaaggagcagctactctccttggtgctgagatagagtgccaaaggaagaggctcccactcactcatcctcagggctgagatctggccttcttggaaagggaacaacggtgctcactgagtggccgagaatttgctgtggtatgtcaccagacgaacttgcatggtatttgtactcccatgtgctggggaggtatctcatgggagacttcacacaacagaaccgtttgagagagtctctggagcaggctgctggccaccgagtactttaggatgctgggcactgcaggagcatgctgaggggatgcaccttctctcctacagcgtctccccaggaccctgtactgaccatgctgcatgccctctgcctctactaaatggctccaaacagctgcaatttcacaaccaaagttttttacttgaaacagcatgttactccttgctaatctaattgagtgtgtattaatcggctacactggtcacacatttgattgggtaagacctaaagtaggctctgcttaacagtgagtccgttcatgtgacctataaaatctctctcagagactcctttccagtccatctttgtcagctgtcttgtctagagctttcaactagctcatagcctccagataacaaggtcattacctttagattaatacgtgcaagttaatacaaaaaaaaaaaaacaacagaaactcgtcttacccttctggggaaaagcaaaagtgcccataagaggatcttgaggtaccttaaaatgcccaaagtttccttctaggctaccaggagctggaatacgtaaacatgaacctgactccgaacacataatttttatagaaagctttcctcataatagcaaacgcgcgcgcgcacacacgcgcacacacacacacacacacacacacacacacatttttaagcttaaatatggagagccattaggatagaattatgtgaggaagggctgggcatggtggcttgcacctgtaatccagcacttttggaagccgaagtaggaggataacttgaacccagaagttcgagactcgcctgggcaacatagcgaaaccccatctctacaacaagtagaaaaagttagcagggtatggtggcacgcatctgtagtccagctactcttgcaggctgaggtgggaggattgcttgagcctgggaggttgaggctgcagtgaagtatgattgtgccactgcactccagccagggcaacattgagaccctgactcaaaaaaaaaaaaaaaaaaaaaaaaagaattaggaaggtttgggaaaaatgtgattcattatcacaacctcacaatttctttcaataattgccactgattgttgactaatttcatgtgtaaattcagattttatcttgacttcatagtcacatttgcttgtgaaagaacattttaatgtttggaaaagttgattattttattttgtgctgtaactctagatctgcatagtccaacaccatagccagtagccacatgtcactgttcaacatttgaaatgtggccagtccaaatcgaggtgtattgttagtgtgaaatgcacattggattttgaaaacacagtatgcaaaaaatgtaaaatacctcattaataacttagatgatgaaatactactttagatacattgagtaataaaatttataaattgatttcgccttattttatttaacatggattctagaaaatttttaattacgtaagcagctcattttataattctcttaaacagtactgttctagatctttatgtattattgaaaaatgcctccatcttttggtagataatggaaatgcactaacaaaagctaatatttcaaatattaattgtatgaaaaattgaatagaatggtgtgagtcccatttatgtgaaatgttgttttggaaggctaattgcatttaatgttataatgattgtatcacaggacaaaaaggtaattagcaatggggtatgcaaattggccaaagataaaaatactcccagaagttttgtgtgatatatggagcaagagccctacatgtatagccaatgacgacctatcgtttatcattgaggagagcatttgagttaaaatattgtaagttaaaataccaagatggtaatgtctgttaatcacattttaatttttagaagttttgatcagttacaagaaagaagaaaattaattggaattcttaccttttctaaacaaattctgctttgtacagagcaatagaaatctgtagaactattaaaattttgtgggtaactcattctctttaaaaatactcattttaacttattttttcacttttctctttttaaaaataattttgtatttataatatattaatcatattttttaatgcaaacaatgcagggataatttactattttgcacttcccttttaatctgaggagcacagcacaatttggggatagagcttaattttgttgatttatacttagctaattgtgatattttattacacaagtaacggctaaaaattttgatcttttacaatttattgtatttatttatttatttattgagacaaagtctcgctgtcttgcccaggctggagtgcagtggcgcaatatcggctcactgcaacctctgcctcccaggtttaagcgattcttgtgcctcaacctccgaagtatctgggattacaggtgcgtgccaccacacccaactaatttttgtttttttagtagagaggggttttcaccatgttggtcaggctgatctcgaactcctgacctcaggtgatccaccgacctcggcctcccaaagtgctgggattacaggagtgatgtttcatgttaaacatcatttgcatatttaaccggccaatcttttccaatttaaaagtagctcatccttgtttgagctagaaaatatcttggcttttttttttttcctaaaagattgttctacttcagtgcagctcattaagaatataccaacttaaaagtagaatacacctccacagaatggttaaaagaatacaaaaatagaaactatgcaaagtacttattttttattccttcaggaagacaacatagaaagaaaccttttcctgaaaagagactactaataatatacgttaataaaaccaaattttatgtttaaagttagtctttaaaaataattttaaatatattttttcaatctttattataataagtaaatttttgtaaaagttgaaatagtagagataactgtaaaattcctcttggctactattttggctatttttccctccaaggtgaaccactgttgcttatttggtatctgttgcttgtctgtacatgggcatgtgcaaacatgtctgtttatattttagagaaaagtttttaaatagctatatggtatcctgctatatgtattctgtaatctgtgtgtcttatttggcattttgttttgaagttattttctttctttttttttttttgagacggagtctcactctgtcgtccaggctggagtgcagtggctccatctgggctcactgcaagctccgcctcccgggttcacgccattctcctgcctcagcctccagagtagctgggactgcaggctcccgccaccacgcccagccaattttttttgtatttttagtagagacagggtttcacccgtagccaggatggtctcgatcttctgaccttgtgatccgcccgcctcagcctcccaaagtgctgggattacaggcgtgagccactgcgcccagccgttttaaagttttcatgtctgtacatatcattctatttcattacacctaattttaatagtcttttacaaacaatgcatgcttattagaacaagtgaaatagatcaaatccaccaactccacttcacccccagttcacccccagttctcactcttcttgaattaagccattctccagactcgtactgacatttggtatcatatatagggtttgggtttttcttttaataattaagagatcaggatttgaattattactcagctaaattatttcagttgaacaatacaaggtgaacatccagtttattcttttgataagaaactttccgtattatggacatcttgtttctaggtatttgcctgcgaaaacatggcagtaagcaccttcgtacctgatttcatgtactgtgctggtgcattttatttctaaagtccttaaagagtgtgtttgtgttgttcaaaatttttaatggctagtaccagattactgatatagctgtgtttcaaatgtaagtctttataatatcttttcctgtgcaagtaaaagtttttaatcttgtcagatatttttatcttgcctttatggcttccgaatttctatcctacttgcaaaggcttcccccagtctaaagttttagaatgtttaatgttcttgttactggtgttattttttccctttcatttccatctgattgttgacgatattgacaaaagatttttttatgtaattaaaattatcttaattcaggaaatttttcagtagtctttaatattcattaagtttttttttttttttttcaatattttgggaccattagctcgtgattatactacctgggtcttcaaaatcagagtgaataacagtagtgttcacaggtatcactgtcctgttactgagtttggtgtaaatagtgtaaatacattcagcatttcactatttgataggatgtttgctcttggttttagaaaatagtttctttcataattatattgcttatttcagtttttgtttaggaatgactgcaaattttctcatgccagtttgatattaacacttttttctgtaaatatttgtgcataataatgaattgtgtcagtaaattcctaatgtcgaactaatcttgcacccttgaaataaccctgatgatagtcttctaatacactactgtattctcctagctagtattttatttatttagaattttttcctccattcataatgaaaaatatattattttctctctttgtactcttgtcatcaagatttggatgttaaaggttctggtagcctcagattggaatgctgatgactagagtattgataattgtcgacgatgagtacatggggttttatgatactgttctctgtatggctgtatatgtttggaaataaagtttttttttaagtgaattagagagctttttatatttttctgtggtccaggataattaaacaaattattttgtttttccgaggttgggagaatgcagctgtaaaaccatatatacgtgatactttgtaaaattatagatcttgatttatctttttattcaagatatatttattggcttcttttaaaatatatattgtcttggtacactttatgatttctgtttatctggggaaattattaatgaacatttagttttattttgtttcttgccactaaaactgatactagaatgaatgttcttataaatgttttcttgagtacatttgtatttctctagaataaatatagaagtggaattatagtgtatgacctagttacattttttgttttgataatttccattttgccttcaaatagtcatacacttttaccatcattttgtgaatatgtctgtttctccatatctttccctaccagtgatgttatcatgtgaaagttctcatggatgataatatgatttcttttttttgagacagagtcttgctctgtcaccaagctggagtgcagtggcacgatcttggctcactgcaacctctgcctcctgggttcaattgattctcctgcctcagcctcacgagtagctgggactataggcgcatgccaccacgccgggctaatttttgtatttttagtagagacagggtttcaccttactggccaggatggtcttgatttcttgacctcgtgatccgcctgcctctgcctcccaaaatgctgggaatacaggcatgagctactgtgcccggccgataatacagtttctaattaatttgtatttccctagttcctagtgaggttaaatgtgtttgcatatttattacgtatttgtacatcctttttgctgaaaagcttctttgtatttttgcatttctctcttgagttgtcttgattgatttatagttctttttttctttttcaaagagacggagtcttgttctgttgcctaggctggagtgtagtggctctatcatagctcacttcagcctccaactcctcggctcaagcaattctcccacctcagccacttaaatagctaggactgtaggaacaagtgacagtgcctggctaaattttaaattttttttacagagtatggaatttgctatgttgcccagctggtctcaaactcctgggctcaagcagtcctcttgccttggcctcccaaagtgctggaattacagacgtgagccatcatgcctgtcttttctttttttaagtaccaaattcttatatatgttacttaggtcagtacatagtcaacatttgtatttagttaaactgtatgaaatagttaacatcgagctgtttgaactaaagaattcccatttcatttagttcagcccagtattatatatgtttcccaattatttgcacgtactttatttttatgtaatcacttttgttgatatactgtggcttcattgagtcttactttagaagactcctgttgattatgtgaatgtttaaactctttttttaggacttgatttcatctgaaatcagtttatttttgtcattgttaaacatacggatctaatttttctacatttgtggacagttgtcccgacaccatttattaaatgttatgttccttctccaacagttttgtttggaatgctactttcatgataaattttgctattatagatatatttcttcattttcgattttattacatgaatctatttggtttttctgtggtaatgctctatttttaattactaggtttttacaatattttggtatctgttagagcaggttgtcattgtttttgaagttgcattgcctcttcttatactgttctcttacagatgctttccagaatcattcttatgctcttgattttttattttaatgacacacagtctccggagtagagatgaagagagaatttctaaacctggggctgtctcaactcctgtaaagcatgctgatgatcacacacctaaaacagtggaagaagttacagttgaaagaaatgagaaacaaacaccttctcttccaggtaagcataacgaaacactaagttcaagaaacatttgcaagtagagtgaagtaattgttaggatttacagaagattttaaagatgcaattattattcttctcatgtgtgaatttgtctgcatatgacttccagcgttttccttatgggtagcaggttggcacaaatcagttgcctttcatgaatgttttcctttactttctagatagaaaatatttatcattaacaacttcttgcaattagtaaagttgttttccaacactgctccttaaagagaaacatgagattggcttcaaaaatttaaaaagaaaagttattttgcttttttgaaagtgttttcataaacattttatggagtatacctttatttattgtctttgggtttttttttttgagacagagtctcactctgtcacccagctggagtgcagtggtgtgattagctcgctgtaacctcaaaactcctgggctccagctgtctttccacctgatcctccctattacaggtgtgcaccaccgcacctggctattttgggttttctggggtttttttgtgggttttctttgttttttgttgttgttttggagagatggaatcttgctttgttgtccaggttggtctccaactcctggcctcaaacagtcctcccacctcagcttcctagtgtgttgggattacaggtgcaagccactgtgtctgacccaagcatccttttaaagctgtctgtgaagacaaaacagaatcagcaaggtgctaagatcggttgcctgggaggcctggagattttgtttctgatgtctttcacttccttttctcaaatcatctttcttgctctgcttgctgagtggcagaaatatggttatttaaaaacattttatcataatgaggaaaggtagctactttggcagtcttaactgggaagtgtaggaattctctcttctcatatctattttttgttattcgttcttaaagaatagatttttcaaattctgattgctggaactatggaaaacacaggtgactgtgtaacatacctacttgttataaagacttcagaatttattactataaaatgtactctaatacatatggtagatatgttcctcatcaggttctctgaacttatgaatcatatattgcttggttgcttgcattattattccatgtttttctaaagtgagtcctactcaattttttttttcttagaaccaaagcctgtgtatgcccaagttgggcaaccagatgtggatttacctgtcagtccatctgatggtgtcctacctaattcaactcatgaagatgggattcttcggtaatacaattttaaagttgtattgttttctttgttcattattaacattattcagagtaggaatttaattgtaaaccatattgcatatattttttaaaatagtacataccacctaatactatgattatttttatatttaacattctgctacttatatatgatagtgagttagaaattagacaacaaaggaactttttggatgctttctttctcaccgctgtctcctgcctagcttttaaattaggaattagaaaaaaaaaaaaattctattcagacatcagaatttccacagctttccaatggagcattaaaaaaaaaaaaaaatcagtgtttctcaatctcagcactagtggcattttgggccaggtaagcatttgttgtgaggggctgtcctgtgcattgtggcatgtttagcagcaatcctggccactagatgccagtagcagtcccctagttgtgacaattagaattatctctagacattgccagatgtttccttgggggcaaaatcatggttgagattggttgagaacctgttctagggtagttagcaacccaaaagtaagtttttactatcttaacacctttcattactttacattatatacttggtagaattgagatgtaaatttgtaaacaaatttcaaaccatcatgattatcaaattagttttttgtttgtttggttagtttttttttttaaacagggtcttgctctgtcgcccaggctggagtgccgtggtgcaatctcggctaactgcaacctctgcctcttgggctcaaacaatcctcccacctcagcctcctgagtagctgggatgaaaggacacacaccaccacacctagctaatttttgtatttttagtagagacggggttttgtttcgccgcattgcccaggctggtctaaaagtcctgggctcaagcagtccaccaacctcagcctcccaaagtgctaggattacagatgtgagccactgtacccagcccaaattagttttttattggcactggtaaaggggacatgatgtgaataattgaaaattgacagaattcccgggccgggcgcagggcttatgcctgtaaagctagnnnnnnnnnnnnnnnnnnnnnnnnnnnnnnnnnnnnnnnnnnnnnnnnnnnnnnnnnnnnnnnnnnnnnnnnnnnnnnnnnnnnnngaggtcacaccactgcactctagcctgggtgacagagcgagactccgtctcaaaaaaaaaaagaaaaattggcagatttcctcaagtgggttagatttagacccagctaggtagatagaagtagttcctgaaagagatggggtttttacaagtttaaaactgtacaattttaatattaggtaattgataattcaaccttttataaattgtgcaggcatagatagtccccttcttttcctttcttgggaattgcttgaaaacttgtgtaagtgtttgaggtttaggaaactgtaatgataagattccagagactggccgggcgcagtggctcatgcctgtaatcccagcactttgggagtccgaggtgggcagatcaccaggtcaggagattgagaccatcctggctgaacacggcgaaaccccgtctctactaaaaatacaaaaaaattagccgggcgtggtggcgggcgcctgtagtcccagctacttgggaggctgaggcaggagaatggcatgaacccaggaggtggagcttgcagtgagccgagatcgcgccactgcactccagcctgggtgacagagcaaaactccatctcaaaaaagaaaaaagaaaaattccagagacctccttccctgggagaacaaataccaaggaagatttgaggacgtggacaggattagtagctgtgccaggaaaggtttggtttttcatttaaagccaatgaatggatttgatgcagaagttagtgagtctgttttgctactgcaagtagttaatataatgcaggcaggacaaagtataaaatgtcagtcatctaaggcacatgacactgttggtgagatatggcctaaagctgtcttctaacagtggttttcagaagccatgttttactaaagggtggatactgtgctcagttgtttttgctttttgaagcacattagatgggtcagggttagaagaggatttccaaagtcctatcttttgtttttgtttttgttttgctttgttttaaagagacagggcctcactctgtcacccaggctagagtataatggtgtgatcattgctcaccataacctcaaactcctaggctcgaggaatcctcccacctcagccttcggagtagctaggactataggcaacgagccacgaaacccagctaatttttttttttttttttttttttttttttagtagtgacagggtcttgctgtgttgatcagggctgggaacaaactcctaggctcaagcagtcctcctgcctcagtctcccaaagtgctggcattataggcttgagctgccacacccaactgagacctggagtcttaaggactttgaggaaatatttaaagaggtttcagtacaatgggtttaggagaggaatctatgagaatgcttttgacctggctaggataccactacaaccaaggggcttggaccatttgtagtaaagctggtaaatagtttcatggagggatcaaggatgccaccagccagtgagagacctcatctgatttctcaggctcttacttttatgactagctgatgttagttccaggtcaggtaacccaatcagaaatgaataaatagtaagttctgaaagttaaggcgatctctttagttggcttaaagagactagaaatctctccttcctcaacacatttcattcatttatttgactttttgttgttgttgttgttattgttatctattagtttctaataatttggttagtattacataataaagagtatagggatttttttctacacttcttgtcagaataggtaaaatagtgtattttcttgctaggaatgtgagagtacttatgaatccctagaagggaaatatagtgggtaatttttaattacagtctgtttctatccagtcagttcttagaaggcatcctttagtatttgttttaaggaatgtcacaaggtttcaacactacactgatgctagaggtgggtgtgtatgcattattttttttttccattcagagaactagaaagggacagaatggatatggggctaatgtagaaaggctgaatgactatatgatttgtattgtaaaactcagaggggcagcagagtaagtgaactactctgtgaactactgaaagactccaccaactgcaaagtttttttaaaaatcactctctgttacatgtagaaatcacaatgcttggagccttattttgagtccatcgtgttaggaaaattagccaatttatacttcaatttctacctttattttaaaaaatttgacttttcagttattaatagaaatgatgtgtgaattggggtggaaaaaatggaagatgtttttagccatttggaatgtaccataactctttgagagttgagaaaacattgttttacaaagtaattttataaattagttatgtaaaatagtacttgcatattaaatttgaatattccaaaactgttaatcagaaaatagtgttattaagtctgatttgaattctaacactaaattttatttagtaaaatagtggtatgagagaagttttagaaatgatggttctttatttaattctgaatatagttttcactgtagtgattgctataacgttttaagctcttcttaactgtttcaaatgaaatatctgttttaacaggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtatgtcagtattgcaacttatgtgggttaaaaagtatttggatcaccagaaaaaggtatcaaacaacaagcttactattgtaattagattgtaatctgtaagcagtctccattgagccagttaaactttgaaagtcaaaatccatcaggtctaccttatgctggacttctcacttcccattcttgtatcttgctcttgtttactgctatattttgtgttagtaaagaatgtaacatttcatttctaccactcgtgttcatggaaataaaagaaaataagtcttatatcccgatgataatatctaccaggtagtctttggaagttcaactaaacattcagactggcaggactctgccatgggccacaacttggcagcaagcaacatcaagtgttcctctcccatatgagtcatcttgaagcaatccacacaacctctgggacctttttaaccccagataatggctcagacacagggagatggaattcacatcaaaggcaaatgtgtaagctgcctggctttgaaacttcatactccacaagagacaggattagttacacaaatcaggaaagcccaggttagatgcagagtatcagtagagtctatagagtcctcccttccttccccataaacggtttcacctagtgacatagtaccatcttaatctgtctcctgtttctttttaaaatatccaaacctccatttgatttgctagattaaactatgtcccattttaatcagaaggtatctgtccattgtgagctcctacatttattctgcttctctaccacaaagtctttgccgtggcctctctattctggtctctttctgtactcagcctgcctcttgccagtgtcctggattcagcctcctgtctgctccagaatcttgtagctttgttcactttcttgtctttctctctccactggttcttcatctatcttccactgtcttatttgtccttttttgctgtttaacttgttgaaggatgtggttgaggcccttgcctgttttcttttcaatcattgtggtcatacagttttgcagcctggcttccaccttcaccacactgaagctcagttttcaataagccattgctgagttaatgtcatcctcaagcctcattttcctttattttttagcagcgttttgactgtcttaatcttttttgaagtacttttttccttagattccataatactgccattctggtacatttttttattcttttcctgcctctttactgatacttttaaaacttggagaatgttggtaactctctgcttctcttgctacactgcctctttcttgggtttggttgctcaagtgagcagctcgtaatcaaagtcttttcacttagcaatttcctgagctctgtcattttctcattgaatcctcctccttttcccttcaaacttagcatgtcaaaaagtcaaggcatcatggtgacttcagacctatttccatctgatctgatatggtcattctttctgatgatgtttacattgttgtcaatcaagttaggtcaaaaacatttaaatacaacatgtataataacgttcactataccaaggaaagtaaagagacctattttcttacccatctcttaaccctgttttgaagtaatcagggcatacatttttttaaacgtttctttcttttttttttttttttttccttgagacagcgcctcactgtcacccaggctggaatgcagtggtgtgatcacggctcactgcagccttaaacacctaggctcaaacattcttcccctcagcctcctgagtagctgggaccacaggcattagccaccacacgtggcaaatttttgtattttttgtagaggcagggtttcaccacgtggcccagactggtctcaaactcctgggttcaagcagtccacctactttggcctcccagagtgctgggattacagacatgagtcactgcgcctggctaaaaaatgtttcttaatagttcacttttgttttgtatcataaaagtaagtggtgcgtgtcaggtttttttgtttctagggtttttttttttcttttttaatctggaaaatttccaaaaggtggaaagaagaaaacctgcctgtaatcctgcacacagtcactggtgacattttaataagttcattttggcatttagaagcttctaatagaagtaaatattaacttggcaaacactgagcctgcattacacagatgctcttacagggttgctacagtgcagattgtctttttagtcccattttcttttgattttttttctcagcaacttgtaaaaagttaccttttttcatctaaactggttaaattttacacagatctttaatgtcaggacacactgaatactatttaaataaatttatacctttaactcactttatttgtttctgtttttttaaaattagagtgtattcttttctccaaagtaaaataaagtttttggtcttaaaagatgtgatattttcggccgggtgtggtgactcatgcctgtaatcccagcactttaggagaccaaagcgggcggatcacctgaggtcaggagtttgagaccaacctgcccaacatggtgaaaccccatctctactaaaaatataaaaaaattagctgggtgtggtggtgggcacctgcaatcccagctactcgggaggctgaggcaggagaatcacttgaacctgggaggtggaggttgcagtgagctgagatcgtgccattgcactccagcctgggcgacagagcgagactctgtctcaaaaaaaaaaaaaagatgtgatattttcaaattaggtagactgagagtatctgtgtcctgcgtatgttattttcatattcttaaacagccaagaatgatttatgaaatcttatttattaggtaaacaacgtagattttacaaatatcataagagaagaagccgtccttttcctgcttgacctccctaaaggagaagaagtgaccatattggctcagaagaagaaggatggtgagatgctgtcagaaaatggaggagataaacctgtagagtttgaggacttacaaagggatttattccatttttaaaaaataagtcactcatagttgagtgatgaatgaatttgttaatctcaaagaaagttatgtaattctaagtcatttaggagcacagaatttcagatgattctcattagcagagcatgctaataggactaacctttatagtattctaatttaaataaaatgccatccaaccctttacaagtgatagaaagtgttgatttattagccatcagaaccatacaaaagtatatatgagcagctttcagattttgtactgatgtttctaagcaatacactcagatgtttattagcattaattcaagagaaaactccattttttctgtgatacaattttcacttagagccaggtttctcagccttggcactgttgacattttggaccaaataatgtggttttaggggctgtcctgtgtattgtggatgtttaggagcattcctagcctctgctcactagatgagatgccactagcacacaccccttaccctttcagtacacagatggggcagtcaaaactgcatattggcaaatgtccaatgttggatggcgagggataaaattacctttatttgagaactgctgatttagatatggaaatgtctataatgtttgcagataagttagatgatataatagaaaacaagcatgtggcttttgacaagttacttgatgtattttctgcatcagtttcctcatctgcaaaatggaagtactaagagtttcaattcttacagtgatgaatacatgaaataatacagtacctggcacatagtaagaatttgttggatattattattgatattatcatagcatctttacataatgtactgtctttcagattgttatcccactaaatattgataatgtgtttgtttttattccttttagtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacaggtatgaatgcttggatacttctcatagagtgaatcaagtaaatgatgatagatcatttcaatcccactgggaaattttggtaatgtaaagaattctttttcattgtattcaacgtatctataactgacttaggtttacaaactcctctttattataaccattaagatttaaactgtatgtgaacttccatccagtattgtatatttcatttcattgtgggtctttttccattttgcattttaaatgcccttattttaattttctcctttcttgtgtagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaaggtagtttattttctacagactaacctaataccctttaacgtcaatatgtttaagaaagaaaaggtataaaatatgctgtttttcatgtgaatttctctccagctggatttctgaggcctgtaaccatttttggaccaatagctgatgttgccagagaaaagctggcaagagaagaaccagatatttatcaaattgcaagtaagtagcctcaaggctaacttaaatgaggttgggagttacacctctaaagtgagtgagttctgattcactcattcaataaaaataagactttttgtcagtgaaaaattagcagtttatcccattcttttaatttggtgagaaaaccccagtgaccatgtccttgttccaccaattcttttaatgagaaaagtcaccgtttaggaaactcttggcttcatatgaaaattgcataacatacaatgtcattgaatcctcccagtcatgctctgaggtaaggagtataatatccatgttacagttgagtagcctgagacttggatggtcattgcgtggatcctttccagtttcttcagtctaaacttcctggtggccctcagtgaacaagtgacaagactcggctttgaccacagccctttcttgctccattccagctcttttagtcattaaactgacaaatacacaaatagttaaaaagggtaataaaacattgctaatattatcagctgttgttattgcagacatttataataagatagtaagtataagtattgaggctgcagtgctttgtatgccaaatacgttttgcttacagatccttgttttatttactttcttttttttttttccaagccaaactgtatccagctttattaaagatactttccataaacaatcatggtatttcaggcaggacatgggcagacaatcgttaacagtatacaacaactttcaaactcccttcttcagtggactaccaaaaatcagaaagccactataaaacccaatgaagtcttcatctgatgctctgaacagggaaagttgagagtgagggttgacatttcacatttagcatgttgtttaacaacttttcacaagccaaccctgactttcaggaagtgaaacgaaaatggcagaatttatctgaagatccacaatctagaaatggaaccactgctcttttgacaggtgccatctcagtggcatcactgggaaagtccagattgcctgacacactggtaaccaatgactaggggtcaggtctcaacagatgtctgggcttaagggagttaagtctatgctgaaacgtggaaagggagaagaggacataaaaacaaatttgtttttccatagcacaaggcttttgtgccaaggtggccatgtgtgtcaaagtcaaggaatccctcctcctgggagccaagaggaagtctctcaaaactggaagggaaaggtgttttctccacatcaatccagttttggagacattctattagtgacatatgccccttcccccaaaaacaacaatgaagtgttctgtgtgcgaacaacatagcttaaaaaaaaaaaaaaaaaggtaaaacaaaattctgcatttttataaaacttgataaaagtatttcaaactgtacagtcaccagaaatacacagttaccaaaaatgcacacacttcacttggcatctccagcaccttcagctttctgtgcctggtctgttttggcatctccattttctgcagggttattcccctccttgccagcatcagcttttccctttttccctttgggtaccttctctcccttctttgcaggggcctttttaggcttgggctctggctttggaggagcaggtttagcagacaacctcgcggatcttctctgtggttcgtccttcaccttggctttatctcccttagcatccccttcagcctttctcttgggcatggtggcggtggcgacaggacgtaggtgctggacgtgggatgcagcggcacgcgggctttggtcggtccgggggtcgttctcgcctcttcttcacactgctcctcttttttttttttcagagacagagtctcactcttgcccaggcaggagtgcagtggttagatcattgctcactgtagtcccaaactcatgggttcaagcagtccacacacctcggccttccaagcagctaggactacaggcacatgccaacacgcctggctagtttattattattattattattattatttttgtagaaacagggtctcactaggttgtccaggctgaacctgagctcctgggctcaagtgatctctggccttggcctcccaaagtgctgggattacaggtgtgagccactgtacccagttttgttttatttttaaactgtttttgtaattataaaagtgccattctgtgtttggaaaagttggaaagttaatttttacacatatcaccaccctaaattttattccattgtattttcttccactcttttaagcatattttggcaaagttttatttatactgtttagaaaagtttatatccaatttttctttttcataggtaatggcatattttcattttatcctgcaatttttggttcagttaggctttttttatatcgtttgtttcgaatttatattactattacaaaagatacagaaatctgtccatattttgtttgcttgtttatgccctgctttgtttcccaaaggatttaaatccttaagaatatagctgttcccataattatgatgaagtttctgctttccagagagttgtgctggggattttgttcccactggcactatatgaccctcagtaaccttttttttttttttttgaaacagagtctcgctctgtcgcccaggctggagtgcagtggcacgatctcagatccaggctccaagtttcacctcctgggttcatgccattctcctgcctcagcctcccgagtagctgggactacaggcacccgccaccacgcccggctaatttttttgtttttttagtagagacggggtttcaccgtgttagccaggatggtctcgatctcctgacctcgtgatctgcccacctcggcctcccaaagtgctgggattacaggcgtgagccactgcacccagccgaccctcagtaacatctttaaactgcatagtgttaatttaaagaatcagaacatcatcttttttttttaatatattgcttttcatttcattgccaatgaagttgaataaggatatttattttctgaacatcagaagatttgcagacaaatgatttgagtaaaatctgagcaagttagaaaatgtttatttcttagttttttcagaagaagttttgttttgttttgttttcttttgtttgagacaaggtcttactgtgttgcccaggttggagtgcactgacgcaatctcagctcactgcaacctccgcctcctgggttcaagcgattctcctgtctcagcctcccctagtggctgggattacaggcacctgccaccgcacctggctaagttatctgtagatgacatttcacctgaaggaagttggtggtaacccttacccataaccaaacttaggatttttagatatgggaaaagcaagtatgatgacttacaaagctctgccttaaagggtaatacattggtttaatcaggtttactccacaacagggaattcaggtagcttagttttatatcttctttgagtctaatgacagtcttttgagttgaggagttagtagcattttttttccagccaaaattcccagttgatctttcttcttaattctccagtgttcactagatttgaaattctgccctgcttgcccatggtgctttgtcttatggtagtctcattctccaaaatcatttatcttgaacctcagtgtgacttgtctttccagatctctgcctttgtctgatctctgaaacaccaaagctcttcctttcctttcaaactttccttgtgaccagagtcacaaacgttgctgtgctctgagatggttggttggaaaccagcccaagctgcatttggcacagtatacaccagtgaagacaggttgccaggatgaagccataggctgtctcacagttacagatgaacagcttcctgcccccaggttccccttctactgatgtaactaaggtctctaacccagaactccctaggcaatccactatagcaccattaccgatggttgatggacatgccaaggtattgacctcttaagccagtagtggctggttagagcttggcaaaggagcagccccctcagtttatctcagtgtgccatacaaataatattttctctggatgttacagtgtgaaaaagggtgggaagtagtgccctgttgagccatattagagccccaggcaaaagaaaaaaatgtgcattcctgtatattttttcttctttaatggctaagtttttttccagaatattaaagtagttgaaaaaatagtgaaaaaaaaaaagggaagtatgcatattaaaactcactttaagtactgcatgcataagacagtttccacaaacaaagtactatccagtccggcatatcagttgtggccagtagttgagaaactcctgtctaaccagtgaaaatttgatgtcttatttttgtcctgacataatgaatagagagtgaaccacgagacgctggaactgaccaacgtagctctggcattattcgcctgcatacaataaagcaaatcatagatcaagtaagttattaaaacttgacccatttcattatgttattgtggttttgagtgggatgggatttggttaatttgaaagtagaaggtagtttttctgagactattactgacatactataagaaaattaagcccttactgaaaagcattataatgattactttcaagagaatagttactgtaggcatcagaagatgatttttcattaccacaaaacaagtgtatgatttttagatgtaattaacagactgcttatatattatatcagtacaattcaagttgtagtttgttatttacattcataaggaatgtcaggaacattaaattcttaaacatttttattctaactgtacgtggataatactgtcagattgcggtgttagggctaagtcttaaaagtgagcttcatagaaaggtttttagaaatttggctagaaatggaattgagttaacttacaattagttttttaatatgtgctcctgagacattagaatacaaagagatctgttaccactgaaatatagtacagacttttgactttttctgaatgtgatggggtgttttgttttgttttggtttgtatttgtttttgtttttgaggtagggtcttgctgtgttgcccaggtgggactgcagtggtgtgatctcggctcactgtagcctctacctctcaggttcaagtgattcttgtgcctcagccacccaagtagctgggattacaggcgtgcaccaccatgcctggctagtttttgtatttttagtagagatagagtttctccatactggccaggctggtctggaactcctggcctcaagtgattcacccacctcgacctcccaaagtgctaggattataggcgtagcgtgagccactgcacccagctgaatttggtgattcttaattaatgatgtcttgtgtctttgtatatatttttctttctgtttctaggacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaagtgagtatgttaataaaggccttctttcagcttacaatgtctgggcaacattaagtaggccaaaatgttacggtgttcaaatactaaaacttacatgatactttcttggaaagcttcctgttgtgttaacacctgctgtttggttaaaagaaaatatacagtagcaaaatagaaatttcaaatgtttgcatcctcagataccatctttcagtaatgacgatttagctgtaagcagggttgaattaattctgacttttggcagtgctctaaccataaaactacatcgttaatttattttcagctacaattaacttaaattcaatgaatgatggttggtatggtgcgctgaaagaagcaattcaacaacagcaaaaccagctggtatgggtttccgagggaaaggtaagacatttcctattacttttttgactagttcagtaaattatgtaactaatcagagatgcttttgagataccagtgctttctaattagatcaacatattggagaaatttggggaaagttagcttttaggtttttataatttgtgtgtaggggttatgaaagttgtttctgatggtaagagaattcttaaattttctcacctgttgaattaccactgcagtaggattgtctcctaaagaatcttaaattataatgaagagcaggttgagttctgatgctgcccctgtctggctatgaatgatgactttgagcctggcttcagtttcctcctctgaaaatgaggggatttggatggcctagatgagcatctcccaaagtgctgtcctcagcatgctcaattcaggacttgctctaagagagaaggcactatgaaggcaagcagcggatgggaaataaaccctagacccctcacgagtatcctcgtacccactggcatttaaaggctctgagacatcttaaaagttaaaaagccgacttcatgcatttccttgcatttatttttcactcaacacctgttaacattctcacaacatactgggagatattgaacaaagcaatagatccttcctggctttgaattttggttttctatacgtccaaatggccagctttaaaataactactttctattgtcagtctttctggttttatagcaatctttgatgggaaggtctgtttattttgtctggagagttaatcatttcctcagaatacaccattgagggaagctttttttttttaaatgtcttttacctttttcagatcagtgcagtaagttttggttattagggaagattgagagtatctctggtttttattttgttctttgtacttccttgttggtttggtttttgttgtgttttgcccccgcatggtccctaccttcctctgcctggctgtggctacagatgctctgacagtgcatgctgcatgcttaggaccccccatgtcctctacccagacatacacagcctctgcaaggagagctgttaacactgagaggcagtgtctattgttctcacctatagtaatgtgtcagaactatggtttttctcattatgaaccagtctgggggatggaccatgcatacgagagcctaagaccactctgaataacatgtcagctggaactggataggaaaatgaaggtggaaacaaaccacaccactttacatgaacacactattactaatttctacttttgcagcacttgaaaggattgtagtcttcatactaaccttctatagcaacacaattctgttaacatcctttggcaggtccaatgttaatagctttcactagtgaattcttaaaatgaaagtagtctataaatgttttcccaaaatgcacaaagtatacatttgtagtatctgagaggcttttttaaaatccacaaatcttaattttctataaagtattttagtgatagtcttgtgtgctttctttgcttggttttaaaataaaggtccaactttctagctttttatgtgaggaaaaataggttatttattatcaggctagactgatgcattttgtaagccagaaaaggttgttacaacttaaagcttatcttcctgtcctcttctcttcaagtatatttcatagaatagattcttaaactaaaactacttcatttcacattgactttcctgaaccaactactttgacctaattgctagaaagagttcctttttacaagatctgacacagtcttacatattccctgctaaaccaggaaaagtcatcctgaggctttcttaacatatttcctagttcaaagcaacccatcgttcttgcttacatctgcatttcaaaccagctttaaaaacttaagtggattgattagttctaagttattcttgcccagactttcaatatttccttgactggctactggattatagtattcagaaccctggcaagctaaagattagagtagatagcaagaagacttttcttctgcaacagctgttaccgagttgagaagccattgagacttgttcagagggattgtgctctaacaggatagatccctggattcccactctccccagcccagcctggcagatgctctcttgaaaactggagcatggggagacctgacacaccctagtctttcttatcaggaaggcagtgctcaaggtcagagtcttaacgagccaagcatggggactgcgtggaaagctccattcaggcaacttgactcccaagaccatgcttctggcacagcagacctgcagagccacaccaaacctgctagttaatagcagtgcatctttctggaggacaagagtttcatgtttgtccttcattccatactgaagtggaagaaatactttctgattcctggattccagatccttcagctctcatgagtaactgagcacggtgtctaggcagggtcttcagggagtgttctttttcatccaggtactagtgtcacgttagtgtccagtgataacctgttgattgcaactctgtagcttcctttccctcaaatacttctcactttctttctgatctactcagaagataatcaacataaactattagaaactgagttcttaattacttaacaaaagaaaagcattactgtatttcttcctctccatctgttggatactgtttctatgaaaaataataaataatttcttcttaatgtagcaaccaccatgtaggtgatgattttccattgtgtttcataacagctttaagggccaaatgtttaacaggttgttttagtctgctcttgaactgctgtaaagaactacctgagaccgggtaacttataaagaaaagagatttaattggctcacagttctgtgggctgtacaggctcctgcttctggggaggcctcaggaaacttaagacagtgaaggggaaaaagcatgtcttacatggttggagcaggaggaagagagagaaggggggagtactacacacttttaaacagacagagcttgggagaactcttatcacaaaatagtattagggggatggtgctaaaccattagaaaccgccctcgtgatcacctcctaccaggccccactccaacactgaggattataattcaacatgagatgtgggtggggacacaaatccaaaccatatcattctgttcctggtccctcccaaatttcatgtccttctcacattgcaaaatatgatggtgcgttcccaacagtgccccaaagtcttaactcatttcagcattaactcagaagttcaaagtctcatctgagacaaggctagtctcttctgtctaggagcctgtaaaatcaaaaacaagttagttacttccaagatacaaaggggacataaacattgggtaaatactcccttttcaaaatggagaagtctgccaaaacaaaggagctccaatccccatgaaattccaaaagtaagtagattagtcattaaatcttaaagctccaaaataatctccgttgactccactgctcacacccaggctacaatgatgcaaggggtgagctaccaaggccttggacagctctgcccctgtagccacgcagggcacagcccctgcagctcctttcatggactggcattgtgtgcctgtggcttttccaggtgcatggtgcatgctgttggtggacctacctctctaaggtctggaggacaatgggcctcttctcacagctccactaggcagtgccccagtggggactgtctggtggggggctccaaccccacatttcccctccacactgccctggaggtgctccatgagggctccgctcctgcagcagacttctgcctggacatccaggcatttccatacatcctctgaaatctaggcagaggctcccaagcctcaactgtctccctctgtgcacccgcagacttagcatcatgtggaagctgccaaggcttagggcttgcaccctctgaagcaacagcctgagctgtaacttggcccattttggccatgtctggagctagaacagccatgatgcagggcaccatgtcctgaggctgcacagagcagcagggccgggcctggatcacccacaaaaccattttttccctcctaggcctccaggcttgtgatgggaggggctgccgcataggcctccaaaatgccctggagacattttcccccattgttttgtctgttaatattctgtccctcgttacttaacaaatttctgcagccagcttgaattcctccccagaaaatgggtttttattttttactgcatagccaggctgcaaattttccaaacttttatgctctgcttcacttttaaatataagttccagtttcagataatctgtttgtgcacacatatgaacacatgctgttagaagcagccaggtcgcatcttgaatgctttgctattcagaaatttcttccaccagataccctaaatcatctctctcaagttcaaagttccacagatcactagagcaggggcacagtgccaccagtgtctttgctaaagcatagcaagaatgaatgacctttactccagttcccagtaagttcttcatctctgtctgagacctccacagcctggactttattgtccatatcactattagcattttggtcaaaaccattcaacaggtctctaggaaattccaaactttccctcatttttctgtcttctcttgagccctccaaactgttccaacctctgcccattacccagttccaaagctgcttccacattttcaggtatctttttggcaatgccctacttctctggtaccaatttactgtattagtccattctcacactgtgataaagaaccacctgagactgggtaatttataaagaaaaggtttcattggctcacagttctgcaggctgtacaggcttctgcttctggggaggcctcaggcaacttacaatcgtggcggaaggggaaggaagcatgtcttatatggctggagcaggaggaagagagttggggaggtgctgcacacttaaaaaaacagatcttgggagaattctatcacaagactgtgtgagggagatggtgctaaaccattagaaaccacccccatgatccagtcacctcccaccaggcccctcccccaacactggggattacaattcaacatgagatttgggtgggaacacaaatccaaaccatatcagttgtttcctaaacataaatatattagctcttattcaacttttgaactgttgggtttatttcataggtattcttccatgtgctattctgtcagtgtgtccttgtttctgtgagcttagtttggtaacattctccctcttccccttgcttaaaagggctgaagagctagtgagtaggttttataaatctgagcagtgtcagagtttcttcgttgtcttccagggctgggccctggagtctaactttgtcctggcttaccggccactgtttccttcatccatgcccttcagatctcaaggggtgctccatgtgtctgcgtgtgtgcttgtacaatcttcttgacttttccttaccagaagtttcaagaagtagatgtgacttctccagagaaagatatccttttcaatctgccttgtacgataaaggccatctcttaaagaactactgaataaaatttgtaatttacttttatttgacccaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacaggtaagcagcaagcattcaacgttttgtagatagaggtgcattattaaattttagaatgtggtgattgagttaaaaatatatatgttgtcctttctccagattaagaattaatcttcaatttcaatttgagagtaccaagggcttaattctaaattttgtgtgtttgtcttaacacagcaatgtactggattttttttttttcccaaaaagtttaggacatgaggtcataattttgttattcagcacacttaaaatgtatgtctaccaatcactataaattgaagtggaaagttagcagtaaacagaaacactatatttaaaatattttaaacacttcacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtacctgtgctgcggtgttgcactaatttgttgctgtccatcaatctggcacatgatcatttttgctttgccctttaagtgttccttttgcttttttactgcaggcttatacactgtaatgctttcaaatcaatacaaatcatttcagtttcgtagtttgcatggcttccattggtatactgattatttgaaaacaggccttttaattgagatttgtgcttattatttttatttttggctttcagtatcttccagaattccttaatatgtaatcgaaacccatcataaacatatttatgttaatacaaattatgatgcccataaatcttctttaggatttttcagtgtcaaaatgaagtgtaatcaatagtgcattaattttctactaaatttaatatttatctttaactcactgtttatttagtacatgctgaaacataaaagcccctacctgcattataaattttgagctttcacttaaaccagctttttccactaatcttgtctatcctgataataaatggtaaaacataccattttcacatattaaatcatagtttaatatttaatcacagtctaataaaatagactagaattagaaacaagactttgtccttaaatgtgaattttttatacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaaggtaaatatgtctttagtgccttggatgcatgggcacaccgtttaaaaggcttcttggctctcccctccgccattacatgatatctattctgttaattatctgttccttaggcatatttgtcttttttttttttttttttttaaacagcctccagaagtagcatctaaaccttcaggtgctcccatcattggtcccaaacccacttctcagaatcaattcagtgaacatgacaaaactctgtacaggtgagtacactttgtgctctttgtggcatagaactgaccaggaatttaaccctcttagtcaataagaaaaccttttactgtgttagtagaggagaggtgtgaataggaggagtttgtccttaaataaaaactatcagctctcctaaacagtgattctagggggaaaaaaagtagaactttatttctgacaaatctgacaaatctttatacctttagcagactttcggaaagatattctccaagcagatgattaaataaacatttttaagctctgacatttgtattatgttttttagttttaaaagtgcttttcgacatgtgaactcttagtttccagtggtgaggaaacagactcagattggttaagataactaaatcatttagtgagcatgcataaggtgcttgcccttgtgctaagcacatcagcataatgaggtgacactgttgttgttctgcattgtagagagagacactgaggctgagaggggctaagtagcttacaagacttagagctggaagagaaacctggcctgctgctcctcagcctgagctttttcccatggcctcattgcactgccaataagtgacagattagatttgaatacagctcttctgattttgttttttgactgaatatatgtttgcacttaggataaagaagagaactgtctaatatgaatttacttaatgacttgctttcttcctcatctgctttgtatgccttctagaactttagaccatatagagttatttgttcatatgagaatcattgagatcctggactgagttcttaaaaatccctttgaaagttcttaaagtctatcatttactgttcttgaccttggtatatgtacttctcaagatgttcactgtctcggttacattgccctttgtctttctgattaactacttctaacctgctgttccctaatcatgtaatcgtttagcttattatattgtgttaaaggactcatgagccagaagggggctgccttttgagtatactctgtgaggacatgggatttgaaatatccattttaactgttgggactgctcagatcctcagtaatcacagcagttagtaattattgaccttttagtcaagataagacttacatattctacttccttcataacattaatatttaaaaaggtgttccgtttgtcattcattatctgttaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagtaagctatttcacctggcttttaaaaataggatgcagcatattaatcccgtgcagttcaatatattttgaagaaaaataatttaagtgtaatatatgatttctgtaggctctagtggttcagcattgtacatactttttagttctgggatgtgtgttttgtttttaaagtctgctattagatgtacatagtttttgcattcacaaagatgctaacatcacagggttttgacggaagacagtgtcaaccacaaggaccctcatcgataggtaatcatcagtcttcacttctgtacacacacctaatgatgtcatgctggttctttttcttttctgtttttattttttaaatataaatacagatgtgaggaggatcctgtttgagggaaatactgaagaggttttttgttttttgtttttgtaagatttctgatccagttttacaggtgagggaaaatgacagggcagagctgggactgaaccccaagtttcttgactcccagtcatcttttccctgtgcttgctgctcccctccgtttactcatccctgggtttcgtgttggtttgttctcctttcttgtgcctgcgtgggtttgtgtctcctactggttctgtgtctctggttgaaccctgactgataagagaatttggtactgatagttgtgtctaagcccacacgggcacacaggtagattcatacctcaatagaacaaaacccacaagaacaaaaacagatgtggatttgtcaaaagaaattcatttacacagttacaggggctggctaagcaagtcctatttcagagggcagttggtcaggaagggaagattttgagctactggggagtgtgagatcagggaaggcctaaattctcattcagagggctctgctgattaggccaggccctcccaagaccatctcccctcaactgacttggggacattacacctgaaaaatcccttcatggcagtacctagccagattgacatattagaattcatcacacatagtattgtgtctatattaaaagcacctagatttttccttacttagttgcgtgggcttgggattatcttgggaaatgacctatttgtcatttactattgagtgtaaattgttttagaacatactttaaaaccactaacattaaaacctaattttaattaccactgcttttttctaagacatcctttgtagtgaagacttttttcactgtcctatatttaaggctttatgtttacagaggaaagcagtttatgagaatccaaatgcaaactgagagtgctgcagtgggggttgtattaaatgcaaaacgtgtcttgtactagtgttgtgaaccaccccttagcacaacactagaaaggggttgtggcatctagatggtgtctggactgaagtgagctagcacaatataaacccacacaggtgcacagctgggttcatacctcaacagaacaaaacccacaagaacaaaaacagatgtggatttgtcattaggaattcatttacatttacagtgttacaggaattcatttacacagttatcacagtaacatctaaatggtgactagcctaaagtgagctaggcactgagccataggagctcacctttggtaaggcagaagggtgtaccctttagttattatttttactaaacaccgttaaacacattcattcctgtcagaagaaggctcaggtgtttagtttaaagatatctcttatttatcgttttacatatttggtaaatagaatacaaccttaaaaagattatatggccaggcgcagtggctcgtgcctgtaatcccagcactttgggagaccaaggcaggctgatcatgaggtcaggagatcgagaccatcctggctaacacgatgaaaccccatctctactaaaaatacaaaaaaatcagcggggcgtggtggcgggctcctatagtcccagctactcgggagactgaggcaggagaatggcgtgaacccgggagacagagcttgcagtgagccgagatcgtgccactggactccagcttgggcaacagagtgagactctgtctcaaaaaaaaaaaaaaaaaaaaaggctgggcgcagtggctcacgcctgtactcccagcactttgggaggccgaggtgggtggatcatgaggtcaggagatcgagaccatcctggctaatatggtgaaaccctgtctctactaaaaatacaaaaaattacctgggcatggtggcaggtgcctgtagtcccagctactctggaggctgaggcaggagaatggcatgaacccgggaggcggagcttgcaatgagccgagatcgcgccactgcactccagtctgggcgacagagccagactcatctcaaaaaaaaaaaggagtatatttaggtctaaaaagtaagttgttttgccagggaatcaatcaaaatgcatgtttgctttctgtgttaatttgtttttctagaaagaagacttagcttatttgtgatgtataactttagggtgtagaacattgccttgcatgcagtaggggctcagtaattgttgagtgaatgaagctcaaaacagggcatggtatactaggtgcatccaccacccttcttttcattaacacagctctggaaggaacctgtattacctggtcattgttttcacagggatatattgtgaaacagatgacatctgtctttgtgaatttactcagaactcagtttgattttactccctgctgctgtgagagagaaaagtatagtttgggctggataccagtatacttttttttcctttgtagtgtgaaattgaaactctttataattgtgctgcattttcccatataggtatttaatggttagagaaatggaaaggagaataagggtcatggaagataactaagagggtagttgtttctgtaagtttcccttgtaatgctttttcatactcttgtccaatgagtacaacttcatcaactggaaaatagcttaaaatataggactctgtcctgcatttcaaaaccatttactgtttgtcactaaataagactgccttcaggcatttctttctttcagtaaatacaggagtagcaaaattttcttccttcagatgatgtgtgcttatgcttcacttaaaaacacacctcagaaatggtgagaattagatatggaaaataatctttgttagcacaggacagatgccccaggaagcaagcagatattacccagtctaacagttccatagagctggattagaactggaaaggttaggagacagtagcttagacattcacctccaaagtaaatcagaagtttccaggattctaaaacagtgcaagaagagcagtgtccctccagggctgtgcacatgtctcagtccagagattgagtcaacttcttcaggacaaccagggattttttgttatcaaatctacctttcaggactcaactcactatgtgagacttccaggtctcaataaatgatggtggtttgtagcttttaaagaactaaatgtgagagactgatgttcagttgtttttgtgtttgtgagacatcattagatgagagagagcctgagcatcaagcatgcagcttcaccagtaagactccaccaccacagggcccagcttatgattggagatggaggaggtcttgctagaaaggaacatgtgaagcctggccaggtttcaagccaggcatatttctatctctccatttaccattcccctcccaggggctcaatgtagctcttctgttgtgttactttttcctgtgtcttcacttgcagaatttctttgcccagcctttttttttttttttttaatgggacatgtcactcccacttattcagaacctgctaattatccttgatcaccactctttgatttgataaatttctttgctcactattagcagctgcaacagaggtggagaaggagcaaagttcaaacacattgcttttcactgcagtaacagttaaagtacatgaaggatgggccagcagacgggacataactaagtgattgtgttttatttatcttcaatttccttggccaaatgagagttagtgatatgttcctttatagaccaaattatggtgaaatggtggatgttggttgatatttttaaatgacatttgagttccatttgctgcaaatttacttagttagattgaccattttctttcatttttctattgcgcttgctttgccatcacctagatttcttggctcttacactagctatgactacttgaaaaggaacgtcaagtggtaagactggcaattaatgtgaggctgttccataaggtgtccctcactgtgtcactggcattatgtgcactttcagattttaatgtcatcatcaagggcttagtctaaattcatgaaagcaagataaaaaagccaatcataagacttcttcaatgaaaatttatgaaaatgaccaggagtattccaaatgtatatgttattgttggtgcacataaagctagtgcagctttggcattcagcagtaaggtttagatggcaatgttgcaattatgggtcttttaaaaagatttgtgtgaattttgtgttacatattaacaattggcaatctgaaaaaataaacatacatggcacaatttgacttaaatgaaccttgtaaaataaagcaggatctgctgctctagcagtcatttaaccaaaaaatggacctggtaactcaaggggaaattttaaagtaaaagctccagtttttttagttttaccgaaacgcagatatgcccattgtctgtggctgcttcaaggctataaccgcataatttgaatagttctaacaaagactgtatgggccaaaagaccacaaacatttactctctggtgtttcagtgaaaaagtttgccaacccctagtctgtgacatctgtttttatggtgctccgagtatgccagatgccagatacaaaatcagaagtgggtctagggccgggtgcggtggctcatgcctgtaatcccagcacttttaagaagcagaggcaggcggctcacttgaggtcaggagttcaagaccagcctggacaacgtggtgaaacgccatctctactaaaagtacaaaaattagccaggcgtggtggctggcatctgtaatcccagctactcgggaggctgaggcagaagaatcacttgagcctgggaggcagaggttgtggtaaactgagatcgcgccactgcactccagtctgggcgacagaatgagaccctgtctcaaaaacaaaaaaagtgggtctcaggaaaatttgtgccatgatatgttttcagaatatttgcaagactttcttaaatctgtcaacgttactatcttttgtaaataacaattaaactatacccaaaatttcacctgcctttggttgccatcttctggatgttttactaatattcttaaagtttttgtgtgtctggacatttcttgtgccgatgaatggtcgaatctgtttttatattttggtagagtagctacccatactcatgagaataaattgtgaaatttctagtttttttttttaacttagagatacatggagaaatgagaacttgttttgtaaatgtgagtccattttcaggtgttggcattttcttcatttgttaacaggggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaggaagttcggaagtagacattttaacacagtaatgcttatgaagtaaaattctggtggtttctaggcaaaatggtttttacattaaaaaatacatgcttgaaacctttgggctgggaacagtaaaaactaagaattttgttaaaagtatgtctcctgtttttacaagaccattattttggacaagccttttagctaaacagattttaatctattttatgctagtctctaaatcttctggaagtagtgtttgccagtatatgtaaagatggtttgtaaaacctactatgttttatctcacacacccaaatagaaaagccataatgtttcatataaaatgtatcccatacaccttgacttttgcatttacataccaggtagatcacatatagctccagattattcatcttaagagctttgtaacattttaccctcagcatataacacaaagtggttatctcttctgctgtggacaggcattttcctagcacagacttctcttattattcccttaggaggcacctccttgggcttgtgagtcttcaagcagatgtgttatagttctggattgaggctatcttttattaagattttttttcacacatgcccatgtttacagataaagacagttttaattcttactttccagtccttatgccttttctctttttttttttcctctttttgagacgaagccttgctctcgcccaggctacagtgcagtggcgcagtctcagctcactgcaacctctgcctctcgggttcaggtgattctcctgcctcagcctcctgagtagctgggactataggcgcacaccaccacgcccggctaatttttgtattttttgtagagacagggtttcatcatgttagccaggctggtcacgaactcctgacctcaggtgatccgcccacctcggcctctcaagagtgctgggattacaggcatgagccaccgcacctagccttctttcttttcttgctgattgcactggccaggacctccaataaactctgaaatgtaagtggtgaaattggacctcttttgctagttcctgattttaaggaggaaggacttcatgttttatcctttagaatgttagctctaggattttcgtagatgtcctttatcatgtttaagacattccctatattcagagtttgctgaaagcagtcagatgtttttcctgcatgtattaagatgaccatatgatttttcttctcgtactgtggaaaattatattactatattcatgaggtatttggattaataattctcctgtcttgtagtgtccttaattatttcacagagttcagttggtactgtgttacactgcggctggcagtgcataaaaaatcctgtggttccactttttaaccaatgtttggcatcatcagacttttcggtttttccattctagtgggtgtgaaatagtatttaatgctttttgttggttttgttttacatttttctaattaatagtgagtatccttattatatgattattgggcattctagttttcacaaagactagtgccaatctttggaggccaggaatcttagcagctggaccctgactccagggcagcagggtatatatattcatggcaccacctgtccatgctgccctcatccctcagcatcacacctagcctccagggctcaagagtcaggctctggctgtgcgacccacatttgggcctcgactccagcaccaggacaagttaagctgggacagggctattataacttttttcagaaagttatttaaatgcttacgtttgtttttcaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgaggtaagacttatgcctttgctcaaagcattggccctgtgatttttctcatgtgagtttgttgtagtttatttgacttgggactttaaagtgatctttttaactcaacctttaaactgaagagtgttgttgcaatgaatgctgttacatagaaggtcctccaggaggtacaagatgttggtaaaataataaagctaacagtcgtgtatggttggtaggtattgtcatcatccctgttttactaagaactgaggttgagtgacagtaagcagtttgcccagggtcacagctagagtgaggtgagcctcaatttagctgctggtcatccgacctctgagcccatgcttttttttttttttttttttgagacaagagtctccctctgtcgcccaggctggagtgcagtggtgcgatcttggttcactgcaacctccaccccctgggttcaggcaattctcctgcctcagcctcctaagtagctgggactacaggtgtgtgccaccacgcctggctaaattttttgtatttttagtagaggttttcaccatgttggccagactggttttgaacttctgatctcaagtgatccatccgcctccacctcccaaagtgttaggattacaggcgtgagccactgcacccagccaggagcccatactcttaaccagccatgaccttttgtaacctcctgacctactggtaaggtgcatgtggaggacatctaaaaacattaagtatctatgttcctcattcattatttgttccacaatgatgctaagaagaaaaatagaataacctctgactgtttaaagagcagcagttagtgagatggctgagcaaatgagacaaagtgagcccacctggagcctccctgcagctcctctttcctgtctttcattccacggcgattgaccagatggattctggccatacataaaagctcatctcagcctcctacagccagttccattttcacgccaccataaagcagaagcacttgcaggcagggagaaccaaaggtcaggatggccacctgagtctgctttccaagagaaaggatggttatggcggtcactgccttcctagctctgcacatccacagatggtcaggggcggacagagctggcctctgctctgcagctcaggctgcgctctgctcccttgatgttgtgtcgtaggatgtcgtccctggcactccggtcatgctggagtgaaacggcagctaccttcatgtaattctgtttcgttggtctttctgctcacctttgagccctggctcaaaactgtactttcaggaagttgatagcctctacttttgaagcagtcattgataccacatcccctttgcctttggcgttctgtgattactaagttaatctactgtctctctttcgtggatgtttgggatatgcccatacaagggtcttcgcctcatggaaccttggaagccttgcctcctacagccagagcgggcgcttggtcctcagggaatgctgaggcaggaccatactcaggcacacttaaaatcctagggagattttatcaagtctgagatgctgtcagccgtgagatgcaccattgttttgtgtcactaaaaatggaagaacagccaggcacggtggctcatgcctctaatcccagcactttcggaggttgaggcgggcggatcactggaagtcaggagttccatcctggccaacacggtgaaaacccatgtctactaaaaatacaaaaattagccgggcatggtggcagacgcctgtaatcctagctactcagaagctgaggcaggaaaattgcttgaacctgggaggtggaggttgcagtgagccaagattgcaccgctgtactctagcctgggtgacagcaagacactccatttcaaaaaacaacaggaagggaagaacagggctaccaattaaattgtgacttaccagttttaaagttccaatttcatggattttaaaatgtgcttcataaaactctgtacctgtttagtatcccttgtccaaacttcttgggttctgaagtgtctcatatcttgggtttttttggattttggaatattgccaaaatgctccaatgagcatttcctttgagcttcattttgacactcaaaaaaaagtttccgattttggagcatttcagattttcaggttagggatgcttcacctgtagttgggtgttcaaggcatcagattttacactttcaggttgcaattcattaatgaaggtcgtttgactgattgccttcaaaaattgaatttttgacatttctctagaatttttgaaattttctagaatggaatttctctagaaataatattctcgccaggcgcggtggctcacgcctgtaacctcagcactttgggagaccaaggcaggtggatcacgacgagatcaggagtttgagaccagcccggccaatatggtgaaaccccatctctactaaaaatacaaaaattagccaggcttggtggcgtgcgcctgtagtcccagctacatgggaggctgaggcagaaaaatcacttgaacctgggagatggaggttgcagtgaaccaagatcgtgccactgcactccagcctgggcgacagagtgagactctgtctcaaaaccaaacaaacaaacaaaaaagaaataatattctctgcgataaccctgtcagtaaaatctgttgccagaaacttatcttgttaaagtaacttcttgattatatggagaaataaaagtgaaagcacgtaatacagtagtagtaaaagcaaagcacctgtgtattattaggaattcactcactagccatttctgaactttcagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtaaatgtgtttatttttctccttagttttgataacttaagagttgccctgtgtgcacttcagagcttatagtgcttggctaataatgcagcacctctctatctccagatgagtgctgtagcgaggggtgccctggggacggtgttgcaagcaagcagtgggtggcctgaagcaaggctgtggtgaccacactgcctgcttttacttttggtgtgaaataaaaaatgatggcataggacaggccacgggatgtctcacctgctgagcagcctaggctgacctaaccaaatttgtctttgaatcagtcagcctttgcgtctctggagatgggttaggtaacacccactcagaaaggctttgctgtgccttcacctgattggagaacctaaacctcttgacaggtactgtcttattcatcaccccagaacctagcactagtacatgctcagcagagtgcatgaaggagtctcagaggagatgacagcatgtttctgagcttcttaaggaaacttattttcataatcctcctggatctaccaggatattataacgaagtgtgttgtgatttagcatcttttagcagtgcttttacttcctaaacaaatttagttcgcttttttgtattttgccggaatactgacatctgattctgtactctgattttggggatatcctgttttaaaaaccagtaggactgactgtgttggccctgcatgaatctctttaaccacctatggagcaaacaaaacattttgaaaatggaaaatatatcacattcgcaacaagcacatttgaatatgttttttattatagacccatatgattgaatgcagtagccactgcctgcacgtggctagctagcacttgaagtgtgacaatttgggattgaaagatgctggaaatgtgaaatacacaccaagttccaaagatttcatatattgattacatgttgaaataacagtgttttcgttatattgagttaaaatattaaaatattgtaagatttgatatcacttgtttctttttactttctaacgtggctactgggaaatttaagattccatatgtggctgctgttacgtttttttgtggtcagtgcgactgtagagaactaactccattaggctttcaagcatataattagaagcagggtgaggaaaactgggattctagaagaaagaccacatccatcctctctgcctatccccttttccaactccaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtatgctgtcttcactctgtcctttgggagctttggggactgtcgttgattaatacctgggctgatgatgctgcccatgctgtgtgttagcaaatctctatctctgttcctgtggccttgtaggcatcaccagtgttttcacatttatttgtggtgcatatattgtaaataaatatggaaaggtagaagactttctgccttttaaaaattgataatttgggccgggcgccgtggctcatgcctgtaatcgcagcactttgggaggctgaggcaagtggattacctgaggtcaggagttcaagaccagcctgaccaacatggtgaaaccccatctctactaaaaatacaaaaattagccaggcgtggtggcacacacctgtaatcccagctactcgggaggctgaggcaggagaattgacttgagccagggaggcggagattgcagtgagccaagatcgtgccactgcactccagcctgggcaacagagcgagaccgtctcaaaaaaatttttttttgataatatggccaaatattgactatttcttggtgttcagaaaaatgatttattctgtcaaatttttcaggatgcagtgggagatattgtcctgcacaaataggcatttttaccttattaaaatgactttgttcctttatataactatttctatttttggttactattgtttaatttattttttgtttgtttgttttgatttggttttttgaggtggagtctcgctctgtcgcccaggctggaatgcggtggcacgatctcagctcactgcaaccttcgcctcccagcttcaagcgattctcctgcctcagcctcgattacaggtgcccaccaccatgcctggctaatttttgtacttttagtagagacggggtttcaccatgttggccaggctggttcgaactcctgacttaaagtgatccacccgcctcggcctcccagagtgctgggattacaggtgtgagccaccgtgcctggcctgtttaatttcttaatctacaacgtatgtataccagagaaacttaacaagatcttccattgtgatcatacttggccatggtttttcagtgtaatactctaaattacttcttttatacactatttgtaaatgactttttctcctgagataatttcaaagcttccactgcattttcacatttctcacttccttgagtgacttaagtcagttaataattagaattttattttgggtgtagatcactttaagcgaacctgatttaaagtctagcttccaaatctttgataaatcagatgagcattatttagttttagtttggtacagtatgaaataaaagtttgtggtctaaagattatagcaagagcatattttaatgttatcagaggaaaaaattacatgtaaatacatatttcctcatatttacaagtaccccattttctggaaaaatgaaatgcttttggctccagatattgcttaggtaatgtctaacgtactgtaagcaaagttctcagctggcactgttgacattttggccaaatgattgttgtagggccctcctgttcgtcgtggaatatttagcagcttccctgggcctctacccctagatgccagtggtaacaagcaaaactgtctccagatgtcccatcaggggcagggtcattcctgtttgagagctacttctgtaagggaagcaaacgtccacagctgtgactctcagcttgcttggacaccacagagacatatagtcgtccctgccttcacatctaatagaaatcaccaagagcttattaaaaacttaaatcctgagacctaactaacacccagtcaatgagtttttgaagctgcatgattaattttgttgtccagctggaatcagagctgagcagctctggtgcagtctcgtttttttgcttgttttttgtaagggggaagacagtcttcaagaactagattctgcagaactgggcttcatttgttggtttatagttgagtgtgagaaatgtgtcctcattctcagctcaaataggtgatcacataattatcctccagactttcgaaactggaaaaaaaaaaaaagtgctactgataattatgtgggctctggcaaactgggactgtcccaggcataagattgccatcactcacttgtattcattttttgaaaaggccaatgcacttgataatgtaataaaggagaagtctgaaaattaaaaacaaaaaacaaaaaactgttcttaatggtgtgagttagaaagaacgttttaaaaaaaatttttttagaagtgtgaaacacctttggaattgttagatgccagcagatctgctttgaaatacagcaatgtgttttgatacaaattcaatatgctgaagaaacagaagaaaattatgtctaaatatacgtatttgccctataattgcaaagcattacggatagcagtttactgaactgtaaatgacatcaacttcttttctctcataggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaatatgttgcctttgagtctggcttatttcacttagcatgatgcatttgagattcatgtatgatgttgcaggttcttttttattgccaggtggtattccattgtgtggctgtaccagagcttgtttatccattccccagttaaggaacttctgggttgtttccaggtttgggagattattagtaaactgctataaacatttgcgtacaggtttttgtgtaaacgttacttcatttcgcttgacttcagtttgatgaagtctagtttaatcagtttgttctttcatagattatgcttttgtcatatcttcactaagatgttctatcctaagagaaatcttcacttagcccaaagtgtaaagacttctcaagtttcagaattttttgttttatatttatgtctgtgatccactttgagttaactttatgtgtagtatgatataggtgttgagttttctgttttaaatgtgtccttattgtaaacacagacacacatatataaggcctaaataagacagttttcatttagataaattagggaaacaatttattgtgaaagggacacaactcagtaagtctgttttttgtccccctaccttttagtatgtggcatgaacacctggtcaggtgtagatacctagagctccttcctaaggacatttctgttgcctaaccatcttcccacagcactgagcatggtgcagtgagttcattcagatggccaagctttagggtcagaattctgcttttgcccttcccctatactaacgttacaatcaacagaaggcttagtgaacatccactaatgctgcgtgagtcagttcctcctcttgacctctgagcaagtacttaatgcagtacacaaggcactgagcagatggagatgactcaggtgaggagacacagacgttgacactgggtggcttccgtctagacagggagcagttggctaggaagggatgtggcagtaaatgcaggaaggccacctagcaggcagatggggagtaagttttcggttttcttgactcgcagtttgaaaaccatttactggatgggaagccaggctctgttttccgtccaatttgcagaaagcaaaccagagagctgtgtacacagatgcatccgggcacacgttactgcggctgcccagcagccctacatgtagagagtgacctggcactctgtttccaggctgcttagccgggtttccccagatggagtg

SEQ ID NO: 15342 - DNA, 5190 bp, Human
ctggtgtatactgtgccaaatgcagcttgggctggtttccaaccaaccatctcagagcacagcaacgtttgtgactctggtcacaaggaaagtttgaaaggaaaggaagagctttggtgtttcagagatcagacaaaggcagagatctggaaagacaagtcacactgaggttcaagataaatgattttggagaatgagactaccataagacaaagcaccatgggcaagcagggcagaatttcaaatctagtgaacactggagaattaagaagaaagatcaactgggaattttggctggaaaaaaaatgctactaactcctcaactcaaaagactgtcattagactcaaagaagatataaaactaagctacctgaattccctgttgtggagtaaacctgattaaaccaatgtattaccctttaaggcagagctttgtaagtcatcatacttgcttttcccatatctaaaaatcctaagtttggttatgggtaagggttaccaccaacttccttcaggtgaaatgtcatctacagataacttagccaggtgcggtggcaggtgcctgtaatcccagccactaggggaggctgagacaggagaatcgcttgaacccaggaggcggaggttgcagtgagctgagattgcgtcagtgcactccaacctgggcaacacagtaagaccttgtctcaaacaaaagaaaacaaaacaaaacaaaacttcttctgaaaaaactaagaaataaacattttctaacttgctcagattttactcaaatcatttgtctgcaaatcttctgatgttcagaaaataaatatccttattcaacttcattggcaatgaaatgaaaagcaatatattaaaaaaaaaagatgatgttctgattctttaaattaacactatgcagtttaaagatgttactgagggtcggctgggtgcagtggctcacgcctgtaatcccagcactttgggaggccgaggtgggcagatcacgaggtcaggagatcgagaccatcctggctaacacggtgaaaccccgtctctactaaaaaaacaaaaaaattagccgggcgtggtggcgggtgcctgtagtcccagctactcgggaggctgaggcaggagaatggcatgaacccaggaggtgaaacttggagcctggatctgagatcgtgccactgcactccagcctgggcgacagagcgagactctgtttcaaaaaaaaaaaaaaaaggttactgagggtcatatagtgccagtgggaacaaaatccccagcacaactctctggaaagcagaaacttcatcataattatgggaacagctatattcttaaggatttaaatcctttgggaaacaaagcagggcataaacaagcaaacaaaatatggacagatttctgtatcttttgtaatagtaatataaattcgaaacaaacgatataaaaaaagcctaactgaaccaaaaattgcaggataaaatgaaaatatgccattacctatgaaaaagaaaaattggatataaacttttctaaacagtataaataaaactttgccaaaatatgcttaaaagagtggaagaaaatacaatggaataaaatttagggtggtgatatgtgtaaaaattaactttccaacttttccaaacacagaatggcacttttataattacaaaaacagtttaaaaataaaacaaaactgggtacagtggctcacacctgtaatcccagcactttgggaggccaaggccagagatcacttgagcccaggagctcaggttcagcctggacaacctagtgagaccctgtttctacaaaaataataataataataataataataaactagccaggcgtgttggcatgtgcctgtagtcctagctgcttggaaggccgaggtgtgtggactgcttgaacccatgagtttgggactacagtgagcaatgatctaaccactgcactcctgcctgggcaagagtgagactctgtctctgaaaaaaaaaaaagaggagcagtgtgaagaagaggcgagaacgacccccggaccgaccaaagcccgcgtgccgctgcatcccacgtccagcacctacgtcctgtcgccaccgccaccatgcccaagagaaaggctgaaggggatgctaagggagataaagccaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttggtaactgtgtatttctggtgactgtacagtttgaaatacttttatcaagttttataaaaatgcagaattttgttttacctttttttttttttttttaagctatgttgttcgcacacagaacacttcattgttgtttttgggggaaggggcatatgtcactaatagaatgtctccaaaactggattgatgtggagaaaacacctttcccttccagttttgagagacttcctcttggctcccaggaggagggattccttgactttgacacacatggccaccttggcacaaaagccttgtgctatggaaaaacaaatttgtttttatgtcctcttctccctttccacgtttcagcatagacttaactcccttaagcccagacatctgttgagacctgacccctagtcattggttaccagtgtgtcaggcaatctggactttcccagtgatgccactgagatggcacctgtcaaaagagcagtggttccatttctagattgtggatcttcagataaattctgccattttcgtttcacttcctgaaagtcagggttggcttgtgaaaagttgttaaacaacatgctaaatgtgaaatgtcaaccctcactctcaactttccctgttcagagcatcagatgaagacttcattgggttttatagtggctttctgatttttggtagtccactgaagaagggagtttgaaagttgttgtatactgttaacgattgtctgcccatgtcctgcctgaaataccatgattgtttatggaaagtatctttaataaagctggatacagtttggcttggaaaaaaaaaaaagaaagtaaataaaacaaggatctgtaagcaaaacgtatttggcatacaaagcactgcagcctcaatacttatacttactatcttattataaatgtctgcaataacaacagctgataatattagcaatgttttattaccctttttaactatttgtgtatttgtcagtttaatgactaaaagagctggaatggagcaagaaagggctgtggtcaaagccgagtcttgtcacttgttcactgagggccaccaggaagtttagactgaagaaactggaaaggatccacgcaatgaccatccaagtctcaggctactcaactgtaacatggatattatactccttacctcagagcatgactgggaggattcaatgacattgtatgttatgcaattttcatatgaagccaagagtttcctaaacggtgacttttctcattaaaagaattggtggaacaaggacatggtcactggggttttctcaccaaattaaaagaatgggataaactgctaatttttcactgacaaaaagtcttatttttattgaatgagtgaatcagaactcactcactttagaggtgtaactcccaacctcatttaagttagccttgaggctacttacttgcaatttgataaatatctggttcttctcttgccagcttttctctggcaacatcagctattggtccaaaaatggttacaggcctcagaaatccagctggagagaaattcacatgaaaaacagcatattttataccttttctttcttaaacatattgacgttaaagggtattaggttagtctgtagaaaataaactaccttctcgaagaaccactctttcataagctggaaactttgtttgaacaggctgagcggacaaatcctctctgctttttcgaagatttctcttggagctgcgaagacctctgaatctccagaagtcagcacggtctccgcctgctgtttttggaagtgtatactgtacactggctagctgctcagctctacacaagaaaggagaaaattaaaataagggcatttaaaatgcaaaatggaaaaagacccacaatgaaatgaaatatacaatactggatggaagttcacatacagtttaaatcttaatggttataataaagaggagtttgtaaacctaagtcagttatagatacgttgaatacaatgaaaaagaattctttacattaccaaaatttcccagtgggattgaaatgatctatcatcatttacttgattcactctatgagaagtatccaagcattcatacctgttcttattagggatgatgcctcgttctacctccttatgatttttaccaattcgaatagcaagccaagagcccagttttccattgtacaaggtatccacaacacggaacacctctcctttgttaaaactaagtccatagggagattccttttcatattcaaaatgggttctaatatagaaagaatctcctacatctgattctacaatgcgacgataaactaaaaggaataaaaacaaacacattatcaatatttagtgggataacaatctgaaagacagtacattatgtaaagatgctatgataatatcaataataatatccaacaaattcttactatgtgccaggtactgtattatttcatgtattcatcactgtaagaattgaaactcttagtacttccattttgcagatgaggaaactgatgcagaaaatacatcaagtaacttgtcaaaagccacatgcttgttttctattatatcatctaacttatctgcaaacattatagacatttccatatctaaatcagcagttctcaaataaaggtaattttatccctcgccatccaacattggacatttgccaatatgcagttttgactgccccatctgtgtactgaaagggtaaggggtgtgtgctagtggcatctcatctagtgagcagaggctaggaatgctcctaaacatccacaatacacaggacagccc

SEQ ID NO: 15343 - DNA, 49144 bp, Human
  misc_feature (1)...(49144): n = A,T,C or G
tccagccggtaatggaaaatttaatccaccgcttttgtattgtaaagtttatttagcgtatttttttatttttgagacagggtcttgctctgttgcccaggctggagtgcagtggtgcacacactgcaaccagagctcactgcagccttgacctccccaggcttaggtgatcctctcacctcagcctccctagtagcttaggctacaggtgcataccaccattctgggctaatttttgtattgtttgtagagatggggttttgccatgttgcccaggctggtctcagattcccgggctcaagtgatcctcctgcctcagctgagtagctgggatgacagttgcgtgccaccatgcccggctaaatgttgtatttttagtagagacaggatttcaccatgttggtcaggctggtcttgaactcctgacctcatgatccgcccgccttggcctcccaaattgctgggatggcagcagcttttttttttttaatgggcatgttgtgcagatgtggttcaggagagtgagccagtggcccaggtcatccccaggtttctccgccagcagtgacgccccaccctggggagcaacttcccttaggcccagctagctgcagaatgggggtagttggagggaacctagaaggacctaagcgcagggccctggcaggtgagcacagcatagggaggtgccaggtggagaagtgtgcagggaagcagggaaggatggtggaaacatggcggcccaggggcagaggttgcagatggtcgcagttgccctggtcccgggaccaaggggcgagagctaaaaaagtgggaggccccactggggagggtggcggtagggctgggagaatgtggctgtggcagggtgggcggggaccttccagccacctggagcatcctgggtggagggttgggtggccttggccagatggtcacagttgctgggaccaagtgtgagcacagacctctagagtttgtgggtgtgaagtgcaaccgtggtgactggtcctggcgggtgcttaggaggcgggggcagagacatggctcactccagcctcaacctcctgggctcaagcaattctcccacctcagccactcaggtagctggggctacaggcgtgcaccatcacgcccggctattttttttttttttttgagacagaatttggctcttattgcccaggctggagtgcaatggtgcaatctcagccacaacctctgcctcccagggtcaagtgattctcctgcctcagcctcccaagtagctaggattacaggtgtgcaccaccacgccgggctaatttttgtatttttagtagaaacggggtttctccatgttggtcaggttggtctcgaactcccaacctcaggtgatctgcctgcctcagcctcccaaagtgctgggattacaggcgtgagccaccacacccggcctaatttttgcattttttggagagacggaggtttcactatattgcccaggctggtcttgaactcccgagctcaagtgatccagccttggcctcccaaagtgctgggattacaggtgtgaatcttctattactttcctgtgtgtccttcccaagttcacagaaaacacaagctgacagaaatccattctttcccacggttgctggcacggatgctgctgtgtgacagcacaagttcatgtgcttgagggtctcctggccacagccagccccaggcttgccctggacaggcgggcttcagattccccccaaggttctatgccattgagttggaggacaagagcttccccactgtccagcgttgaagcaaacctccctccaggtcccacccctccccacgcctttgtccttttatcagggattgccctgggggagcccccctggggagctgatgaggagggagcctctgtgccccgtgcactggcctgagggggtgaggccagggctggggctgctgcaggggactctggcccggagctgcggctgccttcctggaaacactcctgtcagatgactgcagagtgagagtgaaaccagcttcccttggaggctgcagcacagggctgacatgcaaacgtctgaaaaagaggcaagctctcggtgtgagcaagtggactgcggctatttgaggtgggcacttcccctggggacagcaccaggcacacaagggtcccttgttcatggtcccgtggggggcccagcttggacattctgcctcctggctccatgtgcaagctgggctctgtcgtcccaagacctgagtaaaaggacatgaggtgtgagccttcaagggtgccaaccacgcccaagggaagccaagcatccacagagccctgctgggcacagagggcagacgcagccgctggatttcagatgcatccacagagccctgctgggcacagggcagatgccagtggcatggcggcccctcacctcccgtgctctgcaggcccagtaggtagctgtggggtcctccctggccaggccagtgagtggctggcatccacggcagcatctgctgtggtccatggtcatgccgcccctccagggacactggcaccctcgtcaggacacggagcccaggacagcagctgcatgtgtccatctccaggttccaactgctgccctccttcctgctcctgcaacccccatcctcaggcagtgagagggtgctggggcttctcctgagactgcccggggacataccctccccctgcccctgctggaggcctgggtggctgacttttgctttcttttcggcaggaaggagcccacgtgggaatcccctgagctgcgccatggccagagtgagtcacccctttccagccagcaaacaaggcgagtccccaggccaaggtgtcacagcttccaagctggtgggcggggtggggaggccgcttcccaatcagtgtgtgcctctgcctctcagtcaggctggtatcaacttgctatgccttacaggcctgtcatcacaatcaatattattagacagagtcttgctctgtcgtccaggatggagtgcagtggcgcaatcctggctcactgcaacctccgcctcgcaggttcaagcgattttcctgcctcagcctcctgagtagttgggattacaggcacctgccatcatgttcagttaatttttgtattttagtagagacggggtttcaccaccttggccaggctggtcttgaactcctgatctcaggtgatctgcccacctcagcctcccaaagtgccgggattacaggcgtgagccaccatgcccagccagttttttttttacgtgtctgtgccaatcttctggaaacagagcagtataaattaaacaaaggcattttcatgagagcagcactggggcaagtactctgagactgggcggcacggggcagtcatcctggtcactacctgctctcgagggctgtgggcatttgccaagcttgggaaaccttttctggacttggggtggggctgaggtggtctcagactcagcccttcaacactgtcatcatccaggaccagtgaggtgtgtcaccccatgttggaggccactgtctgaaagctgttagaatgactttcccgttaccctgaaggaagtagagtgtcctaaaacaggtgaaccccttcttttttctttgagatggagtcttgctctgtcacccagggtggaatgcagtggcgtaatctcggctcactgcaacctctgcctcccaggttcaagtgattttcctgcctcagcctcctgagtaattgggattacaggcatctgccaccatgcccagctgatttttgtatttttagtagagacagggtttcaccacgttggccaggctggtcttgaacccctgacctcaggtgatccacccacctcagcctcccaaagtgctgggattacaaacatgagccactgtgccgggccttttgtgtatttttttttttttttgagatggattcttgctctgtcgccaggctggagtgtagtggcgcaatctcggctcactgcaacctacgcctcccgggttcaagtgaatctcctgcctactcagtctcctgagtagctgtgagtacaggcgcgtaccaccatgcccagctaatttttgtacttttagtagagacagggtttcaacatgttggccagaatggtctcgatctcttgacctcatgatctgcccacctcggcctcccaaagtgctggggtgagccaccgcgccccgccttttgtatttttttagtagagggtacgctccctggctgggctaacggtcgggggaacttgcttgctgcgggcggcatgggtgcccccgcgggccgttcgatgtccctttcgcagaccggcgcctaagaataccggtagtggtttctcacccgacggtgcttacggggtttccctggcgtgctttgtcgtagcgttgtcaggtttgacccttgcaatgcagggggataccctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaagacaccgtctcaaaaaagaaaaaaaagagacagggtctcactctatagcgcagcctggagtgcagtggtgcaaccacagctcactgcaacctccacctcctgagcttcagtcatcttcctgcctcagccttccaagcagttgggactacaggtgtgcagcaccacacccagctaaattttttttcctttttttggtagagatggggttcccccatgctgcccatgctggtttcgaactcatgggctcaagcggtcctcctgcctcagcctcccaaagtgctgggattataggcatgaactgccacgtgaaccctttctcatcccgagctggctgctgcagactcaggacagctttgagcctcccaggtgcagccaggaggagacgccttcttacgtttgagagctcagttagttcctgggcttgagcaacctcactgagcctgcaggtgcggacttgggacatttccatggctgcttgcagcaaactcaggggtgatgacgttgatggaatccgatggcttcctgagttccatctcaaggccttgctgtcccaggaatgtgggtttggggcggaggggaattccaactgcaaaccaagtaacatatatgaaatgtggcattggcgcctggggacagcgtggcctgtgtaaattatgcaacttcaaagcctgccctgttttgcagtgtattccatccttgaggagtcccgtggtctcagggtctgaatgcttggaggagacttacctccgtgaacgtttccttctctgcaaagcggggtgaaaggtctccatttcaccaaaggctggatggagagggggtggtgtgtccagtgctagcccgtgcaccgccagagagaacctgctgcagctcccgttctcctgggcagatgacagtgccgcctcccccatgcagcccacaggactcctagggcagcccctgttttggccgccaaggccactgttttcatttgagtgtctggaggccataggttgtgttttcacttgaggtcgggagttcaagaccagcctggccaacatggtgaaacctcgtctctatcaaaaatacaaacattagccgggcgtgatggcgggcgcctgtagtcccagctactcgggaggctgaggcaggagaatcgcttgaacccgggaggcggaggttgcagtgagtcgagatcgcgccactgaactccagcctgggcgacagagtgagcctccgtctcaaaaaaaaaaataaataaagtgcacaacccagtagattagcacaccggccatgtcgggcggccgtcaccactgtccggttgcagagcattacctcaccccaaaaggagaccccatagccttaataccttacttaagtgtgcagtattcttttagtcctgtttctcataaatgttacccaaattgaggcgccgctctgcgcccggcaccgggggaggcggagggacccgcaggtgtcgggtaggtgcggccgccccgccagggccccgcgtcccgcgcgcgacgcgcgcctcgtgggaaccggtgtcgcccggcttgggctcccggctcacctctcgggtgtgcggcaggggtctccgccccggggccacgggaggggaagcaagggcctcgctgtctcgccgcacctggggaagggacccaattagcgcggaccccacagcgcagcacctcaccagctccccgcaccaacgccccggcgcgctctttgaggaaaaagcagagggcgacttaggtacccacgccgtctcagcgccgaccaatcggcgcacgctgcggctcctgcgggctcgctggttggctccggcgtcagtccgtcaggcgcgctcggagcggggcgtatctggccaatggctctcgctacagcttcctgagggctggctggttggctcccatgtccgtccgtcaggcgcacgcggcggagcggcggcggcggcggcggcgttgggggcggtagctgggcgggcccttagttccgggcgcgctgcgaccgttgggtgaggcgagcgcggggtcgggtgcggggtcgggcgcgggcgcggggtcgggtgcggggtcgggcgcggggtcgggcgcaggcgcgggcacctctcagggagactccgggccggagcgggagcgggggcgggagaggccgcggggcgggggcggggccagcccgaggggatttctctgagccgctgggccggaaaccaagtccgagcgtggctggcgcgggaaagttcgggaacgcgcgcggccgtgctcggagcagcgccagggcacggtccggggttttgcgcggggtcgcggctcccagtaccgcctgaggcccgtgggcggcccacccggccctgccccgtcccgggtccgtcgctcccccgcaccctgtcgcccctccacgctcagctgtgggcccctcgtgtccccgaagccccgcaccctcagccggctgcgtgctcgggagggtcaggggcgcctccgacccctgagtttgccagcgccccccagccaggggtcggggaagaccagtgaggctgggggcggagccgactctgctgccttcctgcccagtggctggggagacccaggctgagcctgggtgaaaagtccctctggctgctgggagggtcgggggcagcaaggagccagtgcggggatgggctgcggtggaccgggccgggatcggggccggggcctggtcctggcagtagcaggggatgtttgtggaaggtagagccgagaaaaagaggagttgcaatgtctgcaagaatctggcgtgagcagctgaaggctggtgcttcctaggccaagatgaaggagtcacagcgcccatggcctctcgggaggcggccagatgggcagcctggggtcaggggaacggtcagggccagagctgggtattttggagttgtcattttgaggccccgagggctgagggtcagtgcagaagagcaccaagcctccactcggtgtagggccgacagggggtggggtgtctggcagccggtgaagacggggctcggaggaggagggagtctggtctgggtcaagtcaagggaaactaggactgagaacggaccctgctctgtggccacatgattttgaagggacggaattactgccctgtaactcagtctctctccctgttaatagccctagtttttaataagaggaactgaatgtattaatgggtggacacttgtaaggttcaagatctcctcttctaccacgcttgcttctgatacttttgtataaacagttgttaagagtttaggttgttatcaagcttctatttggtattattttgagcctgaaaaagatggggttacatataaaattgtaattttatttatttattttttgagatagttttggtcttgttgcccaggctggagtgcagtggctcgatctcggctcactgcagcctccgcctcctgggttcaagcgatttttctgcctcagcctcccgagcagctgggattacaggcgtgcaccaccacgcccggctaattttttgtatttttagtagagatagggtttcatcatgttggccaggctggtttcaaactcttgaccttaggtgatccacccgcctcggcctcccaaagtgctaggattacaggcatgagccaccgcgcccggccatgaaattacagttttaaagttaacttctagtatttggagggcctcatattcatggctgcatgcagatcagtgttcctgaatattactcagatgagcttttatagaagtgggttagaatcaggtgccattgacgcctgtagtcccagctactccggaggctgaggcaggagaatggcgtgaacccgggaggcggagcttgcagtgagccgagatcgcgccactgcactccagcctgggtgacagagcgagactccatctcaaaaagaatcgggtgccacccagtgaactcttacgtggagtccagtattgtatgaagcagttgtgtgctgttggtggagacatgaattgaggtttgaatctccagcatttggggcatcttggagtctgcttgtgagaagggcgaggcctgggttgaacccaagcgtttgcggcgactaggtgacccctgcagcggccaggttgcacccatatctgatttgatgtcatggtttgggcagtgtttgacttgtgtaacaatacagcttgtccttttgagagtcaccgatgccaccaaaccatgttcacacaccagagtcaggatgccaggtctcagctgcctgatgactccagcttagtgaaggcctctgatttcttgtgggggtgtcccattgtgaagggaacacacagctcggccctaccagcaacaagggtgccagatgcccccactctcctgtggaggggagtctcgctctgtcacccggctggagtgcagtggcacgatctcggctcactgcaacctctgcctcctgggttcacgctattcttctgcctcagcctcccgagtagctggactacaggcacccgccaccacgcccagctaattttttgtatttttaatggagacggggtttcaccatgttagccagggtggtctcgatctgatctcgtgatccgcccacctcggcctcccagagtgctgggattacaggtgtgagccaccactgaggggcttttttacgttaaaacttgtttgtttgtttttctttttttgtttgtgtggttttttctgttttttttttttttttgagacggagtctcgctctgtcccccggtgtgagccaccacgcctggcctttttttttctttttttgagacagagtttcgctcttgttgcccaggctggagtgcaatggtgcgatctcggctcgctgcaacctctgcctcccaggttcaagtgattctcctgcctcatcctccagagtaggtgggattacaggcacccaccataatgcccggctaatttttgtgtttttaatagagacagggtttctccactttggtgaggctggtctcgaactcctgacctcaggtgatccacctgccttggcactcccaaagtgctgggattacaggtatgagccaccttgcccggccttaaaacctgtttttgacatttctttgccattttaacttttttgttattttatttttatacctgaggtcttgttatgtttcccaggctggtctcgaactcctggcctgaagtgatcctccaacctcagcctcccaagtagctgggattacaggtgcaagccactgtgtcagttggtcaccgcatgtgtgagagttccccccacacttattcagtcggtcaccacttgtgtgagagtcgcccctgcatgctcattcagtcggtcactacatttgtgacagtcatccccgcatgctcattcagtcggtcaccgcatgtgtgataatcacccccgcatgcttgttcagctcgtcaccgcgtgtgtgagagtccccaccgcacgctcgttcagccggtcaccgcgtgtgtgagagtccccaccgcacgctcgttcagccggtcaccgcgtgtgtgagtcccccccgcacgctcgttcagccggtcaccgcgtgtgtgagtccccaccgcacgcttgttcagccggtcaccgcgtgtgagtccccactgcacgctcgttcagccggtcaccgtgtgtgtgagagtccccaccgcacgctcgttcagtcggtcaccgcatgtgtgagagtccccaccacacgctcgttcagctggtcaccacgggggtggcacttttgtttttagctgacttagctgatagaattgggagttttagagtaaaactgatctggaagcctgaaaaaaccagcagcacattgttcgtttccaggttgaatcgctcctagctgacccctcacgtctcttatgatacgtacagaaagcaagagcagcccatgccgtccggccgcgcaccaggtctcagtctgtgtgtctggttcaggtgaccatggtgttcagttcagttcctcctgcctcgtgtgtaggccactgagagctccctagtctaagccggaggaggttctggtaagtgctaggcacagtggaagtcggattccaacatgtgcgcaaattggggcactgtcagaagtgtgctaaaatcttggtgtagcacttttgagccttcgtggtggttttcattagttcttaaaatgtatttatgaatgagattcaaataaaatgtttaaggaatctctaagcacaaagaaccccagagtgtagtgtgggcatcagtgggacctcagggtcccctgaccgggctgcctgccgtgtcctggctgtctggggttgtgttttcatttggaaacaggaataatgatccccgaccttccagccgtgtcaggatgtcacgatggccacgtgaggccgtgtctgtgagaagcgtctgccggtggtggaggacgtgcactttgttgtgaacctcggctcactgcagcctcctcctccccaggctcaggtgatcctcccacctcagcctcctgagtggctgggaccacagatgcaagatcctcccacctcggcctcctgagtagctgggaccacagatgcatgccatcacacttggccattttttgtatttttagatttgtttttttatgtgtgttttgtttttgagacagatggttgctcttgctcaggctggagtgcagtggcatgatctcagctcactgcaacctccgcctctcaggtttgagcgattcttctgcctcagcctctggagtagctgggcttacaggcttgcaccaccatgcctggctaattttttgtatttttagtggagacggggtctcaccatgttggccagcctggtcttgaactcctgacctcatgatccgcccgcctcggcctcccaaagtgctgggattacaagtgtgagccaccgcgcccagccatttttttgtgtttttggtagagacagggtttcatcatgttccccaggctggtcttgaactcctgagctcaagcaatctgcctacctcggcctcccaaagtgctgggattataggtgtgagccaccatgcctggcccatttttgtggttcttttatgtctgacaggcatgcctagggcagggagggcacacctctgtctccaccttcaagagcgcatttaggaggaatgtcgatatgaaaagaatcaagctttgtctgaaagatgcaccaggacactcttcagtgacattgggaaaaaagaacgctcaccctgaatcttttttttttttttgagacgaagtttcgctctttgtgcccaagctggagagcagtggtgcgatcttgactctctgcaacctctgcctcccaggttcaagcgattctcctgcctcagcctcccaagtagctggaattacaggcgtgagccactgcactcggctaattttgtgtttttagtagaaatgggtttctccatgttggtcaagctggtctcgatcaccacctcaggtgatccacccgcctcagcctcccaaagtgctgggattacaggcatgagccaccgtgcccggcccattctgaatctgtctaccctagcaaaacgatcctttattttactttcttgccccattcgtacactggcatgactgcactcatagaattcttcacattttatatcctatnnnnnnnnnnnnnnnnnnnngctataaaattcaatgctataaaaagaacttaagagaatgtaagaggagtcagatgtcgtggttcatgcctataatcccagctacctgggaggctgaggcaggaggatcactggagcccaggaggtggaggctgcagtgagccaagattgcaccactgcacaccaattgggcaacagagccagataccgtattagaaaaagacaaaggaaagagagaaagaaaggaaagaaagaaaaagaaagaaggaatataagagggagcccttctaaataaaaaatgtgatatcgaagttaagaaaaatgttaagtagaaaggttatacattgaggaaatctccccaaattagaacagaaagaacatgagttgaaaaacaagaaagactggccaggcgcggtggctcacgcctgtaatcccagcactttgggagaccgaggcgggcagatcacgaggtcaggagatcgagaccatcctggctaacacggtgaaaccccgtctctactaaaaaatacaaaaaattagctgggcatggtgactggtgcctgtagtcccagctacttgggaggctgaggcaggagaatggcgtgaacctgggcggtggaggttgcagtgagccaagatcgcgccactgcactcccgcctgggcgacagagcgagactccgtctcaaaaaaataaataaataaaaagaatgtggcttaaaaaccaatgatacttaaaaatagaaaatttctttgtccaaagtggattagaagccactttgttctaaaaccattaaacctttttaaactgttagtggctcagccaggcacagtggctcatgcctataatctcagcactttgggagattgaggtgggcagattatctgaggtcaggagttcgagaccagcctggccaacatggtgaaaccctgtctctactaaaaatacaaaaattagccaggcgtggtgacaggcgtctgtaatcccagctactcgggaggctgaggcaggagaatcgcttgaacctgggaggcggaggttgcaccttagatcacaccgttgcactcccgcctgagcgacagagcaagactctgtctcacatgaataaataaataaaccattagtggctcatgaaatcaatgtaatagcttctgaccagaacaaaagaaagaaaatagaacactcagaatgcctcttatgaagactaagtgtagttctgtgaatcttttagtgacgtacatgtatgtagcacgtctccacatgtcatgatgaatgtgcgctgagggtgcagtcctggtgagcaggctcccacctcagtttgccacggctggtatgcatctgtgagctccggaacatccacatagctctgccgcccacaggagcaggtgcacccaccttcgagaaagtgggagaaacaggtgtggcctccccaccgagggaccttgagcactgggcaggcagagccccagcgtcccttctgttgggtggttggaggagtaagtttaggttataagcatgttttctgaactctgaagtgccacacgaatgcaaggtctcactaaattacagattcagaagctgggattgaaagcacaccactgctggctttggggggcagacaggtgactgacagtctcgtcacagtttctcaagagtcagccctattcaggtcagtgagcgcaggtcagggatgaggtcgctgcactctgcgttccccagtcctgtatgcggcgtcagttttggcagtccacgtgtctctcctgtagaggattagaggggccagccccatgggtctgcagggttggcgcaccgtctggggaagacacttggaatgtgctttcgttggtgagccaggtcaaggaaactttggggaatgtttgcagagagctgaggatggttgtcttggggcctaagtttttctgacttaaaaagcacctcctatttggggtctgtgtggtagtgaccctttttcttttttactttttttttcgagacggagtctcactgcaatgcgcaggctggagtgcagtggtgcaatatcggctcactgcaacctctccttcccgggttcaagcgattctcctgcctcagcctcctgagtagctgggattacaggcgtgcaccaccacgcccggctaatttttgtatttttactagagatggggtttcaccatgttggtcgggctggtctcaaactcctgacctcgtgattctcctgccttggcctccgaaagtgctgggattacaggtgtgagccactgcgcctggcctttttttttttttttttgaaatggagtcttgcctcatcgcccaggctggagtgaagtggtatgatctcagctcactgcaacctctgcttgctgggttcaagcaattctcctgcttcagcctccacagtagctgggattacaggcacacaccacaatgtccggctaatttttgtatttttagtagagacagggtttcaccatgttggccaggatggtctcgatctcttgacctcgtgatctgcctgcttcggcctcccaaagtgctgggattacaggcgtgagccaccgcacctggctggtagtggccctttttcaggggtttacaggtaaactttccttccactttttgagatctggggacattacatgggagttggaggcaagtctcggaaggctgctgggccttgtcctgggcgcaggcttcttaggcccacctcagggttgccaaggggcaggtgtgcagatccatagggaccagcaccggggctcttccaagcagggcaaaggtgttaagggaacagaggagagcagggggattgggggcatcatgaggatggtgggggacaaggccagatggggctaaacccagtggctgggtttccttctgagtgcccaggatgttcctagggagccctcagtgaggggtgccctattgtgggtatgaaggaggagcagagagcagggtcggggccagagaaggggctagtgctggcagcatggaggcagagccagtggaattggcctgtgattggacaaggaatgggctcagaaagcatcctggatagctgggcatggaggtgcactcacctgtagtcccagccactggagaaactggcgggaggatcgcttgagcccaggacttccaacctgtagtgtgcatgatcacacttgtgaatagacagcgtactccagctagggaaacatagtgagacccctgtttctaaagaaaaatgaaagcctcctgggtttggctgagtccctggtgaatggtggagcggtcctgagagctgggaagacctctttctggcacagcaaccggggcagaggtgagaggagaagggcctcagcagtgttctggccttttgggttcatccaaaacttgccggtcctgggcctgctgggagaggtcagcccctttcaggtgagcagctctggggccgggtgacccacgccaccgtgtcgggcacacagtggtgcttcgttttcctcactcctggggccacagccttcctgctgcggttctgcctggtgggtgggtccatgctgctttgaggaggcaagtgacctaaggcttccgggacactcttttggcaacttgggccttggaaggacagcagagcaggtgtgcagtgttaggacctgtggctgagctgacctaacagcctgcctggaggcatcagtcaggctcaagtagaacagcaaggcccccatcttggggctgtcgtccaggcacagagcggtcagcatctactgtccttcctggagaaaaaagggaaaatgcatttgtcatttaaatgttggaatgggccaggcacggtggctcctacctggaatcccagcacattgggagggcaaggttggatcacatgaggccaggagtttaagaccatcctggccaacatggtgaaaccccatctgaaaaatacaaaaaattagccacctgtggtggcgggtacctgtggtcccagttacttgggaggctgaagcatgagaattgcttgaacccaggaggtggaggttgcagtgacagattgctccactgcactccagcctaggtgacagagcgtaagactctgtttaaggaaaaaaaaaaaaaaaaaggaatggttctgagaagtcattccttaagtaaataaattgccaccccaggttgccctcttgggaggggactctggaggccgccctccacccttaggccagggcctgtcagtccctgcctccctgggctgcctcctggggatctcagccaacaccatgcccctgtccttcctccacctctttcccaggttgctctgcctggagtccaccttctaggagtgagcccccccacccccactggaagtccctctctagctgtccccagttccctgaatcaagactgcttccctgccagagagatgaccccaattcctgcctcctctcactgggctctcaggggccgggactggggacagagcatacttagagctagccctggccctcgggctgcttttggaaggaggagcatggcaggcgagcatcaggtgacacgtgcccccacggggagcgcaagaaggcactggaggctgttgcgaaggagcagtgggtttcgggtcctcatgaccggccctggttccgggtgtgaggctgtggagatgcatgggtctgcctttctcatccgcagcttcctgttgctacttgggaagctccatgtttgctgtccggttgtgtttcgagtctgttctcttgggcgtctgtgccgtggaagttccttgtgcttgatagggccagcacgtgtgaacaatcttcacttcagctagaagctttgaagtctttggactcaagctttacccaaaccgcttataaggttggggggaaccgagtgcctgtctctccccgcttttttttttgagtggagtctcgctctgtcacccaggctggagcacagtggcgcgatcttggctcactgcaacctcagcctcctgagtagctgggactacaggcgcccgccgccacgcccggctaattttttgtatttttaatagagacggggtttcaccgtgttagccaggatggtcccgaactcctgatctcatgatctgcccacctcggcctcccaaagtgctgagattacaggcgtgagagttgtagttcgttgagagggagacagacctcgaggaaatgcttggtgtgcctgccgggtgactgctcgctctccttgtctgctcactctgcccagtgaatgggtctaggcatcctcattgttcccttcctctgtcctcaacatcagcccaaccctgaccaggccccttcctgaggttcccacacaacaggggctccatgttcagaaggggagagagaaacccacctggggatgctctgtaaggagagcagagcccagtggagtctctgcccgggacgctgaggaagagctgcggttaattcaaaaggaagggtgaggtgcaggtattggctggacgatgctcagagaagcaggaagagtgggcatggcactgagtggctgaggccatcactggtggccttggtgcttaggcagaaggagagggcatggtgcagggcgctgaggccgtctgtggctgccttggtggggcttactgagttctagtggacagcaaggtgccagggcagggctggcacatggagggctctgaaggccatgtgtatcgtctgaagtgagggaaacccgtggtagctaaagggaatgcactagccagccccaggtgcgccacattcctgctctaggggctggagggaaacccgtggtagctaaagggaatgcactagccagccccaggtgtgctacgttccgctctcggggctggaggggaacccgtggtagctaaagggagtgcactaggcagccccaggtgtgctacgttcccgctctcggggctggaggggaacccgtggtagctaaagggaatgcactagccagcctcagatgtgctacgttcccgctctcagggctggaggggaacccgtggtagctaaagggagtgcactagccagctccaggtgtgctacattcccgctctcggggctggaggggaacccgtggtagctaaagggagtgcactagccagccccaggtgtgctacattcccgctctaggggctggtctggcggcatggctctctcctgagtgccttcagagcctgagtgccagcaggcaggcgtctcctgcccagtgggtttggtaagatatatttcagaaggcatccaccactctaaaacatgcttattgcaggaaccatgggggagaccaaagggcctagagccttgagaacctctgaccattagtgttaacaggaaggcagcctgttcccctagctggggagggggttgtgcgtggcaggaagcccgtgcgtctgtgtctctttggagctgtgggttggttgtgtggatgccagctgtgtggtccccagcctcactgagcctgagtttccatactagcggcgggagatgggactagagggtctccaaggctccctgaagctctgcgattctgcttctctgagtcttgaccgcaggtcagtggggacccggcccctcaccatcgcctgctactgatcaccattggtttggttttgtctcgaggactgttctggaattgaggtgtaacgtgctgtgtgttcttccttagggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcaggtgcatggggcctgcaggctgggaggaggggcaggcaggctaggctggttttagagccacgctgcccagcctggtagctcccagcagagccgggtccagcttagatgtgctccagttatcgatactccctggatttcggaggtttaccacaaagaatgtaaaattaataattttaaaatagcaatttgaaatacgattttggatacatggggttaaatatagtacgtcattacagttaattttatctttttattatttttaatgtgagtactggaaagtttaaagtgccacctactgctcactttttggctgctctaggcagctaagacagccgccttccttgcagcgagtggtctgagaggtgtggcctgtgcacatcggcagcagctcggcctgtcgggagagccggcaatacctgagttactgcagcagatgtccttggcggttcaggcgtgccttcctcaaaaacggagtgataaaaacagtgtgctgtgaatactggggtttaaaacatgtcctgttaacatttgcctgctgttggtttcactaaggatgagaaagtttaaactgtggtgtggaggtaggtttttgaactgaagcaaatggtgtttgttttttgcattaggtttcacagtgggttgttttttgccttttttccccactagctctgggcctcagaactgtgctgcctgtgttcacgagggcatatatgaagaaggcatttctattttagaaagcagttcggtaagtaaaatgtcttgaagctaaaaatgttgaacagaaaatgtcttaatttcctttacaacatgggtggggctgggcacagtggctcacacctgtaatcccagcactttgggaggcccaggtagggggattgcttgagtccaggagtttgagaccagcctgggcaacatagtgagaccctgtctctacaaaaagcaaaaaacttatcaggggccgggctcagtgtctcacacctgtaatcccagcactttgcagggccaaagtgggtggatcacctgaggtaaggagttcgagaccagcctggcgcacatggtgaaaccccatctctaccagaaatacaaaaaattagccgggtgtggtggcgcacgcctatagtcccagccacttgggaggctgaagtgggaggattgcttgaggctgggaggcggaggttgcagtgagccaagatcgcatgccactgcactccaacctgggttacaaagtgagacccctcctttaaaaaaaaaaaaagaataaagggccgccagaagttgtcccttagcagactcctgaagtttagggtttggaaactttggcatcaaggtgagtccaaaaataaaaaggaatcagagagtcatcctctgctcctggagtggcctggaaaggcgatgtgacgcagtattggttggtttggacgtgtggtctgtgttccttggttgctgcagggagtctgggaggaggtttaacccgagggatattcctctccccaggccttcccagataatgctgcccgcagggaggtggagagcctgccggccgtctgtcccagtgatggatgcacctggaaggggaccctgaaagaatacgaggtaaagatgcctgcgtgtggcatggtgacagaagctccagcagtcgggagtcgtccacgctccccaagcagttatgaccttgtcctgcacgttcctctcactggggctgaagcctgtctgatgtctgtggaggaagagacggagctgctccttagagtatgtccatttagaaactcaagtagtgcagagcacagacctgcaccatggagcttgggctgtgtgacctcgggcgaggtatttaccctctctgtgcctcaggtttcttgtctgtcgatgggggtgcaggatcccaccatcgtggggtggctgtgagggttggaggtgcctgtgtgagccctgggaatgccatggttatctgagcagtagcatttcctgggaatgaaggggagatcgctgtgcaccaggacctgcagctttcaagtttggtgggggtttttgttgtgtctcttgtatccacaaaggattgcttattttgaattgtgttgacactggaaattgcagaaataatggacacacttgtcctgtggtcacggcaacataggcagtggcccgcacttcacttggctgtggtttgtccctgtgtgctgggcgagccgtgcacgccttcctgcactggggatttcagtgtgattctcacgtcaccttttaggcatttggaaacttcacctgtagtgtagaggccaggaggtgccgagagagctcgtcgaggccactacagctcgccaagttatgcagtcttccttcttgtaatgaatgccctttaagaggtttctctctgggatccttgtacaggattcctggagtaacactgtccacagagcccaaaggtagaggcagcccagtgtctgcggatgaatggataaacacgggaagtgtgatctgtgcacacagtgggatatgattcagccttaaaaaggaaggcgattcggacacacacaccccagggatgaactctgaggacagtgtgctgagtgacatgagccagttaccaaaggacagatcctctgtgattccacttaggggccacccttagagtcatcagatccatgggtacaggaagtagaatggaggagacaggggtcattgttcagtgagtaccgagtcatacattggaatgaggcagtaccttgatgccatccaatccagccccaggttggtgaggctgtgagggctgtttgctcagaatcctggctttctgcacttaggggagcttcctgcccgggccagagctgggatctcctgctcagccggaccctggggtgttaccggctgggttggaattggacctgcattactgtgtgtttctcctctcctgctccccgccctgtgagcctggccacgcctccctcttctcctcgcccactccccaccctgtgagcctggccacacctcccacgatcttttgacagactctgctttgtggtctttgggctccaagtttcgttttttcagaagaactgccccagctgtgtctggggtgaacaagatgtgctttcctccctagcacggggattgcgtcctggacacggagcggtagctccagggcactgccctagagtgagactcctacctctgtgggcagagatgccagaccgccctcagccacgacgtgcgatgcaaagctttctaggctcctgtgtggctctgccgcacaaacggctgtggcgcatggcattgtaccccccactccctgctccttgaaagagatgcagcttggtcattgcccagtgctgtctgcaagggagatggctccctggggaggtggcccagggtcagggtctccctgggagggttggggtaccagctggctgcagggagtaggggtgctatgcgccatgccaccctttgagaggactgaggagtgtctgggggacaggtgggataatagtttccagctctgcactggaccctgagtcctctggggtctctgccacctccaggctcatgggatgccacattgacaattatgagggcctccggctgagggccaaggactatagccagcccctggcctggggcgccacgcggtcctgcaggcacgcagggtggaaagtccctggctgcacctttgagagctctggaaagtccctgagaggagccgggtttggtcatgtgggaggggcgggcactgctctggaataacttggctgtggcctttgattttgttgataaaacctctcactggctgtaaatgtcacacatggggacggaaatcaacccgtctatacagttgggagccgctctgcccctcggagccgcctctctttgctctccgggtgctcggagtgtgctgctagttggggccttattgtaaacacagtacggaggctaaggctgcctttcctccttgatggtcggaactttattggaaaaggggaaaatcctgcttagcttttgaatgtttgtcctttgcaatgatgcctttctaggaactgaatgattttatttatttatttttatttttttgagacagggtcttgctctgttgtccaggctagagtgcagtggcgtgacctcggctcactgcagcctccacctcccaggttcaagtgattcttctgcctcagcctacaggcgcctgccaccacatccggctaattttttatatttctagtagagatggggttttaccacgttggccaggctggtcttgaactccttacctcaagtgatccatccaccttggcctcccaaagtgctgagattcctggcataagccactgcacctggccaaatcgaataattttaaaactttaggtaaatgttgatggagtgcttgctgagtgccaatagcagaactgaattccccagtgggcccctgagctactcgttctggcagctggatgcgggggtgcggggagactttccagagaggacataggctggctgcacgagcagcggaaaggccaggaaaagccaagtatgctcggcctcacggacattctagtgacattcagagggatgacgactgtatttgcgtcaaatgtgtagtttgaattctggctgaataaatattgatttttttttttttaaactgtgtctgctgtgggtggggagaagactgagacagatggtgctggtgtagatgtatctgctgcaggacaaccctggtcccactggagatttcaagtaccgagtgccaagagaaaggttttttttgtttgtttgttttttgttttttgcgatggagtctcactctgtcacccagactggagtgcagtggtgcgatctcggctcactgcaagctccgcctcccgggttcacaccattcttcctgcctcagcctcctgagtagctgggactacaggcgcccccaccactcccggctaatttttttgtatttttagtagagatggggtttcaccatgttagccaggatggtctcgatctcctgacctcgtgatccgcctgcctcggcctcccaaagtgctgggattacaggcgtgagccaccgcgcccagccaagaaagattttatttttgacatttcgagcatgcagcgcatctgagcagtgaggctgagagtagaggtgtgccgctgccccacaggcctacatgctgccccgcagcacctgccagccttcgccagcctactttcagcccttcaaccccccacacacatttttttcttttctggcttattttaaagcaaatgaagatgtcatatcatttcacctatgagcattttattattattatttttagaaatagagtcttgctctgttgcctaggctagcgtgtagtggtgggatcatagctcactgcagcctcaaactcctgggctcaagtgatcctcccaccttggtctcctaaagtgctgggattacaggtgggaacccactgtgcctggccattttactatgttttaaagaacagtcttttttatttttatttttttatttatttgagatggagtctcactctgtcgcccaggctggagtgcagtggcacgatcccggctcactgcaagctccacctcccacgttcacgccattcttctgcctcagcctcccgagtagctaggactacaggcgctcaccaccactctcggctaattttttttgtatttttagtagagacggggtttcactgtgttagccaggatggtctcaatctcctgagctcgtgatccacccgcctcggcctcccaaagtgctgggattacaaggcgttagccaccgcgcctggcctaaagaacagtcttttaattaaatctaagaacattgactatttgtgctttcgtttttaggtttcataagccagaatagttgctgaggctcctctttgattcagcttgatggtggcttgttacacactagtgtggccgagggctgggtcctgtcccgtcagtgggtagcagagtgcaaggcgctgttgggttcagggagttggttcctttagcaggcttagcttgggccagtgccgctggaggtcttggagggctgggcccatgttccctggggcgcctctaaggagtagttgctgtgcctgtgtgaaggtttgggaggaacactccctggggaggttgaatggaagccagcccaagtgcctgtgctgtccagagcagggtctcccctcttgggggaagtagcattaacctttcctgagtcacttggggctcctgagctgtagccagctctctatggagctgctgacccccactccccaccccatgaagggccccgcagccaggtcctctgctgccctggcctctcaggaaccttcctctcagcacattgtcctcctctctccgggttgtgcccatcggtacagaatatgctctagtctctcctgtctcaaaacttagtgttgtgctcagtgagctaagctaggcacaagaagataaagactgcgtgaattcactgacagagtccccggagtggtcaaattgagagccaatagatggtgctgggggctggagcaggggaatggggagttagggtttaacagggacagggtttcaggtttctacaatgggaaagcgtgatggaggtagatggtggtgatggttacataacatcagtgaaatgtacttaataccacagaactgtgcacttgaaaatggttaagatgatacattttatgtttatcatgattgaagaaacagcagattttcaacttcctgttcctttgacttccattccctttctctgttcccagtcatagcagacttctcccaaaagacgtgtttaactctggccaggcacaggggctcatgcctgtaatcccagtactttgggaggcttaggtgggcagattgcttgagctcaggagttcaagaccagcctgggtaagatggctctaccgccgggcgcggtggctcacacctgtaatcccagcactttgggaggccaaggcaggtgaatcacgaggtcaggagattgagaccatcctggctaacacggtgaaaccctgtctgtactaaaaatacaaaaaaattagccgggtgtggtggcgggcgcccgtagtcccagctactcaggaggctgaggcagaagaatggtgtgaacccaggaggtggaggttgctggttgcagtgagccgagatcgcgccactgcacgacagagcaagattccatctcaaaacaaaaacaaaaaaccaagatggctctgccaaaaatacaaagaaatttagctgggtgtggtggtgcgtgcctgtattcctatagtcccagctatgtgggtgctgatgtcgaggctgcagtgacctgtattcttacccctgcactccagcctaggtaactgtatcagtccattttcatactactataaagaaatacccgagacttgggtagtttataaagaaaaagaggttgaatggactcatagttccatgtgcctggggaggcctcacaatcatggaggaaggcaaaggaggagaaaggcacgtctcacatggcagcaggcaagagagcatgtgcaggggaactgccctttatcaaaccatcagatcccatgagacttactatcacgagagcagcacgggaaaaacccaccccatgattcaatgacctcccaccaggcccctcccacaacacatggggattatgggagttgcaattcaagatgagatttgggtggggacacagccaaaccatatcagtgacaaagtgagaccctgtctcaaaaaacaaaacaaaacaaaaagccctgtttagttttatttctgtacctcaccagccccttatggaggcaggtgggacctcctgtggcttgggccagaggcctgagagtccttcttgacttctctgtgttcctgtaagcggcacgttcagtctgccggcaggtccacgtggctccccagacacatcctgaatccggccctctctcccgttacactagcacctttgtagtgcctgccaccccgttcttcctcctgtgactgctgcggcttcccaaccttagagtctgtgagaggtgcagctgccaggcagtcctggaagggttcagccacatcccgtcaccttgctgtcctgacccctcacattcgggcagagccctcaagacggtcggggaagccctgcctggggcagcagtgggctggagaggtggctgggttctgcatcctacattcttgattcttcctggcctgggtgtggcgaggagctggcaccgcctcccttccctctgtgtccttttcccttgccaccctggccatctgtggacgtccacagtcctctgcctcgcctgacgcttagcctgcggcaccggctcccgcttccctagtctgcagtctgcatcttgtggcaccttccccggccctgcctccactgcctgccttccctggtgttctggcactggtggtcactaccaggttgtcagctccaggagggcagggcctctgcccagctcctgggtggctcagtgtgtgggaacgtgtaggtgcctgagtgaccttcctgtgtgtcactggccctcgcctgtcttcctcgcagcttcggccctttcagatgcgtgtgctgtgcagctagacccagctcctggcaccttggcctggtgggcttgtgcctcaggcctttgctggcttcctggtgctggaggcagaggccagctgcccgcatgctatctcccgtgcgtgttccctacctcttcacacctcccacctgcaatgaggatggggctgggactggcaagactcagcctggaccgcgttgggcttggtcatcagatcgagcgtggcctgctttctcggttaggagctggtgtgtgtggcagggacccgctggcgcagagcagggactgtgcacttggctgtttcagggggcagatcggggagcctggtggtggcaaggcatccacacagagacccccatggcagagcatcccctcagctcagtgtgcggtgaagagagtggagacgaggacacactgatctgatctcctcctgccctcccacctgtgggagccctgagagctatctgcagagggcggcccccaggaccagcatgcggacaccaagccagcgctacatcgccttgtgtccccgggtgaagctgtggctgcccaaatgtcccacgcgagttctactgacgcttcctcctttcgttgctagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggtgcgtggggtggagcagcagcctgtgtggctgcagccatgcggggctgagctggggagctgcgtgctggccactgcggctgcgtcggcccctttgcactcgttccaccccctcggccctttccctggagacacgcgggcggatgtttcttggcagaactgggaatgggtgtgaagttaatgccgaggcctttcaaaagcatttttgtaagccgggcacggcggctcacgcctgtaatcccagcgctttgggaggctgaggcgggcggatcacgaggtccggagttgaagaccagcctggccaacatggtgaaaccccgtctctactaaaaatgcaaaaagttagccaggagtggccaggtgcggcggttcatgcctgtaatcccagcactttgggaggccgaggcgggcagatcacgaggtcaggagctcgagaccatcctggctaacatggtgaaaccctgtctctactaaaaatacaaaaacaaaattagctgggcatggtggcgggcgcctgcagtcccagctactcaggaggctaaggcgggagaatggcgtgaacccaggaggcggagcttgcagtgagccgagattgcgccactgcactccagcccaggcgacagagcgagattccgtctcggaaaaaaaaaaaaaaaaaaaaagccaggcacggtggcgagtgcctgtaattccagctactcgggaggctgaggcaggagaattgcttgaacccaggaggcagaggttgcagcgagccaagactgcaccactgcacactagcctgggcaacagagcaagactctgtctcaaaaaaaaaaagaaaaaaaatttttaaaaaaagtttgtttttaggacaaaaaagcatttttgtcttagaaaagtctaaatgcatcaggtagagagtgcggtggtgggtgtgcgtccgtcctcgccaggcctgggctttgccctcaagacagttgctcaagtctgacttcgccttccccaaagcgttggtgagaatgcatttctgcggtgcacagagctagtcgctagcgccatgtctgagatgcagctgtgactgctcacatggcctgcagcctgtgtctgcgtccctgttgtctgtctttgccttggtgtatctgaatcacgatccatacagggttcctgcctttggtggaaatgtctctgggtctctctctgcctctggggcccatggcatcttttttcctgggctcttgtccttcaggagccccacttccctgagacccatctgcacttccctgtaaactgtcagatggacgggcctgaccatagcacatctagggtgccaagccctccgcagcagcatgtcagggtctgtcttggagacgtcccgcatgccgccagccctgcccatccgccaggccctcccaccggcctcgcctcccagcgggagcagcgtttccccatcttcaccggggccgttgtttcacgtggcttccaaatctcctctggtggcttgggtctccctcgcattgccctgagctggcagaacaaacaaagcgttaagatctccgaggctcctgggtggtgctggcaggatcctgcccgggaggagcactgtccttcgaggctggagggtgaccacgtgctcctgcagcccctcggcgctgcccagcctgagcactgtgtgccgccctccacccgcgcctggcattggcgtccacccttacactcctgatcccttcttttgaaggcgcaccacgaggtctgccccaagttccccttaacttgtgacggctgcggcaagaagaagatcccccgggagaaggtgagtgtccttcacctccttggaggaccgcagggcggggcccatgtgttggacgtgagggtcccgtgggtgggggtggggcaggttatgacccttgtgcccaaaggaacagcagtgcaaagcccctgtaacgttgggtcatggatgcgttcagggtggcggccgctctcctgagtgggccgggggccaggtggctgagtcccgagccctcttcctcatcctccagtgtacatagctgcttacttttcagcaggtcacttcctagttatcctgaaaatgaaacattaaagttctcatcgccctccatgtgctgcttatgagaaatgttgttactgactttgaagctgaatgtttgcagcaagcggttggggtggagactgggcgccctagtctggtctgctgccacagccgtgaaatgtgggtggctcgcctggcagaactttgtccctggtgtccttacttctttcaggaaaatggtttctctcccagttgagagttaactgctgcagatgacacctttaggaaaggaagctgggaaataatacgcatggaaacattttcccaaactgcctcccttgttggaggtgtgagggtagctcatccagagaggctgaagctctggaaggggcacctgctctgtgtgtcagaggtccaatgtggaggcctcacaggtggcagcccccatctgggcagctacaggaggggtcaggctggccaggcctgcccgcgggctcagcctgacaggtgtgtgcctgtctttctgatttgcttctgtttaaatataggtcacagcccaagtcctgaaatgggtagggctgggggacgggacagggctgtctcctcacctctttccacttgtctgttaaatgtcccgcactgtgagcttggccgagtgctgtctgaaagcatcctttcccttcacctggagactggagcgccatagaggctatggctgctgccatgcccccttcagaggccaggacgcctgcctggggcccgtgtctgtgaggctgtgtcccctgctggtggggcctggaggtgcccccgagaggtgccctctgcgtgtgccccagtctgtgtcagcccttgtctgtcctgagggggttgtacagaggagttaggaggtgattctttccttgagactgtttccagagtgaaagacgaagacgggcgcccacgcagcgcggtggtgtctggtgggttttgtccccacccatcactgtgaacacggggctttctctgtgcatggtgcattttcatccttcccgtctttttttttttttttttttggagacagagtttcgctcttgttgcccaggagtgcaatggtgtgatctcggctcactgcaacctctgcctcctgggttcaggtgattctcctgcctcagcttcccgagtagctgggattgcaggtatgcaccaccacacccagctaattttgtattttcagtagagatggggtttctccatgttggtcagtctggttcttgaactcccaactttaggtgatccacctgcctcagcctcccaaagtgctgggattacaggcgtgagccactgccccagcccattgcatctttattttgatgttcacagggcctcatcttcagactgaggggcctttcaggctctctgagaatgaatctcttgggccccgcctgcttcctcagggcagtcctgtctaggcatggaactctggcccttcaatgcaggccgacatataggggctgcatgtatgtgcagggtgtcctggggctgtctgtgccccctggcccgttccagaggagaatgctgagagtgctctcaggtgtttctaatgtgtgtggcgtgcttgggattttctcttatctctttttttttttttttttttttgagatggagtctcgctctgtcacccaggctggagggcagtggcgagatctcggttcactgcaagctccgcctcctgggttcacgccattctcctgcctcagcctcccgagtagctgggactacaggcgcctgccaccatgcccggctaattttgtttttgtatttttagtacagatggggtttcaccgtgttgaccaggatggtgtcgatctcctgacctcgtgatctgcccacctcggctcccaaagtgctgggattacaggcgtgagccactgcgtctggccctttttttttttttttttttttttttttggagacagagtctcactctgtcgtcaggctggaagtgcagtggcgcaatctcggctcattgcaacttctgcctcctgggttcaagcagttctctgcctcagcctcctgagtatctgggattactggcacctgccactccacctagctaatttttgtatttttagtagagacagggtttcaccatcttggccaggctggtcttgaactcctgacctggtggtccacccatctcggcctcccaaagtactgggattacaggcgtgagccactgtgcctggcctctcttatctttttttagtgttgcaaatcttggttcctaacactggtaacgtatttgttttatgttatatatagagtaggtttaaaattaaaaatacctactgagcatggtggctcactcctgtaataccagcattttaggaggctgaggcgggaggatcacttgaggccagttcgagaccagcctggccaacgtggtgaaactccgtctctactgaaaatacaaaaattagctgggcatggtggtgcacacctgtagtcccagctccttgagaggctgaggtgcgaaaattgcttgaacccaggaggtggaggttgcagtgagctgagatcgcaccactgcactccagcctgggtgacagagtgagagcctgtctaaaaaaacaagtcaaggccagttgtggtggctcacatctgcaatcccagcactttgggaagccaaggcaggtggatcacctgaggtcaggagatcaaaaccagcctgtccaacatggcaaaaccccttctctactaaaaatacaaaaattagccaggtgtggtggcacaggcactcctgtaatcccagctacttgggaagctgagacaggagaatcgcctgaacccgggaggcacaggttgcagtcgcagtgagccaagatcgcgccagtgcgctccagcctgggccacagagtgaaactccatctcaaaaaaaaacaataaacaaaaaccagcaacatggcttctgatgatgaggccactgatgatgaggccacctgtttcttcgaagctctttttgttcttggaagtacatcttatgaagatgtagggtccacataccatgttcttattataaaggaattttttttttttttttttttttttttgagatggagtctctctgccgcccaggctggagtgcagtggcgcaatctcggttcactgcaacctctgcctacctggattcaagtgattctcctgcctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcctcaccactgcctgggacatgtgcagggctgagccgagcatggggcggcgtatgttgggacctggtcctttggaggctgacctgtggggctcgctggataggagaagtgggcctgggcctcatggccaaacagcccagaagccttggcagtgacggacacctcgtgtttgataaggtgtttgccccttcatggtgatgctggcaggaaccacagacgggcagtgtttagtgtttcctgggggcctgggggttgccctcctgccctcacaggaaccctagggcaccctttatcagatgaggaaattgaggcttacagaggccaggcgcccagctggcttccagttccatggacggccctgccgtgggcagcctgggggacttgtctcctcgcttccagcagtgccttctcccacacctaccctacctgggcgatcgcaccccccattcccagcatgctgcgcacatgccaggttcctggcctcttctccttcagcttcctgtggtggaaatttctgagcctggacagatgagagagagcacattagaacttggggccctgctgtggctcaagatggggggtgcccagtgacagttctgtttcattcctgcctccacttcttcccgcagcccagtgtttcatccgaaaatacttcagtgacagcagagggatccttgctttattttaagagaaaatacattgtgggttcacacggatgtttgcatttcagattcttacccaacttccatgttgctgtctcctttctacagaaagtcgtggttcctgttgacattgctatacataagaacggtgtcagtagcactgagtctgatccatggcaaattatgtgatgacgaagttctctttctagttctctttgcttttagagtctgtattgagttgctgtgtcataagtcattcgaagcagcgtctctgggcaggcggctgtctcagtattccacggaggcccatttgtttcattttgcttttgagttttaaagattgccctttaaaaaaaaaaaggccgggtgcggtggctcatgcctgttatcccagcactttgaaaggcggaggcgagcggatcacctgagctcaggagtttgagacctgcctgaccaaaatgcagaaaccccgtctctactaaaaatacaaaattagccgggtgtggtagcgcatgcctgtaatcccagctactcgggaggctgaggcaggagaatcacttgaacctgggaggcagaggttgcggtgagctgaaatcatgccattgtactccagcctgggcaacaagagagaaactccgtctcaaaaaaaagttttgtaattttgtaaaatggttacatggcaccaaagcgaaaactacaaaaaaggtgcattctgagacgtcagagggaaatgtgtcaggctccccgtccgcagcgccgtgcggtcgttcagaaatttgcattcccataagcattgtgggagcaccgtctcccgagacttgccagcacagtgtggtgtgaaggttggacgtgccactgtgatgtgtgagaaacacatcagtcctctgtatcgggggtccacgccgtggatccagccaaccgtaggttggaaatgttcaggtaaaaatgcactgaacacgcgcggacattttttattgacacagcgttcacgttgtattggtcatgagtcaccgagagctgatttcaggtatgagggagggtgtgcttaggctctgtgcaaacactctgccatcttccatcagggactcgagcatccttgggtttcagggaccctgagaccaacctcctatgggtggcaagggacagcagagcctcgaggcggttctgacgggcgtttcccaagctgtggtgtgaccgagcccatctgtgcttctcttgctgttcatgactcctgcccactgaatagtgtttttggtttttgtttgttttgggggaaattgttcaaggttcttatgtgactgtttctggaaactgattcacagttacggccgtttccctccttccgggtatgaaatcttgtgctgcgtctggcatgtgtgggtttggttttctcacactcagagccgcgacacacctgccatgtcacctgggaaatggaggagggacttggggttcatgtttttcctcgggctgttcctgcatccatagacccatgtcagataccacagtgttagtctctgtttcttccctggttcgatgttcctgttgtatgtgagtgtctgtgtgcacttggcccctttctggattttacgttttgcttcatgttgtgtctgtgtcatcctgtaccaccacgcaccgggtgagcagtgggcgtttgattctaggttttgaacccaggccctgaggcctcagcaccgcatgtcctgtggactgtgatagagggacaggcgtgccatgtgacacacaagctggggtctccacaggtgtcccgaaatgcttgcccatctcagttactggcacagtgtgcatgtttgcacgtgtgtgtgcacaggtgtgtgagcgtgtcgctttggaaatgggctgttgggtttcattcagtgtgagagtgaagaggccaacggggcaggtcatgtaacctctgtgtcagtcagtgtggtccatgtggaagtgctgaaatgcatcagaacagagaaagatggctctgtgacgtcactcccttgtagtttcaggaccacgtcaagacttgtggcaagtgtcgagtcccttgcagattccacgccatcggctgcctcgagacggtgagtcggggggtctgaggttgggggccacccctcatcctgggtgtggtcttcactgcctccagcccagtgcttcctggtttccttccagctgctcctcagccacctctgcagcactgcctcctcctgccccggctgtccgagtgttcccagcttggtctctgggctggcagccctgtccactccctcctggtggcattgtagtgcctggctttgactgccacctgtctctgaggatgcccagtgtgtgtgcccacctgtcgccttgagcctccctgggtgttgagtgcacgtctcagatgtacccggccggctcgccacgaccactccttggccgctgtctccctgcccccatctcacacagaaaagggcagcactctaacccagcggctgtcgctgagccctccgccaccaacaggcactcgggcccctcctctcgcctcatgcttcacgttcgggctgacagaggtctcgtctaccctcaaatggtccccccagccgtcactgccctgtccacgtcatcctcatctctcactgggacccaggctcaggcgcttatgggacccccgttcttttccgttctggcctgttcacagatggaaatcgatcacagctcttcctcatggcttctcattcagagtggcctgctcctgtgatctttccctcccctcagctatctcctctgccctgctcgctggcctgagcttccttgggcatgcccacttgtgcccaccccaggcacttgggcactggcacaatggccaggcgcctgggtctctccaggtggacccccctgctccacccctgcagactctgcccctctgtcgccagcacctcgtgtctttgtctcttgtccgtcttgccctgtacaacaggagccccttgaggtcaggaccctcgaggagtactgggcccagaggtggtccccagctgaggtgtgtgcctgatggatggagaggggcaggccgtgggtgcagaccctcccctggccagctcactgggcgggcaccttccttgcttgaagacagggatgtcttgacggcatttgtggtagagtcagttgctgacttgattctatgtggccttaggtattgtgtttttttcctaatggtgaaaaggagcgtggctgcttccattttctttgtctgcgttggatagtcttctgctgtccgtgttcttgtctgtttcctgctctgacgtggcatctgccatctctaggaagcccaggcttcccgtgcgggaggttgcgtagtgaccacccgggcctcagtggtgcttgctgccgccaccgtgctccttgtttctgggcctcttggtgttgagaaatgagagagaacacagcgtgagtctgtggcgatgctcgcttcccgtttgcacaaaggatctccccgtgctggcacacccaccccaggctcagccagggcctgctttttccacgccgcgcacagcatggtcccaacagcagcactctctgagaaaatgcagggcgagctctcgtccagctgtttgtgtcttgagtgcccttctgctctctgggtggtcatgcctctagctgggtacacatgtaggtccatttgtttcttttactgtaatttttttagagtgttttgtttatatatatatatatatatatatatatatatttatttaattaattaatttatttatttttgaggttgagtcttgctttgtcgcccaggctggagtgcagtggcatgatctcagctcactgcaacctctgcctcccgggttcaaacaattcttgtgcctcagcctcccaagtaggtgataaaaggcccaagtagctgtgatcacagctgtgtgccaccacacccggctaatttttgtatttttagtagagatgaggtttcaccatgttgcccaggctggtctcgaacttctgacctcaagtgatcctcctgcctcagcctcctaaagtgctgggattacaggcatgaccgcgcctggcctcattttcaaattttgttgtggaaatttgaaaataatttaattgcaaagtcaagtctataaaatgaggtatgtttaaggaggcctagcttccagccctgtgttttcaccttcccctgtgggtggctttttatttcttattttattttgttttatttcattttatttttgagacagagtcttgctctgtcacccaggctggagtgcagtggcgccatctcggctcactgcagcctccacctcctgggttcaagtactctcctgcctcagccttccgggaagctgggattacaagcacacaccaccaggcccagctaatttttgtatttttagtagagatagggttttgccatgttgaccaggctagtctcaaactcctgacctcaggtgatccgcccacttcagcctcccaaagtactgggattacaggtgtgagccactgcacctggcctattttaatatttatttatttatttatttatttatttatttatttatttatttattttcgaaacagagtctcgctctgttggccaggctggaagtgcagtggcaccatctcagctcactacagcctccctctcctgggttcaaactattctcatgcctcagtctcccgagtagctggaattacagacatgtgccaccatgcccagctaatttttgtagctttagtagagacagggtttcaccatgttgcccaggcttctctggaacttgtgggtggcttttttttttttttttttttttgagacagagtttcgctcttgttgcccagactagagtacaatggcgcgatctcggctcaccacaacctccacctcccgggttcaaacaattctgcctcagcctcccaagtagctgggattacaggcgtgcaccaccacgccctgctaattttgtatttttagtagagacagggtttctccatgttggtcaggctagtctcgaactcccgacctcaggtgatcctcccaccttggcctcccaaagtgctgggattacaggcgggagccaccatgcccagtcatgagtagcttttttaaaatggtgtgttgcttttatttttcttttctcttcctttctgtccctccccctccttctttccctccccttcttcccttcgtcccgtcttcccttcatcccttcatctcgtcctgtcccgtcccttttttcttttcttccaaacagggttttgctgtgtcagccaggcagggatgcagtggtatgatctcggctcactgcagcgtcaacctcctgggctcaagtgatcctcccacctcagcctcctgagtagctggaaccactggcacacaccaccatgcccagctaatttttaaaaattttttgtagacgtggggttttgccatgttgccccagctagtctccaactcctgggcccaaatgatcctcccgctttggccttctgaagtgctggaatcacagttgctagctactgtgcctggctgcaactaagttctatagcttcacgttctttaaacacacctgactttcagtctgtcatacacaagaaggatcagccatgaccaggccacccaggcatccctatctatgaccctggcctgtctcctcagctcagctgaggcccacgtcttggtggccgtccccgggtgggagccgaatggtggatggagccagcagcctccctgccctgtgtccgcaggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtttgtgcctgccgggtggccagccatgaggaggacagtgtaaagggggatagtgttcgtgccccagcaggttctagcaggtcctagagctttagagcccggacaatgtagaactccatctgcaaaccccagtccagtgtggtttaggggaggctctggcccccttcatttctgagtcctgtcatctaagggacccaaaccctggaaggtcctagaggccaggccgtgggcaggagcctcttctctctgatgggagggcagagtcagccatggatggggatgtgcatggcctggtgtggcttctgagcacgcttgctggcccggagcttctgtgtggacttggagccaccacctcttggcgagggtggggttgggttcttgtgtgcagggagtggacatgagaaacatggagcccaggggtgcccaagagcactgtcctgctggagatcggtgggtgtgggaggcaggggctcgtgcccgcacccctcctgtaagagggaaggtggtcttggcacccggcaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccaggtgtggttctaggacccccacctcactgcagctgctgtttacttggcacctgggtcccctcacccctgtgaccacataggatggctcccaagggtggggctgggatacgacccccagtgataccgggagcagctacacctccctgagtggcaagtggggtagctgaatatgggctggccggtgggtgccctcgggcaggggtcggggtaggggggttgggccggctgccctcctgccgtgccagccctcgaggtgtgcccctcgtcacccacagcctggtcctctggcacacggccctaaagcagacattacatcaacaggctctcctgcctgatcacagctcccaggaagacagggcgggtgggggtggctgtgggggtgggacatggctctcagggccttggagctgagctagtctgatccctcccaggttcattttccacacggagctcagggagggtgtttctcacactcccccacctttttttttttttaaaccccaactatggggtctcttgagagggtgctcgtggggtctcccctggagggcactgctggagagggggtggggtggtggctgcccagctgcaggctcctgccaggactgtgcttctgggcgctgcagtccagaggcggcccccctgctgtccctcgaggccctggctgaccttgtggcggccccagccatcatctcggccccaactcagtcactcccttcttgggctttgttgccatggctcagaacacgccctcgtgcagactttatttttaggctgagttggtgaacctgctgatagaatcttaggttctaggatcaaggccgagatgctgtaggcacctttcctgtttgaatttagcctggcactgctcgtgaaactcagcactgggggccatggcagtcctgtgctctggcgccctcgaggcggaaagagacccaagcgtcatctggaggggccgccacattgtgtggtgcctgctgccaaggccttcagcagggaccagaaacaaaactcacactctttcttctctgagttgagactggaaaaatgaaagattgttttaggggaaacttgagggaacagtctgggcagcctgcagggcatggccctgttcctccagggctgggaaagtcagcactgctttctggtggcgaccttccctctgcagctgctggctcagccgattgtatatgctgggagctctgcactaagcgttgggtgaagggtcagcattgtggaggccctgccacggaggtggtcttcttgggagctgcactcaggcaagaggacctgtttgtgtggaacatctgctttaagcaatgctggtgaacacagcttgtgtgcggcacgcgtgcaggctgaggacaggcagaatgggcctgggggcacggtggaggacgaggatggggaggatgggcctgggggcacggtggaggacgaggatggggaggatgggcctgggggcgtgtggaggacagggatggggaggatgggcctgggcacgtggtggaggacggggacggggaggatgggcctgggcatgtggtggaggactaggacggggggaggatgggcctgggggcatgtggaggacgaggatggggaggatgggtctgggggcacgtggtggaggacgaggatggggaggatgggcctgggggcacgcggtggagaggactaggacagggaggatgggcttgggggcacgcggtggaggacgaggatggggaggatgggcctgggggcacgcggtggaggacgaggacggaagggtggtcctggtgctgccacagtggggtccctgcgtgcagacctttgcacacagtgttctgtcatgtgacttggaaagcagcctctgccgagttctggctgtcactcacgtctgtgtcttgttgggtgggaaggaactcgactcttcttgttttggggttcactctagccagtgcctcttctgaggcaggcttggggcccaacctaagccctgggccggtcagggctccctctgtggctctgccgaggtcccaaccactgcatttagtggatctcgccatgtggctctgctcatcttcttaagttttgggggttacatttgggattcttagaaatgctttttctggctgggcacagtggctcacacctgtaatcccagcactttgtgaggccaacacgtgtggatcgcctgagggcaggagtttgagaccatcctggccaacatggtaaaaccccatctctactaaaaatacaaaaattagccaggtgtggtgtcgagcgtctgtaatctcagctactcaggaggctgaggcaggagaatcgcttgatcccaggaggtggaggttgcagtgagctgagattgcgccactgcactcagcctgggcaacaagagtgagactccatctcaaaaaaaaaaaaaaaaaaaaaaactttttctaagtactacctttttttttgtaatgaaatttgttttcattggaaactaactgcatagtttgagggaaaaaaaacttctttgcaccccagaacctgaatgtttctttgtaggtgtttttgtccctgggggagggcagccaggcaggaagagccctgccccgcccttgctgagtgtcagctcaccaggcacccctcctgcctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaggccgtccctgcaggcttcgctagggccgcacctgggagtccctctgggcagtgcagcttctgtggtgcagggttgtgcgggacaaggtggcttgggctcgctggaccaggtgtctgcagcaggcacgtcaccctgtgatgctgtgtcacgcggtggagagctctggcagtttgttgtttccatgatttctgagcactggtccgtgacacaagcacctggcttcctgacctgtcagataaatataaatatgactaagaaaaagcacaaggccgagtgggcggggagtatgtatccctgtgatcccagcacttttgggaggctgaggtgggaggattgcttgaacccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcctgagtagctgggactacaggcatgcaccaccacgcccagctaatttttgtatttttagtagagatggggtttctccatgttggtcaggctggtcttgatctcctgaccttgtgatccgcccaccttggcctccccaaagtgctgggattgtaggcgtgagccactgtgcctggcctattttgaaaatcagaatctattattttgtggaattgaagatgcagagactagactggaatgagagaaggtcccttccttttgccacagttggcccagacttgctacttcccccaccccctatagctagtggagtaggcagagcagagttgggtgggggagggggtgtggagggcccacaggcccttgtctgtcctggggcatccaggttcacagtcctgacagaggcagactcaggttctccctgaaaagtgctcttcacgagtgggcagtgggtgcttcatgatctctttggcaagaaaatgtctttgccagatgtgttattttttgcattttcctaataataattcaagttcaggagtggtaagctttagtctaggactccagatgtcagtggacaggaaaggccagaatggacacagattccccagagagaagcggaatgccggtggctggggagggctggggagcccgggcgctgtggcaggagcaaggccgcccaccacgtggtctcggctgggcctcagcctctggcctgggtcctgggatggcctcctgctggtggccctgccagtgtccagaccctcgggagccagagagagacggcccacagacctgtgtcccctccctggggctctctcctccaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctctgtggtcagtggcatccatttgattccaggttgcctgcggcttccagccttggcagtggtgaccctctgcgggtcctcctggcctctcctctcacagacccctccccacggggtgcctagcccctgcctgcttctctagctagccaggctgtgttctctgttcctcacctgctgtaagctccctcttctcgagccttgttccctcttctggaatgttcttccctgtccatctcctctcctgggcctccccagggactcctgtgagagcagaatgaggatgagccagccctggtcctgcctttctgtgcacaggctccaccgagcatcctggctgcacccggggggtcctggccacaccgagggtcctggctgcaccgcccctgtggtgtgtttttgggacagtgcaggcaggcgtaggcacggcttcacactcggtgtcagggcagccgtgctgggacctattgggcatctgtatcggggtccaggataaagtgctgtcccctctcgacgtcttcacgcactgctgtagtttgagaagttgaccacagaaaagtacagaaaataactcaggcacggagctgaccgacgggcattgtctgtgttccgtgagtgtgtactgggcctaaagagcaagcattgcagagccctgctgttccctttcccggcctcacctcagctccccaggccacgtggcgggaattgaggcgttccggttctctttgggctttagaattttgcatctgtacgtttctgtattcacaaataagaatattgcattaaaaatgcagaaaccatccactgggtcagctgcaggtagctgggcttttgactcagcctggctacttttaatgcatcttgtgctgggcactctacatggtggattctgactgccgtgtgtgagttccctagagagcaccttccagtctcttcccgtgtcttcagggtttggtgactggagatagccagacctgctctcctgggtctcctgtcaacctggaaggagggttggtggtttctaggcctcccctttttagcagttgccagcttgctttgcagaggggctgcatccggtccttccaccagcaccagggggagggttcccatcactcccatccctcccatccctgcccgtgcttcgtgttgttggaattgagatgctgcagcgtgctgtgtgtgaagtgaagtggcatcgctgtcacgtgcgtttctctgatgactcggcggagtcaggcgtctttaccacgtttacctctcccttggattctctcccgtgcgaattgcctgttgatgtctttttctcatttttcttctggttgttggtctgggtcttattctgctggttggtaggagttcctgatattcctgattacggattctcggttgtgtctttgaactgcgtttctgttgctcctgatgtgcagaagcttaagccttacacatgatcagctgatcttatcctttatgaatggtgctatttccgactgactcagaacatcctgaccttccctgaggctggaaaccactgtcatgttttcgtctaatgattgtgaagttttgtctttaacatactgggcttctatatttggggatttgtttgtatgtgacaggttttgctgggtcactgcagtttgttaaaacagattgattgaggtcatctcttctcacttaaaacgaaatggaactgtgaaatgagaggaatggaccaaaaaaaaatcctcccccagggacaaagatggggaagaagccaacatcccacaaaggatttgaacccattttggaaggtgggaagtgggttggtgggtggctgctgagcagaagagggctgagggggaagctggccacaccgggaggccctggcatggagcagagtctaaaagtggatcaactgaaagacggggcagagcagctaccttggaggtcctttgccagagcagccggatggtcctcctggccctcacctccctgcagtggagatggaggtctggagaacctggggaagagctgaggaccgcaccccccacgcagtgagagcagcatcgggctccaggctgcagaaggggcagaggtctgcactcggaacaattccctaggcactggctgccacaccaagaggctcccacgaagcagaccgaggcccttgagggacaaaatgctctgga

SEQ ID NO: 15344 - DNA, 86980 bp, Human
gtttgtgctatctattttgttttaaaatgtcacctgtaagtatgctatatgcatccatgatggcttttaaaaacagccacattctgttaacattcttagcaaaattaacagtaattctgtactattatctaatggatcagtccatactaaaatttcagttgtctcagaagtatctttttacagttatcttgttcaaatcaagatctagacagggtccacacattgtactccgttacatctcttaaatatttgattttacaatagttccctctgcttttaaatgccatttatgaaaaaaactgaggaatttgtctggtagaatgtcccgttttctgaatttagttgcttctctatatcctgtattagatctagagtttgagtaaatgcaggttcaatttttaggcaagaatccttcacaggtgtggctgtgtactttctatcacatcaggaagtacataatatatgcttgtcccaaatttagtgagattaagatcagtgggtttaggtgatgccagtctattataaagttccccatcaacctttcaccttaattttatcatctattgatgttgccctttcgattattttattaggagttacaaaatcgtgattgttttatcatcctccatttattagctggaactcttataagtactttggttacactaaaattcaattcatacaagaaaggcaggataaatgcttgatgttttcccttatcaagttttagaatatttaatcttcaacttggcaatcttcaatcacgactgaattttattttttaaggagtcattataaactcaagaatttttatatttgatgtgtttcaatcaatagcaagtatgtgatgctcaagttttcccatgtcccatcacgttagcacctgtgttaatgatgccattaagctttgataacttacttcctcttggtgtaaccttccacttttttttattaacctactgagtacctacccgttctgagtgcattggatgagaggacttcaacagtaagcttgtatgtgcataggaaatttctggaaggaaaaacaaaaagttggtaaatgtcataacctgtaggaagtgaggaagattttttcttccttttctttctgtactgatagaattaaaaacaaagcttagaaaacaaatatatgatgggagtattttccgttttgtagaaataaattataattacagtaactggtttagtgaattatggttttcaaaaatttataagaagattaatatctgagccttaacaaccaccttttggattacaccgttaaaagaaccaaagtgagaggatcgcttgaggccaagagttcgagaccagcctgggcaagatggtgaggacgccctcccccccacccccgccacaccccgccctgctagcccccaacgtctctacaaaaaaagaaaagaaaaaagttaatcaggtacaaaattgtatccagccttaaactggagggcaacaggtcgctaaatcttgaatgtcataaaggcacctcaacttcatgaggaatagtgaacgcagctgctattttccactctatcccctagctctactaattgtatccaaaccaaacttcagggagttatgctgaatccctctagcaaagcacacgcactaaaaaaaccactcgtttatcagaagttcacatttaacgggcttggaaaacggctcagctgctgcctccagttcatcttccgctgtcgaaagcgtttcagaacttaaactctcagattgcctcagtgcgctgctgtagttgtcaattaggcaagagataaaaaagggctttggctaagtggctagattataaaagcgaggaatcgccagggctcagtgaacttctggcggtgaggatgcgacaagagtcacaggaaagccgaggctggggctggaccgtgggaacgtcccagcaggaaccaagccagcctccgccgctcagcacttgacggcggcttttgcggcggttgctgtgagtgccgtaaagcggagcggctgcagcctgctgttgagtgaggtaaggtacgggaggctcaggtcggtacccggggatgggtgggcgccttcagacaggtaccgctggcgactcgggtgcccttaccgggcatcctccagcattctgggcacctgcctaccccttggtgaggaggccggccacaggctgagcgcgctccgggctgggtactcctcagtcagtccacgagcatcgcgtggtagacttccacttggccagtccttcccgcacttctgggcgtgtcatcaggtgaaatcttaatcctgggacagatgaaaggttggaggacgatcgagactcttgtagtagccgggttagggtagtgacccctgacctcaggttatccgcccgcgttggcctctcaaagtgctgagattacagccgtgagccaccgcgcccggcctgaaatttacaatttctcatttaacatgaggtaagccacatttctcttggcttcagttttgtcagatgtggaaaaaaaaaaaaaaggacctagatgatatatcagattctttatgcttttgaagatagcacgtttccagtcggtaaaaatcaagctgtgaacaaatgacaaagtgaatgatagagcagtatattagaaattgggcagatggaagcccagtagaaaaggctgtgtttgagctagactctgaggataaatagggtttgaacgattggaaaccatctctgttgggccatggacaaagatatcaaatgcaggaataagcatttatattttagcgattctatttgtggacataagtttagtgagggtagaggatttgggaaggctggcattgaacggtgaaagaactcttagtggaaaggaagtgcagggtgttctgacaaggaagaagaaaggaaccggggaaatgccgaaagaacaatacgcaggacttgatttcttggatctgggtgatgatatttttaacctgcgtttctaaaaagtaagtttaagtgctgttggcaaaaatgggaattctgttgaattccagcatgcaatagtgtactgggaataaagtgatttagatcgtagagtgctgaggttgccaataactagcctcttggctgtcatttaattcttctagagcctattctccataaggtgatgttgggccagctgatctctcttctctaaagcctgtaaaactagagactgtgaggatggagagctagttactttcttctggactgggagaggacgatagttgacagagaataaaattgttaattttggggctggacgcggtggctcacgcctgtaatcccagcactttgggaggctgaggcgggtggatcacctgaggccaaggagttcgaaaccagcctggccaacatggtgaaaccctatctctactaaaaatacaacaaattagccgggtgtggtggcgggcgcctgtaatcccagctactcctgaggctgaggcaggagaatcgcttgaacttgggaggcagaggttgcagtgagccaagatcaggccactgcactccggcctgggcaacaagagcgaaactctgtctcaaaaaaaaaaaaaagttaattttgaacatgttaaatttgaggtgaggtgcaggaaatagagttgaaaatataggcagatagagtgcatggactgtaatttaaatagtgttttctctcacaggtggtagttaaaatcttgagaatggatttgctttcagggagagattgtagagagagtaactataggccatacccacagagaggaggttggagaaattattgaaggaggcatgtggatctcagagctaagagcaaggaaggagttctttttaaaaaagttacatatagttgtagattctcaggggcccagtgttgttattaagctaatttaacagcatttacagcaaataataagcacctacttctgggaattctggcagaaaataaataattcaaatagatataatctccactgcctaattgtctacccagaagtggtatcatttacatatttatttattcaacaaatatttatatgtttcaagcactgctggttctagggatataacgacgagcaaggtagacattgttcttatcctccctgcatgtaaagcccttagcatctacatcagtgcttttcaaattttaatgtacatatgaatcatctgaggattttattaaaatgtagattatgaatcagtaggtgggggctgaaaattctgtattactaacaagctccaatgtgatactgatgttcttaggaccatacttttaagtgacaagaatctagatcctgtttagcaaatatggccgttattaagccactaccactacccatcatctgtttctcctaggataaaataattttacttcttatgaaaataatatatgcttatacaaatattggaacaatatagaaaagtgtaaagaaccatgtaaaaatcactcctaattctccctacccagagataaccattattaatatttttgggaacattcatccagattttacatatgtacatacattcacaatttaagtgttgcactaagtacatgtcacactctaagccctgtgtttgattctatttgctgtatgattttattaagataaatacccaagtgtccagaaccaagcaattaagtacttgcattcttgagggagccacttaaaaataatttgggggccaggcacggtggctcacgtctgtaatctcagcactttgggaggccaaggtggatggatcacgaggtcaagagatcaagaccatcctggccagcctgatgaaaccctgtctctactgaaaatacaaaaattagctaggcttggtggcacatgcctgtagtcccagctactcgggaggctgaggtaggagaatcacttgaacctgggagcggaggttgcagtgagctgagattgtgccactgcactccagcctggcaacagagcaagaatccgtctcaaaaaacaaaaaaaaaaacaaaacaaaaaacaaactttgggagccggacagtgtctcatgcctataatcattccaggtgcccaagaggctgaggtgggaggattgcttgtgcctagcagtttgaggcagcagtgagctatgattgtgacactgcactccagcctgggtgacagagcaagactccatttcttaaaaaaataaaaacttgtgttacttcaaaaatggggagacattaacataattacatgtgggctctagtaaatgaatatttgtcatttcatttaggatgagaggagaatttttaaagttttaaaaaaaacttagtttttttcttactacaaaatcaattgatgttcacgtaagataaataaggaaaaaaaataaaagcacctacactcctcccaacccaaagacaatccttgctgtcttcaccttccttcctgctaacctgtcttatctatatctttcatttcagccactatctttccaaaaccctcttacaccatagtcattcagaaaggagtaactatgtatttatgatttttctggagcatctactggagaaactaaatttcattagctttttatcttcaagtaacagcatgtgtaggtagaagttatattgcaaaggattaagtgcatgaatggtaagcaggtaaagaaacttcttaaccctttgcagtctaatgtttacttccaagctgctgacagttgtgaaaagttagcagtcaaaggaaaagaaatggacaataagaaagaccaacagtatttagggaagatttgatagtagctgttgctactgggatatttttggcttttgagaacagctgaaaaatgtcgatttttttttttttttggtctgacctctgaattcattttcagacgcattttctctttatgcctgccaatctgctacatcatctctctaactataccttttcctaattacactactctctttcctctgtagttcagcctcctgttttattttgttcagagcatatttgaatgtcagttctgttttaatgaattgcctgaaggattcttcctgtgcgctgcacaaacgaaaccagttcactgagactgtgctactgcagtaaagaaacagcttacttaacaatgatgctggctgtgcaaaggagttattactcaaatcagtctcgccaaagacttggtggttagtttttcaaggatagtttttagtttggtggcaggggactagggaatgagggctgctggttggctggggatgtgatgataagggtgtgaaaaatggtccttgtgtgctgagtccacctctgggtggggagccacgtgactggttgggtcatgagtcactagttcacctctaggtagtgtcagttggtccagaatgcaaaggtctgaaaaatatctcaaaagaccaatcttaggttctgtagccagggaaaatataaatcctgtgtcctctggaaaaaagactggttatcatttaactacatgttaccagaattcaggtccctctcataatcctaatcttgtagtctttcattacctttataaaggcagtttagttttggaaaaggttactatcatccttgctttaggttaaactgtaaactaaattcctttcaaagttagcttggcctgcacccagaaatgaccaaggacagattggaggtcagaaacaagatggaatcaactatgagatttctcttagctgtcataattttgcaaaggcagtttcactctctgattcatactatctatgcctcactcttactccccaatatccccaaataagtcggggatcccacagcataaggatatggctaggctctcacatatcatcttatgaacctaagttaggtgtcagggaaggtttttgattccacttccccccactcctgccttctggatcatctctcttgatatatcattcattcattcattcattcaaacagacccctacctaggtgattctcaaaagagtggggtctggggctggaggaggtgtcagggtaaaccagttaccaaaagtctttcatactaataccttcaaaggacaaatgcaaatgtaaaaaggaagctgaaagaatatgcagtggggttccaagatggccgaataggaacagctccagtctacagctcccagcgtgagcgacgcagaagacgggtgatttctgcatttctaactgagatactgagttcatctcactggggattatcggacagtgggtgcaggacagtgggtgcagcgcaccgagcgtgagccgaagcagggcaaggcatcacctcacccgggaagtgcaaggggtcagggaattccctttcctagccaagggaaggggggacaaatggcacctggaaaatcgggtcactcccaccctaatactgtgcttttccgacagtcttagcaaacagcacaccaggagattatatcccacgcctggctcggagggtcctatgcccacggagcctcactcatttgtagcacagcagtctgagattgaactgcaacgtggcagcgaggctgggggggggggcacccgccattgctgaggcttgagtagataaacagaggggccgggaagctcgaactgggtggagcccaccacagctcaaggaggcctgcctgcctctgtagacttcacctctgggggcagggcatagccaaacaaaaggcagcagaaacctctgcagacttaaatgttcctgtctgacagcttggaagagagtagtggttctcccagcatggagcttgagatctgagaacggacagactgcctcctcaagtgggtccctgaccctcaagtagcctaactgggaggcaccccacagtaggggcagactgacacctcacacagccgggtacccctctgagacgaaacttccagaggaacgatcaggcagcaacatttgctgttcagcaatattcgctgttctgcagcctctgctgatacccaggcaaacaggatctggagtggacctccagcaaactccaacagacctgcatctgagggtcctgactgttagaaggaaaactaacaaacagaaaggacatccacatcaaaacccatttgtacatcaccatcatcaaagaccaaaagtagataaaaccacaaagatggggaaaaaacagagcagaaaaactgaaaattctaaaaatcagagcacctctcctcctccaaaggaacgcagctcctcaccagcaatggaacaaagctggatggagaatgactttgacaagttgagagaagaaggcttcagacgatcaaacttctccgagctaaaggaggaagttcagacccaacacaaagaagttaaaaaccttgaaaaaagattagacgaatggctaactagaataaccaatgcagagaagtccttaaaggacctgatggagctgaaaaccatagcacgagaactacatgaagaatgcacaagcttcagtagccgatttgatcaactggaagaaagggtatcagtgatggaagatcaaatgaatgaaatgaagccagaagagaagtttagagaaaaaagaataaaccgaaatgaacaaagcctccaagaaatatgggactatgtgaaaagaccaaatctgcgtccgattggtgtacctgaaagtgacagggagaatggaaccaagttggaaagtactttgcaggatattatccaggagaacttccccaacctagcaaggcaggccaacattcaaattcaggaagtacagagaatgccacaaagatactcctcgagaagagcaactccaaaacacgtaattgtcagattcaccaaagttgaaatgaaggaaaaaatgttaagggcagccagagagaaaggtcgggttacccacaaagggaagcccatcagactaacagctgatctctcggcaggaactctacaagccagaagagagtgtgggccaatattcaacattcttaaagaaaagaatcttcaacccagaatttcatatccagccaaactaagcttcataagtgaaggagaaataaaatcctttacagacaagcaaatgctgagagattttgtcaccaccaggcctgccctaaaagagctcctgaagggagcactaaacatggaaaggaacagccgataccagcctctgcaaaaacatgccagattctaaagaccatggatgctaggcagaaactgcatcaactaacgaggaaaatcagcagctaacatcataatgacaggatcaaattcacacataacaatgttaaccttaaatgtaaatgggctaaatgccccaagtaaaagacacagactggcaaattggataaagagtcaagacccaccagtgtgctgtattcaggaaacccatctcacatgcaaagacacacataggctcaaaataaagggatggaggaagatctaccaagcaaatggaaaacaaaaaaaggtaggggttgcaatcctagtctctgataaaacagactttaaaccaacaaagatcaaaagagacaaagaaggccattacataatggtaaagggatcaattcaacaagaagagctaactgtcttaaatatatatgcacccaatacaggagcacccagattcataaagcaagtcctgtgtgacctacaaagagacttagactcccatacaataataatgggagactttaacaccctactgtcaacattagacagatcaacgagacagaaagttaacaaggatatccaggaattgaactcaactctgcagcaagtggacctaatagacatctatagaactctccaccccaaatcaacagaatatacattcttctcagcaccacaccacacttactccaaagttgaccacatatatggaagtaaagcactcctcagcaaatgcaaaagaacagaaattataacaaactgtctctcagaccacagtgcaatcaaactagaactcaggattaagaaactcactcaaaaccgctcaaatacatggaaactgaacaacctgctcctgaatgactactgggtacataacaaaatgaaggcagaaataaagatgtgctttgaaaccaaggagaacaaagacacaacataccagaatctctgggacatgtttaaagcaatgtgtagagggaaatttatagcactaaatgcccacaagagaaagcaggaaagatctaaaattgacaccctaacatcacaattaaaagaactagagaagcaagagcaaacacattcaaaagctaacagaaggcaagaaataactaagatcagagcagaactgcaggagatacagacacaaaaaacccttcaaaaaatcaatgaattcaggagctggttttttgaaaaggtcaacaaaattgatagaccactagcaagactaataaagaagaaaagagagaagaatgaaatagacgcaataaaaaacgataaaggggatatcaccaccgatcccaccgaaatacaaactaccatcagagaataaacacctctacacaaataaactagaaaatctagaagaaatggataaattccttgacacacacactctcccaagactaaaccaggaagaagttgattctctgaatagaccaataacaggctctgaaattgaggcaataattaatagcttaccaaccaaaaaaagtccaggaccagatggattcacagccgaattctaccagaggtacaaggaggagctggtaccattccttctgaaattattccaatcaacagaaaaagagggaatcctccctaactcattttatgaggccagcatcatcctgataccaaagcctggcagagacataacaaaaaaagagaattttagatcaatatccctgatgaacatcgatgcaaaaatcctcaataaaatactggcaaaccgagtccagaagcacatcaaaaagcttatccaccatgatcaagtgggcttcatccccaggatgcaaggctggttcaacatacataaatcagtaaatgtaatccaacatataaacagaaccaacaacaaaagccacataagattatctcaatagatgcagaaaaggcctttgacaaaattcaacaactcttcatgctaaaaagtctcaataaattaggtattgatgggacgtatctcaaaataataggagctgtttatgacaaacccacagccaatatcatactgaatgggcaaaaactggaagcattccctttgaaaactggcacaagacagggatgccctctctcaccactcctattcagcatggtgttggaggttctggccagggcaatcaggcaggagaaagaaataaaagatatttagttaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaaataacagagagccaaatcatgagtgaactcccattcacaattgcttcaaagagaataaaatacctaggaatccaacttacaagggatgtgaaggacctctttaaggagaagtacaaaccactgctcaacgaaataaaagaggacacaaacaaatggaagaacattctatgctcatggataggaagaatcgatatcttgaaaatggccatactgcccaaggtaatttatagattcagtgccatccccatcaagctaccaatgactttcttcacagaattggaaaaaactactttagagttcatatggaagcaaaaaagagcccgccttgccaagtcaatcctaagctaaaagaacaaagctggaggcatcgcgctacctgacttcaaactatactacaaggctacagtaaccaaaacagcatggtactggtaccaaaacagagatatagaacaatggaacagaacggagccctcagaagtaataccacacatctacaactatctgatctttgacaaaactgataaaaacaagaaatggggaaaggattccctatttaacaaatggtgctgggaaaactggctagccatatgtagaaagctgaaactggatcccttccttacaccttatacaaaaattaattcaagatggattaaagacttaaatgttagacctaaaaccataaaaaccctagaagaaaaccaaggcaataccattcaggacataggcatgggcaaggacttcatgtctgaaacaccaaaagcaatggcaacaaaagacaaaattgacaaaagggagctaattaaactgaagagcttctgcatagcaaaagaaactaccatcagagtgaacaggcaacctacagaatgggagaaaatttttgcaatctactcatctgacaaagggctaatacccagaatctacaaagaactcaaacaaatttacaagaaaaaaacaaccccatcaacaagtgggcaaaggatatgaacagacacttctcaaaagaagacatttatgcagccaacagacacatgaaaaaatgctcatcatcactggccatcagagaaatgcaaatcaaaaccatgataagataccatctcacaccagttagaatggcgatcattaaaaagtcaggaaacaacaggtgctggagaggatgtggagaaataggaacactttcacactgttggtgggagagtaaactggttcaaccattgtggaagacagtgtggcgattcctctgggatctagaactagaaataccatttgacccagtgatcccattactgggtatatacccaaaggattataagtcatgctgctataaagacacatgcacatgtatgtttattgtggcactattcacaatagcaaagacctggaaccaacccagatgtccatcagtgatagaccggattaagaaaatgtagcacatatacaccatgaaatattatgcagccataaaaaaggatgagttcatgtcctttgtagggacatggatgaagctggaaaccatcattctcagcaaactatctcaaggacagaaaaccaaacatcgcatgttctcactcataggtgggaactgaacaatgagaacacttggtcacaggaagggggacatcacacaccggggcctgttgtgggatgggagcaagggggaggcgtagcattggtagatatacctaatgtaaatgatgagttaatgggtacagcacaccaacatggcacatgtatacatatgtaacaaacctgcatgttgtgcacatgtaccctagagcttaaaatataataataaaaaaaataagtaaataaaaaagaatatgcagtgctgctcttcactgtagaaagagcctgagaattatcttgaactccaaatcctgtaccttttttcatcacagttgtgtatgggttttatctactactagtttttttccaagccttttcacatcttgacacatagtaaatttgaccaagaaaagatgaaaggaaacataaaagaatgtgttcttggctggagatgacctactcttggggtctagctgccccaaagactgagaggattgttaactctgacacctataacccattcatgatttagttggtaagcagatctgcccatttctttcttcttcattgccagatctcagttcatgcactagttatgccctgcttccacttcatctaagaataattctgtgtcgcaatataccataattatatattaatcttctcatatttgcattagaactttaagattattgggctacttaaacttcgtaactcccctcgttacatcttttttttccctgaaaacatttgtcatttctctcccaaccactgcctcattttaatttactatctctgcaatactttttcttttcttttccattagagatgatatgctgtcttctttaggaaactttacctaagtgtaagtaaggaaatgaatgctatcctccctagtgtttttattatgatagctaaaatgtaacatataaaaagaagtgtatatagaaacaatatttttgttttagttctatgccatatctctctataggttattttttatatttttaaacgtttattttttgaaggttggaaccagatatgtgagtttaaggggctttaaactcttttaaaaatcttttttttttatatttcaaattctgttttattgtaaaagttcctgcagaacagaaaagttttatttaaatagttttctgttttcttgagcattgtgcagtgtatttttagtatacttagcatacttactattacttgatgttaattcagccaattttaggctggtggggaagatgattcatgtacactaacagttataatgcaaaatagaaactagtaaaagcctcaaggttagttgcctctccttgtgcttccatagtaacccgtgcttattccttcattgcaactatactgtattgttattgcctctatatttatctctgatagagtccatcataaactagaacagtggttcttaattgatgtgggggtggtaaggaatggggcttgcgcattttggaaaacatcttctcatattctttttcaggtacatcactctctccaccactatcactactgcccttcttcttttgaaaactcctgtactcacctttaagcccttcaaaattagggaagtgtatcttatttgtcattttatctctagtgcttagcatttttttttggcatctgtgcccattaaggtagacagtaactgtttatttgttgcaggaaggtaaaactaggttggaggtggagggagcacttctaacctggaagaatattgaagacttccttgaagaagtgtcatttgagaggagctatgaaaagaaagtaaactggttttatggaagtaaatgagaacattgcagacaagaggtaatgggcaaaaacacagaggcaggaaagtgtaggatgtattccaggaatactcatgcaaaaaccatagactatgtgaagtgtgagaaagcttatagtaaatttgcctgtattcagtcagattgtgaatacccctttataccattatatgtaatttgaactatttgtaggtggtagggaactattgaaaagttttgattgtggtgtaacttgatttatctgtcagcaacttgatacatctgtcagtgtataggtaagattgtggatacagagaaagtggagacagggacatcagttaaaattaggacattaggtacaattagagtttagaatgacagtgaagaaggaaggaattgatgcaagaggtattttaaaggtaaaatcaacatactatggcttctttttttcagtatcacattattcatttttaagtggttactgaatattcctaatgaagcggtagtgctagtgaaaaggaacattttgataggcgaatctttctcttttgtgactgaattgccttggcatttatagaaaataaataatgaagttaattggatatcatcttgataataaaaatgtaattaagtttttgatattatggtttggaggtttattttataagaattagttgtaaactagagaagaaagaacaagatattaatttagattttatgcctgtagtagcttatataggcaggcctattatgtgttctttcccatttattaatttgggcttagaagaagctgagttatggcctactctgagtgccactttagatttcactaggaatcagcatagaatacattaatgcactgtttaatacaagtacaagaacttgagttgaaatcttgaaaatgaagggcagtctccttgttaatcttgtgagctgccctcatcagagtataggttgagcatcccaaatctgaaaattcaaaatctgaaatgctccaaaatctgcaacttttgcgtgctaatatgatgctgaaaggaatgttcattggagcatttcagaattttggattagggatgttcaactggtaagtgtaatccaaatattctggaatcctaagaagtccaaaatacttttggtcccaagcattttggataagggatactaaacctctatttgataattgtatttccatgggttttaactgaatacaaaaactaataccatcatcaatgttgattgatattgttttcacagttttgggagatacaaaataattatgatttattaggttatctttgcttaatatacattactgatcaggtgaattgttcacatcactattggtattatttctcttaagtagtttcttgagactgtatatatatatatatatattttagtgtttgctttatatagtcatcagctctggcagctcatttggattgttttaaaaccccaaaccaagacttgattttaagatggtaaagacatttgtgccctattctatctgaaattaccatgaaacaacaaggaaactgagagaaagagatgtaattacatctttgctgagactagaagacctgtaactccaaactgaaatatttgagaaatggcagccacatgtaagcaggaagaggttaaaagagaatgctggtagaaagagatctcagatagagctggcagagcaaagagtcctcttctgtttgcagtgggatcaggatgcatagaaaggcaatgggaatttccttggattgtttggcaacatgaactagcaagaaaggaagagtgaatgaggaagtgcacagataccccatctttgcaggaagcactctcttgctgaggcaaagtagaggagagatagtgagtggccctttgctgcctgtctctgacatctggaagaagtaatgtttaaatgcttttcccacttgttctcatacacattctctgcctttctcacatatacacatgtacaaaatactctgtcagaaagagttttcttgtataccagagactaccctctagtctagaatacacccttatttctttcttccatagttaaggcgtaaattatattcccgtttagaaaagtagatgaggactgggtgccgtggctcatgcctgtaatcccagcactttgggaggctgaggcaggtgggttgcttgaggtgaggagttcgtgaccagcctgaccaccacagaaaaaccccgtctaaactaaatatacaaaaattagccgagtgtggtggcaggcacctgtaatcccagttactcgggaggctgagataggagaattgcttgaacccaggaggtgaaggttgcagtgaactgagatcgtgccactgcactccatccagcctgagtgacagagggagactctgtctcaaaaaaaaaaaatgcttaattgtagttctgaaaatagagaattcaatgttataacagaaaaaatatttaagaaaaccttctgcaaagaaaagacatctttaggtcaggctcagtagtagctcacacctgtaattccagcactttgggaggctaaggcaggaggttctcttgaggctgggagtttaagaccagcttgggcaacatagcaagaccctgtctttacaaataaatttttaaaaaattagctgggcatggtggcacatacttttactcatggctactcaggaggctgagataggaagatcacttaagtgtgggagtttcgggttacaatgagctatgattgcaccattatacttcagcctggacgacaaagtgagaccctgtctcaaaaaaaaaaaaatctttattctacagattgaaaggaaacacactgaatgaggaaaaactaacatacggtcatcaacatccttgtataacctagtttttaaaaaaattggatttcaaaggtaaggaatgcattctttgctcatcccaataaaaagattaaactacctatcaggagttggtttgggaaatcagatattgtcaagggaatatttagcactacaggacaatggtacaaagtgtgtaagtcattggggaaagacagtgtaacctcaaagccaaattgacaactatttttgaacaaggcaaaagctcaaggtaagtggtacccctaagttctttttgataaactgcaagaagatgaatatcagtcatacagtagatgaacagagatgatatagcaaatggattggcagggaacattgtaggaataagaccaaaataactatgagatttgtagttatagaatacaatagaactgtaacatgtagaaataattaataaaagtcaagattgaaagaggagagaagacagaatgtagtataaatttgttggtttcttcttattttatagctggagaacaaaagacatataaaccttagatatcaagcataagagaggtgtcagtatatttgaaggattgaaggaataaatgtaagcatttgaagaactaaatgtgtttaaccaaaatcaaacagtggagacaaggtaggaagaagtagaactgtattaaatttcttatcctaaaggaataatcagagatgagacctaagatgaaagaacaaaatgtttattgtggcattctttacagttgaaaaaactgaaaacatacatggagtataaataaaaactgaccacatcctagatcacacacaaacttgaaaagcaacaaagagctgtcttacaggccatgttccttgactaaaaacggtctcagtttctcctttggaagtggttctcagcattgtcagcagcaccagcatcatttgggaacttgtcagaaatgaaaattctgaggtctcataccggatttactgaatcagaaactggaggagaaaagcacctctcaaccttgttggtcagtttttataaatatcctatttatgttttcagttatttacagttataaaaaaaagtgataataaacatttttgttttttcatcattggtctcatatttgattatttctttagcatagacaatgaccagatcaaagaatgcctgtggaaatttaattttttctttgttctattgttggttattacaggtacaaaattaaagaggtttttgtttctttaaaaatatcttttttgttcacagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaaggtaattttattccttctttcttatcattcctcctttcttatcattgtatattttctgatcacacttctctttgcaatacataatattaatcatgggtattcaaattcttgcatctttgcgaggtgtggcaaacaattaaaaattcagttaaatatacttgtaatagcacactaaagacaggtgctaagtttcaaggatgtttaatctattggaatttcctgagctagttatttaaaaattattattttgttaaacagattatccttcatttaaatgaactcaatgataaataattttgataaaatgtcaaaattagtttattttagtacagcatatattttaatttagtacctactggggaagtataatggtatgacttacctttatctgtatgtataggaataaagtagagacaatgatgtggaaatcaatagcttctgaagattccgtagaatataccagataaggaattccaaagttgagatggtgttgttacattgtgaaaagttgccaaacactccctctggggtgtattataataattactaccatcactgataattgtactagatgctttccatgctcagtttagtcctaaaaacaatcatggggaagaaaaaaaattttttttgtttttatgtttttatcctcatgtcttaattagaactattcatcagaattaatcactttgcgcccctcctcaactagaatggagtatacttccctgccttttttatgttgggcttgaccagtagaatgttaacagacatgtgcagaagctttgaataggctgttgtgatttgacttagtttttatgctcccctgacctataggagaagagaaaaatgtatggagcagaccaaagcatagctgcccagctgactcacagatttgtgagggaggaaatagatgcttataagccataagactgggggaagtttattatgcagcattgttacatggagttattagacctaattttgacagataagaaaactgaaacttttcttttttttttttttttaattaatttattttttttattatactttaagttttagggtacatttgcacattgtgcaggttagttacatatgtatacatttgccgtgctggtgtgctgcacccactaactcgtcatctagcattaggtatatctcccaatgctatccctccccactcccaccaccccacaacagtccccagagtgtgatattccccttcctgtgtccatgtgatctcattgttcatttcccacctatgagtgagaatatgcggtgtttggttttttgttcttacgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttattttaattagatcccatttgtcaattttgtcttttgttgctattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccctatgaactttaaagtagttttttcgaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattatgaatgggagttcacttatgatttggctctctgtttgtgtgttgttggtgtataagaatgcttgtgatttttgcacattgattttgtatcttgagactttgctgaagttgcttatcagcttaaggagattttaggctgagacaatggggttttctagatatacaatcatgtcgtctgcaaacagggacagtttgacttcctcttttcctaattgaataccctttatttccttctcctgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaagaatattggtctaaaattctctttttttgttgagtctctgcccggctttggtatcagaatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatatcagagcctgttattggtctattcagagattcaacttcttcctggtttagtcttgggagagtgtatgtgtcaaggaatttatccatttcttctagattttctagtttatttgtgtagaggtgtttattctctgatggtagtttgtatttcagtgggatcggtggtgatatcccctttatcgttttttattgtgtctatttcattcttctctcttttcttctttattagtcttgctagtggtctatcaattttgttgaccttttcaaaaaaccagctcctggattcattgattttttgaagggttttttgtgtctgtatctcctgcagttctgctctgatcttagttatttcttgccttctgttagcttttgaatgtgtttgctcttgcttctctagttctcttaattgtgatgttagggtgtcaattttagatctttcctgctttctcttgtgggcatttagtgctataaatttccctctacacattgctttaaacatgtcccagagattctggtatgtcgtgtctttgttctcgttggtttcaaagaacatctttatttctgccttcatttcgttatgtacccagtagtcattcaggagcaggttgttcagtttccatgtagttgagcggctttgagtgagtttcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcacataggacttgctttatgaatctgggtgctcctgtattgggtgcatatatatttaggctagttagctcttcttgttgaattgatccctttaccattatgtaatggccttctttgtctcttttgatctttgttggtttaaagtctgttttatcagaaactaggattgcaacccctgcctttttttgttttccatttgcttggtagatcttcctccatccttttattttgagcctatgtgtgtctctgcacgtgagatgggtttcctgaatacagcatactggtgggtcttgactctttatccaatttgccagtctgtgtcttttaattggagaatttagtccatttacatttaaagttaatattgttatgtgtgaatttgatcctgtcattatgatgttagctgctgattttcctcgttagttgacgcagtttcttcctagtctcgacggtctttacattttggcatgattttgcagcagctggtaccggttgttcctttccatgtttagtgcttccttcaggagctcttttagggcaggcctggtggtgacaaaatctctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgccaagagatccgctgttggtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagtacttctctgtattggttattctagttatacattcttctcaatttttttcaaagtttttaacttctttgcctttggtttgaatgtcctcccgtagctcagagtaatttgatcttctgaagccttcttctctcagctcatcaaagtcattctccatccagctttgttccgttgctggtgaggaactgcgttcctttgtaggaggagaggcactctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggagtaccctgccttgtgaggtgtcagtgtgcccctgctgcggggtgcctcccagttaggctgctcgggggtcaggggtcagggacccacttgaggaggcagtctgccggttctcagatctccagctgcgtgctgggagaaccactgctctcttcaaagctgtcagacagggacattgaagtctgcagaggttactgctgtctttttgtttgtctgtgccctgcccccagaggtggagcctacagaggcaggcaggcctccttgaactgtggtgggctccatgcagttcgagcttcccggctgctttgtttacctaagcaagcctgggcaatggcgggcgcccctcccccagcctcgctgccgccttgcagtttgatctcagactgctgggctagcaatcagcgagattccgtgggcgtaggaccctccgagccaggtgtgggatatagtctcgtggtgcactgttttttaagccggtctgaaaagcgcaatattcgggtgggagtgacccgattttccaggtgtgtccgtcacccctttctttgactcagaaagggaactccctgacaccttgcgcttcccaggtgaggcaatgcctcgccctgcttcggctcgcgcacggtgcgcgcacccactagcctgcgcccactgtctggcactccctagtgagatgaacccggtacctcagatggaaatgcagaaatcacccgtcttctgcgtcgctcatgctgggagctgtagaccggagctgttcctattcggccatcttggctcctacccgaaacttttctttttttaagagaggatctcgcttcgtcacccaggctgaagtacagtggcataatcatagctcactgtaaccttgaatctggggctcaagcagtactcctgcctcaatctcctgagttgttaggaggactacaggcacatgccatcacgcctgactaattaaaaaaaattttttgtagagacggggtctcgctgtgttgcccaggctggtcttgaactcctggcctcaggcagttctgtcacctcaggctcccaaagtgctgggattacaagtatgggctactgcaactggcctggaaaaccaaaattgttaacagagatgtgaaataatttacccatacaaaccacccaatatctaatgtgtatagctgacctctaatgtccctagctccattttttccaggctatataattttaaaaataacagactatactgattctacttttgatcttggctgtttatccaatgaatgtctttctgtgacatcttcaaccctttcctcattattttcttaggataaagtcctagagtagaaattctagatctaatatgcacattttagatttttgttatatattacaaagttatccttcataaggataagcagtatacctgatttctcatatcttttcataaataggaataacaataataatggcatctgtttcagttagagatggctggctaatagtagcttaaacaaatagaggaattatctgtccatatctataagtctagagcctctaaaattctcttggtatttcctgtgttacagtcaaggctagaaggaataatagtgtgatctagcaggcttctagttttgtgacagtggccagcagattcccaaatataagagaatctggggaagtaaggttttactattgttatttagcttttctagcctctataatagagattgcaaaagagaaggggtttgggaatgggtgtcaggtcagcttacctatagtgcctgccatagcagctaacattttttgatgtgcttgattgagcaggccctatgcgaagcactttaccaacatttaattcttaaaacaagttgagtagatcttgttcttcctgtttttccagcaaaaacattgaggttttgagagacttactaattttcccaatatcacatagttattaagtgggggagatgaacctgaggagtctaccccaaaacctcattcattaatttttagtgttcgtaatattcagaaactgaaagctattcaactccattagaggtcgtttctttgattactagtggggttaaacatctttccatatgtatattggttctttttagttgtattcttacttcttcttatttgtgtctttcatatatgttcctgatgatgttgtctttttctgtagctgttctttatagtttgaagaatattaaaccttcatcatatatatttcaaatatttttcctgacttgtaatttgccttttaactttatattcatgatgtactccctcaataaattagtacttaatgtataaatagacagatgtcaaaatctgttttccttagggcatctgttttttatgttataagtagcccaagattatgggaatatttaactgtatttttgtctatttaatgtttaaattttttcactaaaatgaatttattttagtatgaggtatgaattagacatctaacttacatttttccacaatgattaaccaattgtcccaatatcccttattgaattacccattactttaaaaatcccatcttaattatatattaaattctaataaagaactgctgtctcaacccttttcccttggtggcagtgtaacatagttgttgagagcatgaacatcagtttgagattaaacctcatctatactgcttattagctgtgggatcttgagttaattacttgacttctaaatgcctttgtttccttatctacaaaatgggaggcaataacagtaccacctcatagacttgtgaagcttaaatgaattgatatacataaactatttggaacaatgcatgttatacagaaagaaaccagtaaaaattggctattattattattttttaattttataatgaaaaatagtatttgttgtattgtgtccataccatacaaactgccttagtaataatgccttattcattaaagaaaatataatctttgaacagaagtggtatgtaattaaagttcaggtaacctttatataccattaattttgtaaagttcattattcatactagattcttgttttttatgtttacttttgataataggtagacattataacatctaagttctaaaatatcacagattatttttattttattgaaatatatggagtgggtgcagtggctcacacctgtagtcccagaatttggggacactgaggtgtgcagattgcttgagcccaagagtttgaaaccagccatggcaccatggcaaaaccccatttctacaaaaaatacaaatattagcccagcatggtggcgtgtgcctgtagtcccagctattcaagaggctgaggtgagaggatcacttgagcttgggagattcaaggctgcagtgagctgtcattgcgccactgcactccagcctgggtgacggggagatcgtgtcttaaaattttttttttttaacatatggaaattatattaaaccgtttgtagcccagtaattgtatcctttaaaatggaatttttaaatttactcatgagttcagaaactgttatttaaaagtcacaatttgtagagtattttgccaaggcaatagaaacaatgaggtggtttcttcctgcccaatatttataatttaatttgggacagatgctgatgagagtatagatgcttcctgtatgttatagtgtgaaaacaggatactgtctgtaaggaatacaagcagtttctctatgccagtaggaaaaaaaaatgctttatttaaaaatagtaaggagaccaggtgcctgcctgtaatcccagcactttgggaggcttaggcgagaggatcgcttgagcccaggaattcaagaccagcctgggcaacatagtaagatctcatctctgctaaaaataagaaaattagctggttgtggtggtgcacgcctgtagtcctagctacttgggacactgaggtgagagaatccctctgagcccaggagtttgagtttacagtgagctaagatctgcactccaggatggacaagagagggagaccctgtctcaaaaaataaataaataaatatgtacatatgtaaaataaaaatagtaaggatagttagactaattagatgctaaagataccaacttttaaatttatttcagtgtcattgtggaaaattttgaagcttttgggtttttgttaaacttataaatctcacttacacgcagcgtttttgaactcaaagtttagtgaagtatagatgcatcctcagttttctaatggttttcttctgacataggaagagaacctgaactattgttaactttgtttaccgattacatctgaattgcattcctctgttgttcaatgagcagtgttttgtgggatatgcttagataaataaattcatgtaaaaattacttatagttcaattaaatgtttgatttggtagccaaagagtatggaatcatagtcttgatcagtgtgaaattataggttagcgtcatcaacataaaaaccaagattctaagtcatccttgaacttcaaggtaattttcagagacccttgagattatgtgttagagatagggatgaaaaattgattttatcttttattccaacccaaatttagtagcagtaaatgcctgcagcaccatggtaagaaggactgcaaagctttcaggcttttcaggaaagaacactctagtactggctaccttggagtttaaggagacttacttttgaccattttgagggccttagcacagaactactcttggtcctagctggttagacaagcctagcttttctatgatcctccaaatgggatctgaataatccagttatcatgttagcattgaagataaagaactagtatattatatttattgggtctactaaaatttcatagacgggtagaattgactcttcagattccagaacaacccttcaggtcttggatatacaaactcctttagtgtagtgtccttgtgagcattgtctgtgggcgccaactttcaagtagttggcttgcagctcacaccagaatggaaaggacatgtttctaggaccctgaagagaattttcattgttcactgtttttatgcaaccaacaggatagtatgataattgtgtgtgttcatttaatccgtatttattgatcactcgtcttacacagtgtacttaggaatacagagataaatagaacacaggccctactcatgaaactcataatttgatagacatggcagtatcaataatttttgagtttgggcactacatagtcctcatgcaattgtttggctttcagcaagtcactttgagcaccagtttctttaaatgggtctaatggcaacattgctggttgagataatgtatgtgatatgtctcacttagtgtctgatacatggtagatgataactatcagtagcttacattttctagtacttttaaggtttacattgcagtttgacaagtaaaattgtattaaattcttatagtgtccctataagcttatattttttactttttcataaaccaagttaactggggtccagatatgttaagtttcttaagttcaagattgccaatcaggtcctaaaacttgtatttattcatacagctattccaacatgtaaatataaatttgttcaaaagaaatgagtgataagatatgaaatgagatggctttaaggaatgccgtagcacaacagaaaatcgtcaaatattgatgcctatgtggagggaagacaaagccaatgaactatgtttgtattaggcactgagtgatccaagcctttttattgttcttgacttagtccaatgagcagcaccagtgcctgcagtaatcagctgtttgtattatctaggagcccacttatagaattgggtgctgagatatcttattttgcattctatttagtagcctatgtatgtttggttagaaggagggaggagggagttgaaaggggagtttggatttcaagtttggcagtagtcattcacagtgagcaattttatatgccattattagaaatggaaatcagtcttgtagccatttagatcatgtgcaacaaaggcttttgaatatttttagttggttagttacttgctaaaattatgcaagaaatatgattttccctttatcttttttcacttttgggcttcttccattttgccttcaaggataacatataggtcatttctggaggaagaatattatatttgatagcttgatccaatgtggtaaactttaataaatactactgccccacttcttctatcaccctctcactcctgctattatccaggagaaatgtgatataatttctttcattagaattgaagggtgtttttatagtctttccattttttcatttattctcaaacattaggctgtgtaggtttgtaggttttctggccagttttgattattaagaatcacagcttttctaccatttaaggtcacatttatgagtgattcactaataaatctaagaactgcagtggcttgggagtaaatataagagaaatgtttctactgaaaagagaaacactgagaggcagaagtggaaggctatctggagggttgtggaattggcaatggtcagtgtttctgatccttaggtttgcaagcttataagcaattgaaaaagacagttattgaagacttaattttttctgaaagtactactgtttgattctatatgagcataattaatgatcatgctgaattaggaatttggtttgagggtttctataagaaacactgttggatactgcatttcaaaaatgatagaattttttcttaaatcttcacctcctactttctggatgctttttctttgataatatatctttatttgacccagttatcactagagttcagttgctaccagacttttcctaccagttgttgttggcatctgattccatctgtttactcatttattcatttcccgtaaatttttactccaaatatcccataggcagtgtgtcagaatatttttttttaaccagttgactttacatggcatttctttcagaacattctgccattcatttgtcaagtatttgttgaaagcttactgtgtgccaagcacagtaataggctatgaaacaaatgatcagtgaagttcaatccttatgtctaggaactcacaaattgggaaatttgggggatgaaggggagagaggttaagaaacataaagagacatataagcaaacaataacaatacatgttacctcttttttcaaagcacacttcataacttttctgttctctagtatctagcctttgtaatctttcttctgtactgttgtcagagatatttttcttagatgcagatctgatccaagttattctctgcatagtatacctatggaataagaaccaaacttcttagcatagcatgctggatatactgtttgctctccaaattctctctttaccatactctgttcttggggaggcagacctttatggattatattagctgagctcccttgccctttggtttcctgttgggtttagccaatgggatacggctggagattgcaaactggaaagaaagagaggtcagattatttattctcttggttctctacttgtagggtcattggttgacagtgactgcatcttcctgtatagctacagttgcagccactgtagctgccactgagtgccaataactcttgctctccagagacggattaaacgttaagataatgaaatttaaacttcagggcccctcacttgcaggggacttgcagaggccttaggaatctgtttacaaagctatttatttttgtaacatttgcaaaagttatttttacattctttctgaagaagggccgacggctgggcacagtggcttatgcttgtaatcccagcatttttggaggccgaggtgggtggatcacctgaggtcaggagttcgagaccagcctggctaacatggtgaaaccctgtctctaccccaaataccaaaattagctgggtgttgtggcatatgcctgcctgtaatcccagctattcaggaagctgaggcacgagaatcgcttgaacccaggaggcggaggttgcagtgagccaaaatcacgccagtgcactccagcctgggtgacagaatgagactccatctcaaaaaaaaactggggggggcgggtactaacaaaatggtataatcttcaggccctataaaactggaccctccaatgtccttaaccttgacccttcaagcttaggtaagtataaggtttacagggaagagagactactgaataacatacttgggaaggctattaatgaatatttcatggatgaaataataatttgagttggtgttgtaggatgaggagttcttcaggtgaagaaggatagaaaggtcattacaaatagaagacacagcctgttcaaagggaatgagtattttgatgtctacagtgaagcatactaggtagaaaacaaagaaaatacaaaagtcctgcggcaggaatatgtctgtcagttttgagaacagcatagagatcaatgtggctgtagacaaatgagtgatggggagaatagtaggtaaggttagagtttcctgttacttagggtcttgtaagccgttgtaaggactttgaccttttatcctgagtgagactgggaaacaggaaggttttgagctatgtggacatgatctgactattgttttaaaacaagtagtctggccactttgatgagaatagattggctgtgttgccacccaaatctcatctttaattgtagctcccataattcccatgtgctggggggggacctggtgggagataattgaatcatgggggtggcttcccccatactgttcttgtggtagcaaataagtctcatgagagctgatgattttataaggggagatctgatgatttctccttttgcttgattctgattttctcttgtctgctgccatgtaagatatacctttcaccttctgccatgattgtgaggcctccccagctacttggaactgtgagttcattaaacttcttttgtaagttgcccagtctcaggtatgtctttatcagcaacgtgaaaatggactaatacacagagagaccagttagaaggctattctagtaatttacacaagagatgataatgatttggacaagagagttgatggtagagttggtgagaaatggaaagtacagtattcaggatttgttgatggattcgatgtagggtattagagtgacagaagcgagtcaaggataactctagtatttttgtcctaagtaattgcaatggcaaattgctgtttactgagatggatgagactgggaagagcaagtttgaggaatggtgaaaatcaggagtttttttgtacgtgttaagtttaaggtgctatgttaatctgttctttcattgctgtaaagaaatatctgaggcagggtaatttataaagaaaagaggtttaattggctcatggttctgcaggctgtagaggaagcatgatgctagcatctgctcaacttctggggaggcctcaggaaacttacaatcgtggcagcaggtgaagggggagcccgcacctcacatggccagagcaggaggaaaagagagagtggggagatgctacacacttttaaacaaccagatcttaggggaactcactcactccctatcacaagaatagcaccaagaggatggtgctaaaccattcatgacaaactgtccccacaatccaattacctcccaccaggccccatttccaacactggggattacaatttgacatgagatttggtggggacacagatctaaaccatattattctgcccctggcccctcacacctcatgatcctttcacattgcgaaatacaatcatgccttcccaacagtccttcaaagtcttaacttattccaacattaactcaatagttcaaagtctcatctgagacaaggcaagccccttccacctatgagcctgtaaaataaaaaattagttagttactcccaagattcgatgggggtatagtcattgggtaaatactcctgttccaaaagggagaaattggccaaaagaaaggggctacaggccccatgcaagccccaaacccagcaggttactcattaagtcttaaaaccccaaaatttgactccatgtctcatgtccagggcacacgggggtgggctcccaaggccttgggcagctcagaccctgtggctttgcagggttcagcccccacaactgctctcatgggctgacattgagtgcctgcagcttttcctggtgtaccatgcaggttactggtggatctaccactttggggtctggaggactgtggccctcttctcacagctccagtaggcagtgccccagtgggggctctctgtgggagcttcaaccctgcatttcccttccacactattctagtagagttctccatgagggctccattagcagcaagcttctgcctggacatccaggcttttccatacatcctctgaaatctaggcagaggctcttaagcctcaactcttgcactgtgtgcacctgcttacagcttgcaccctctgaagcagcctcagctatacctgtgcccccttgagccatggctggaactagagcagctggaatgcagggagcagtgtcttgaggctactcagggtggcaggcactgggcgtagcccaccaaactattcttccctcctacgtctccaggcctgtgatgggaggggctacctccaaggtctttgaaatgccttcaaagccttttccccattttcttggcgaatgcaaatttctgcagcctgcttgaattcctcccctgaaaatagacttttcttttctatcacatggccaggctgcaaattttccaaacatgtatgccctgcttccctattaaatatgttccaattttatgtcatttctttgctcacacatatgagcataggttgttagaagcagccaggccagatcttgaactctttgctgcttagaaatttcttctgggttgggcatggtggctcatgcctataatctcagcactttggtaggccgagttgggtggatcacaaggtcaggagttcgagatcagcctggccaatatggtgaaaccctgtctctactaaaaatacaaaaattagctgggtgtggtgatgggtgcctgtaatcctagctactcagaaggctgaggcaggaaaattgcttgaaactggatagcagaggttgcagtgagccacgatcataccactgcaatccagcttgggcaacaagagtgaactctgtctcaaaaaaaagaaaaaaagaaatttcttcttccaggtaccctaaactatcactctcgagttcagagtttcacagatctctagggccagggcacaatgcagccaggttgtttgctaaggcataacaaaagtgactttttgcttcacctcccaatacattcctgatttccatctgagacttccttagcctgggcttcattgtccatatcactataagcatcttgatcacaaccattcaacaagtctctaggaagtttcaaattttccctcatcttcctgtcttcttctgagccctccaaactttccctttgcctattacccagttccaaagttacttccacattttcagacaccttacagcaacactgctttcctggtaccaattttctgtagttagtctgttctcgaattgctataaagaaacacctaagactgggtaatttataaaggaaagtttaattgtctcattgttctagaggctgtacaggaagcatgatactggcatctgcttggcttctgtggaggcctcaggaaacttagaatcatggcagaaggtgaaggcggaaccagcacttcatatggctggagcaggaagaagagagagagggaggaggtgctacagtcttttaaacagttagatctcaggataactcactcactcattatcacaagaacagcaccaaagggatggtgctaaatccgtcacgagaaactgtttacatgatacagtcacctcccaccaggtactgcctccaacactggggattacaattcagtatgagatttggtggggcacagatccaaagcacatcaggtgcctatttgacattcaaatgaagaaggtgaatagacaattggctatataagtctgggtagagtgggttgggagtacaaatggagtgttgtaagcatatagatggtgtctaaagccatatgactagatgagatactaaggaagtgaatatagatttttaaagggggagaaagaaagtgccaacatctgaggtttgggaccctccaacacatcagggaagtaggaagaactgacaagttaaagaagcagccagagagaaacagagaaaaaacagaaatatggtgatacagagagctaagtgaatgaagtgtttcagtgaggcagaggttgtcaacaattcttggtatatcaaataagataagtattgataattgaccgttggatttagcaatgttcaggtcattggtgatcttgatgatgctcagcagagtgaatttaaaatgaagtgagttcatgggaggagaggaattggaggcaatgagaagagacaacccattaggagttttgctgtaatgggggacagaaagttgttctttgggaaaagaggagttgagaagtttttgtgttttgttttaattattagtgttttaagatggaataaataatagtcatgtttgtatactgatgggaatgatccatcagagaaagaaaaattgctggagcaatgtctttgtccagtcaaggggggatgggatttagtgcataagtggagaggctggccttagataggaacatagacaattcatctgttatgacagaagggaaggtgtattatatggatataattcttgtacagtaggtgggaagatgtggtgggggtttttgaaaattattttcaaatttcttttttctcagtgaaatagaaagcaatgccataagttgaaagataggatagggaggtgttagaaaaaagggggaaaagtcatctaggagaatgagacagttaatacacaaggggaatgtagtatgatttctgggcagaattaaagccccacttgggattagtagtcatgaatttaaattgacatcagccagatatggtgtctcacacctggaatcccagcactttgggaggcggaagcaagtggatcacttgagatcagcctaggcaatatggtgacaacctgtctttatgaaaaatacaaaaattagccaggtgtggtagtgcatgcctctatagtttcagctgctaggaagactgaggtaggagtatcacttgagtctgggaggttgaggctgcagtgagccgtgatcacgccactgcactccagcctgggcaacagagacccctgtctcattaataatagtaataataataaagtgatatcagtcagcagccacattagctgcacagttgcaggtgcagaataagtagaaagttggcctttgctgagcaaataaaatgaagtcagatggaggaaagttgtcagtgtatacaagagaatgattgtgaaacatgaatatttccgattgcatttttcataatagccaaaagctggaaataacctaaatgttcatcaactaatgaatgaatatacaatggaatattagccataaaaggaaatgaagtactgatacatgccacagcatgaatgaactttgaaaacatcatgcttagtgaaaaaccagatgtaaaaggccacatatatgattccatttttatgtagtgtccataatgggcaaatccacagagaagataattagtgttatgattggggctgagtggaggaggaaaggggagtggctgttaataggaacatagtttctttttggagtgattaaaatattctggaattagatagtggtaatagttgcacaactctaaacatactaaaaatcactttagaaaggcagattttatggtatgtgaattatatctcaataaagctatataaaaataacatgctagctcactagaaatttgcttatcccaaactcaacaaattgaacagctcagaaatatagctgagctgtatttgtaatcaactaatgtaggactaaggtgaacaagtagctgtattacaatgtttgcagtctcttttcaggtttcaagattacagttgtttttttctcagacatcccttagtattaaaatgttattggctaagttgcagagcttgtgaggagagaccaattctggctcagtcttaattacttagtatcttcatctctccatcccttcctctccccttccaattaacaaacctttactaagctataaaaatcatcaagcactatcctaggtgctactggttatacaaagatggattggactttgtccctccccttgaatgtgaggtttaatggggaaatgaggtttaggaacttggagcacatttcatttttagggtgagactactctaatcgttcttcagcatcctcccatctatagcttatagataacgtatgcactcaaggcataagaaacttatttggatcttcattacgcttgaaacattcttccttttgtctctagaacatcagacattctttctcctcttactctaaagtattttggggctaccagatgaaaactcataataattttcttctgatgctctagacctgaaatatcttttataaaaacttcaacattcaaaattacgatgtatgttaggcaaagcgtgcatactggtgctatctgcaaaacaaataataatgtttaccttgcaggattgttgtgagggatcaatgagtatacataattgatatatggaagtgtcaaacacacgagctcttcaataaacattagtatactttatcactttgccaaagtctacaaacactaattttatatatggcaatatgttgagattgcagatatagacatagaccttaacagacaaaccctaattccaaagagtttgccattcattgatggaaattaattggttcagagatgttgaccatgtctaccttattatttaataacttaattaacttactacaaatctatcgatgttttccatcttggatttttatatcataaaaatgtagaattcttagctcatgactatatgaaaaatagatatttgataatgctttttaatgattataagctaattatattttgaatctcatgcctaactgaaatgtaatgttgcatgctggactttgaatttactaaaaagttcttttgttgtcttcctagaatggagctggtttgtcaaaatccaaaggaagccgaattggatttgatagcacacagtgggtatgtagaataaacaagaaatttctcaattataatgttcatttagttcattcatttactccgtaagtatttgttgaatgatggcaataataatagctaccttgtgtggtgggtggccggttggtagtggcaggtaagggacaggccctttaccaagtgctttatgcaatgtcttatttagtccctatagaaagtttaagaagtgagtaaatattgttactctcaattcacttagagagattaaacttagttggctgataatttggtaagaccagattctgtctgcctctaaaacccacattcactgagctatggtgtttccctaaatgaatgaatatatgaatcagatttatttgaataagggaaaagtaatgatcaggaataaaaatctattcaacctattcctttataagatgaggggaaaccagcaatatatacaatatatccttgttttgttttagaaatttcagaacctacacattgataaaatatattttcctatgttttaaaactaaatttagaaagaaaaacattgctgggttactaataaaacacaacatttattctgttagcatacattatgggaatgaccagatatttcttgatacacttcaatctttggcttctctataactagagatgtggaacactttaaattagaagtggattttcagatcaccaagcagtggtcattttagatcattgctaacaccaagtagattttgaactactgtttaaaagtaaagtctgggatatcctattatcaggctccccagctctctagtctataagtgtcaatgtaaacttttaatttattaaaaatagcaattgttttgctctgtgaatttagggtattctgaggataaaggtaagcatgatatacttggaagttatactacccagtcacagttataaagattttagattaaattaaaaagaggtattttgtatgcttctctgtaacacttctctacctccatcccacccttaggaaacacatacacctaatacttggacctgatttatcatcttgtggttgaagtaatttgctgagatttaaaattcagtattttaacagccaaaggcaacaggggtgatctttcatacattttaacattataagatgtgatgatacttagagaaacatatatttttcagatttgccatttattaggagtcttcatctgtacactgtaaagcaatttcagcaaaaaatttaaagccgtagtagcttcagttggataaaaggttttcctttatcggtattaaccaacaacattctgacaacattcccaaaccttttagtaaatagagagagcagtcagagaaagtacaggttcactgatacattttaaaatggaatttgtgaaaaatttaaagcttaaaataatagaaaaaagtagcgtgactctatccttttcattcaagaaatgatccttgaggtgggagaaaataatggatttttttcaaagtctttacttccacggtacgcaagcaaaaagttgaagagcagcttaccacattcagtgagttctctttatactcttttacattgaggggactaaaaaaaattgtaaatgtggtcactgaatgactatatttgcaaaatcacaggaaaggagaagtactaacatacttctaaacttttagaaggaataaaaggtgaaatctcatcaatagtgtgatattgagccctggtaaaattctagggctcaatgtttatggagttattaaacagatgacttgggagcacttagaaaagaaaatgatcataattaggaactaggcttttactaagaacaagtcctgccaagactttttaggttttaataaaattttaatacacaggcagatgaatgggctattatggtctcagcataatctcttttcaacaagatgtttttcagtcttataaacaaaatgagttactgaaggtcagatgataatagtgatttagaattaattggatttagaatcaactggacacgtttccaaggagcgttaatgattgtattgataacaacttggaggatgtgtttagaaggtgagttatagaatctctgcttgaccctgacctaatctgtatttatattaataatggtaatgaagctataagtgtgttcatcatatttgtatttaacaccaacctgagatccattcaacaaacattaaagtaccttttatgtagtagttctgttatctcatctttcttccaaaaccatttctttcttgtttttttcctagtataaagcacagaaagtaataaccctaaaagacacacacacacacacacacaaaatagctaaattggactattaaaattttaaacttctagtcatcaaaaaacactattaagaaaatgaataagcatgccacagagtagcaaatatttgtaaaacatgtatctcacaaaggaatggtatcaaagatatatgaagaactcccacacgactcagtaatagattttttgttcatgcctttcatcaagttgaggatgtattttattcctggtttgctgaaagttttaaatcatgaatagatactgaattttgtcaaatgcttttttctatattgaaattatcatagtttttcacttttttctgttgatttgtcaaattttattgattgattttcaaatgctaaagtaagctttcattcctaggataaatactacttggtcatgatatttactttccttttttatctttttttagttactggaattgattttctaatattttattaagtatttttgcatctgtgttcatgagggatggtggactatacttttttttgtaaggtctttgtcaggttttgctttttttttttttttttttgagatgaagtctctctgtcgcccaggctggagtgcagccatgtgatctcggctcactgcaacctccaccttgtgatctcggctcactgcaacctccacctcccgggttcaagtgattctcctgcctcagcctcctgagttgctgggactacaggcacacaccaccacgcccggctaatttttgtatttttagtagagacagggtttcaccatgttggccaggctggtcctgaactcctgacctcaggtgatccacctgccttgacctcccacagtgctgggattacaggcgtgagaagttttgctgttgagtatggcactggcctcttaaaatcagataggaagtattttctcctgctccattttctcagaaagtttttgtagaattggtattcttccttaaaaatgatagaattcaccagtgaactgtctaagtctgaagtttttccttgttgttttgagggcagtttttttttttcctaacaaattcagtttctttaataggtatagggcaattcagattttgtttcatcttgtggcagttttgttaaattgtatttttaaagaaatttgtgtcatctaagttgaattttttggtgtaacattgtttatcctaactttttacttagctgtttctcacactgaggtaataaacccctataaggcagagattattgtattcttggcatttgcataatactctacactaaaaacaaataatgagactgattcttagctttatctcatcctttatccttacaattgatattttgtctatttatttatcttgtatatatttttatgagttccttcagattttctgaataagaatttattcttaatttcatgaagcacctttttgataggcaaacattcctataagtcttgctttcattgaagtaggcttttaagcaatagtgtatgccagatattctgtttatccttgctgttcttagatattacttattcctaagtgtgatttagtccattttcattctactgttgaatttttgtttttttcagtaggggaccctacttactacccagcagagttatattttgaaatattgcagtattagaaaagcacattatatatggcagtcatcaagcaggcagtgtattttggtctgagtcttttgcttagaaagattattaagcagcattacagatatgaagaaaaatggtacaaacaactgaattttgtttttgaaagattaacaagactgatttttaaaagctgacggatagttctctcaattttgcttgaaaagatttagctaatactaagagaataattttttaagcaccacattttcatgtcagataccacttcctctgtgaaatttcttatccttttgatgtatggtaaatttgtagcttactggtctgtacttttataatatgttgtatatgtttttcttgtagcatatttcaccttatattgaaaatgttcatctttcttagaagactgcttattgagagcagagaccatatgtgctatttaatcatttgtattttttagcacaatgataagcatggtatctattgggtaactactctgcattcttatacaattaatgaattaaaatgttataaaatagactgttgtgttggcttactggaattacgagaattctttttctctcaaacagcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggtaagtgacttgctttcagataatggaatgtgtctctttttacaaaatagtataggtttaggctagtttaaaatgtaaaacattaaaaatttttcctgaaacactttataaattgtatcaggaatattttcagctataaataacaatacaactaatcactaaggcaaataggggatttctttttcttatataatgagaggttaaaaggttagtggctattgatattagtttagctagccactgatgtcaggacttgtgtctctgaaattctttattcatttacctcattatcacaggatagctgtcgtagctccacatatcacatccatgttcacaacaggaagatgagaggaaagattctgcttttttgctgggggaaacttctcaatatcggtatttttaggtcatttctgttgaactgtttgatatctcatagaaaaagcctacaaggcttatttttacaaagaatattttataatgtccctttatattccccaaatgaagttcatagaaattataaccctcctatatacataattccccaaatcaatataatgtattaactataatataacctagaaataaaaggaaatgatatgtattgctgtgtgcagatgctccagaatgactacactggaagacataataaagtaattcagatgcttgtatttagaagtaggatcacagaatgtggtagctacaaatataaacccatactatgaatgatattgttgttggcaatatgattttccaaaatagtgagcaagtttccaacaacaaaaaaagtaaaattgtctcttcattgacatgactattgtattcctgagaaataaaagctcagacaattataaacaagtttttcactatgtgattatgtgacaggacatttgaaattacatagtacacaggatagattttcatattttggattgtaggatatctaatgttcttggcctaggactctaaatgccagtttgtcattatgataaaccaaaaatatccccccaaatttctgaagtatctgttgggtacagtcccacttgccttgagaaccactattttagaagaaggggagtatgccaccattggcaaaactgatactaccatagtcaagaggaagaagcaaaagctcagccatacccagaatcagcacatgggttcaagtttattcttcgtttgtttttgtttgtttgtgttgggttttttgtttttgtttttgttttttgagacggagtctcgctgtgtcacccaggctggagtgcagtggtgcaatctctgttcactgcaatctccgcctcccaggctcaagggattctcctgcctcagcctcctgagtagctgggattacaggcgtgtgccaccacgtgtgactgatttttgtatttttttttagtagggacggggtttcaccatattggccaggctggtcttgaactcctgacctcaaatgatccacctgcctcagcctcccaaaagtttctccttttgtacatatgacatcctactattcaagagattcaagagcccttggatagtcccccctaaaacatcccccaatgtggagctaatcagattgttagatctaataatgaaagactccatttgcatgtgatttttctttattaatgccattaccataaagtgagcaaacctctgccaaggctactgggagtggacttttctagcaaaaccttgacctaggcctttacaccaattgatcagagcaactattttgttctttacttctcttgttgatggttataagaaagcaaaccatatcataattctgcctattttgtctgtcagtctttcctcctataacccaaggtcacgttcttctcaagttctggccggccttttaaatatttcctgaatttgtcagctgataatgcctttcttttattctattcagtagtgtctttctctgaattggctaccctccccctcagtcagtgctttctacttctaaggtgtaccaagaaagaaaagggaagaagggaatgttacagttgataatgaaacaaatgatgttggaaaatgaaccttgtcttacagtatgtttgttaatttctaatgatttgcattatgatggtgttctattatggtagtattttaagatgttgggatgtaaactatgagatgaaagaactacttttttgaagtacttttgaagataaaggttattaaaagttaaattaagaattacaagtttaattttaagtgctgtccttaaatcaacatttactttatagaaactaactggaaaacactaacatgagcattctcattccaaggaagggatttgtattaattttcatagagttttttttgttttttttttttgagacagggtctcactttgtcacccaggcttgagtgcagtggcacaatcttggctcactgcagccttgatctctcaggttcaagtgatcctcctggctcagacccccaagtagctgggactacaggtacatgccaccacaccttggcaaatttttgtttgtattttttgtagagacaggttgcccaggctggtctcaaactcctgagctcaagtgatccacctgcctcagcctcccaaagcgctgggattacaggggtgagctatggtgcccaacctataaagagagtctttggctatatctttcctgctacatactttgtatttttgctgctttcctttattctcccaccactaccttctgcccatcaccctcattaaaaaatgttcttacagagcagattagcacaaaaatatggctcaagttcaatataagaatcactttagttttgctactagtatttggctttaaatattcaatgtttaagtgttgtttcttgatgtttgatgcttctttggttctaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggtaagttcagagtcaaaacgtgaaatgtgaaatgagtgttgttcagtcataattcttgcagtgtttttacatttgagtattgaaatctaatatataatttatataagtatttacagtaacattattcttaatgactccaaattagaagccacccaaatgtccttcaacaataaaaggattggctgggcactgtggctcatgcatgtaatcccagcactttgggaggccgaggtgggcagatcacctgaggtcaggagttcgagaccagcctggccaacatggtgaaacctcgtctctacaaaaaaatacaaaaattatccatgcattgtggtgggtgcctgtaatcccagctactggggaggctgaggaaggagaattgcttgagccctggaggtggaggttgtagtgagccgagattgtgataccacactctaggctgggcaacagagcaggactttgtctcaaaaaaaaaaaaaaaactgtaaaggaataaataatttttgatatatgtgttcatacaatgaagtattacacagcagggaaaaataaactaggggtctgtgcacattgtggatgaatcctacaatgctgaatgacacaaggcacaaaagaatctaaattctattattattattatttttttccattcaaaagtttcttttattcattaataaacaatgatatatatgtatacacagcttcataatcataccaaaaaagtttaagtgaactatcctttaaaggctgagaccataactttttgaacagaaataatatggattataagacagtatattgatttttgctgtctttattttaatataaagaacaaattgtgtggtaagactaatttattttcccactttgaaattaaacctctctagaaacatttagataaattatgaactaatctttaaaataccgtattacttcagcatttcaaaatcagtaagtttggaaactgtatttaagttaatattaggaataatataaccactgttgataactaacaatatagccaaaagaaaatgtggtacatacacacaatggagtactattcagccataaaaaagaatgagatcctgtcatttgcaacaacatggatagaactggagatcattatattaagtgaaataagccaggcacagaaagacaaactttccatgttctcacttatttgtgggagtgaaaaatgaaaataactgaactcatggagatagagagtagaatgatggttatcagaggctaggaagcatagtgggagaaagaggggaagagggggatggttaatgggtacaaaaaaatagttagaaataatgaataagactgagtatttgctaggacaacaaggtgactatagtaaaaaataattgtacattttaaaataactaaaagtatacttggattgtttaatacaaaggataaatgcttgaggtgatagataccccatttactctgatgtgattattatgcattgcatgcttgtatcaaaatattgcatgtaacccataagtatacacacctactatgtacctacaaaaattgaaaatacaaaagtgaaagtaaattctattattacttttataaaaagttcaaacacatgctaaattatgttcatggatgtatacccttatagtaaaagtattaagaaggctaagcaagacgtaccaaaaaagactagatagaggacacagagaactacagggaaactggaagaattttatttctgtggtggagactttggtgtttactttataattcattattttgtgcctttatgttatgcactttcctatatattttttaaaaccatgtgcaaaaatttatctttggctatctcaataataaaaatatttcttgtgagaaacagttatttgaaggaactcatgtaaaatttgattagctatagtttataatattaacaattacaggattaaaaacattcttgaagttatacttggagtatgaagtttctaacctagaattgttccttttattctccttttgaaatcagcgataatgatgttacagtctactttgaatagcagaatctgatgtaaaggtagcagtaaatatttgtaaggattttcacattaaaaactccttcttagtaacttccagtgagataattcttatctgttacacttgagaagtgtaagagtatgtttattcttgccttcttttaaaaatatatatatatattatatatatatgttttctctctctctatctggaatcatgtgagattgccttcttattagtacttaaagtcacatatttgagaatgactgaaaaaggtattcgaaactgaagtcttctatattttttgtgtatgaaaagtcggaacttttctgaaccaagccatattttcaaaatgaccaaaaaaaatgagtagagatggagaacaatactttgtttttattattggcttctcttattttaatcaaaaatcttaatactcactgttctcttaccacttttttgcctgtttttttcttattctgtatttcaaatgaccttctttagggagacattatcttttagttttttaaagctttgtgaatttatttcaaaatttaataacttagtaaagttcaaaattgtcagttacttattaaacataaacatgtgacaatagataaaagctatctctacattgtaaaattttatatgagtaggaatggaaaactctcaaataatatttttagagtatgggatccaaaatacataagatagatttgcagattagcattttacccattaatgagattctcaggccattgtaattaacttgtgtgtcttaagtgttaaaaacatttacttctctaaaagtaaactgataattaaaaattatgtcacaaaatttttgtttctgcttaaaatgccaagtgtgtatgaacaagtacaaatatattaatatataaatacattaaccaaaataattaaaactcaactgtttgatgtcagatttttcaaggtcttattaaaattgctaattgatatctgacataattgatgaaactatgcttgatgtttaggtattttgctaatgtttgatatttgtaagaggctgccagtattctgggttaaatccttttaataaatcttttattattattattattatttttaaattttactttaagtagtgggacacatgtactgaacgtgcaggtttgttacataggtatacatgtgccatggtagtttgctgcacctatcaacctgttatctaggttttaagctctgcacgcattaggtatttgtcctaatgttctccctccctgtttcccccacccctcattaataaatcttaacttttgttttcaggccagagttacagcaagttactgttgatggactggaagttctcattccaaaggatccaatgcactttgtagaagaagtaccacactctaggtttattgagtgtaggtataaagaagctcgagcattctttcaggttagagacaaccaaatgtgtacttttaaattaaagaaaatgttgggattatttttaatatttgagggtggtaagatgaaggggcttatggaaaatagaaaagtaaacatccttttttgatatgtctcttttcttctagattgttttctttcagttttttttagaagtagattaaaaattaaccttaagaaactattttctaagtcaataggttgatatttatttattgttttatttgaataactttaatagatttagcactggcttctgccttaagatagcccattaactttgtgaaaggtggtgtattctcagtccaagtaggataaagccactatagaagatggaccatgtagatttagaaaagacttcatgaaaatacagtttgtttcagagttggcattgaatataattttttttgcatttatgaaggtttttgaagataaatgctacacaaagaccaggtgcttttaaaactttattctcttgctgcagctttcaattcaatacacatttattgtgttccgcaggcttctggccctggggatataaagatgattttgaaaggcatgaaagttcagctctaagagatgacatgaaacacagagatacagtgaaaacaggcaaatttacagtggggttttggtacctgaattctttcacttgccctttattttctggggttccctgccaagaaagctgtgtccacgagggatacgaaaatgaagtatataactgtcaagtgcccaagacccacaaatctgaggtttctctaatacagtgtactggcacctaaagctgaggcctgacagcccaagtgggccttcgtagccctatttccttaagtcattgtggagctgtgaaatttatgcagccagcctcatgaataaaaagctgaaaaaccacatgtgtggatgggcctactctagtagaaaagtgctgcctgacatatgcctaccacataataacaggaagtagaagagatggagttttgtgcttaaacttgaccgctcttcctgtcctaagggagtttgctgtggttgtcatctctattatagcaattatcacagtgaattatgaatatctgtcttgtcctcttatcaaattttatgaacttcttgataacaggagtgttcttttatttacctgtgttggcccagtatctactgtacctggcataaagaaaagatccagtagggtcagttttcaaattaaagtgaacatacatgtatttgaacacttgatggcgccaaacagtcttaaatgtaatgcttggtgtaaagcaataaattaatctaatagacctcatcaagcagccgcctttctttttttaaaataatttttaaaaagcaattttaaatacataaaagctgcaagtacagtaccgataacttttttttttctgaaccacttgggagtaagatgttgaccacaacttcaaaaaatttagtatttttttaaaaataggaacattctctacatgtcctaatatgaaagttaggaaattagcacatacatttttaccatttaatccctattcaatttttgtcagttgtcccaataataacctttgtaataaaaagattcgattcagaatcacatgttgtcttaattttcctgtctctttagtcttcttcagtctgggacagtttctcagttcttttattactttcatgactaatactttggaagattacaagccagatgttttgtgcagtgtccctcatttggggtttgtccgggggttcctcatgttagatttaggttatacttctttagaaggtatagaagtggtgctgtgttctcattacatctcactgggcactgcataattttgatttatcccattactgttgatattcacattgttcacctgattaaagtgctgtctgaaacttcgtatctttaccactatgaagtttctgtttttccctttataataataagcatctggcaagaagttactttaaaactatgtaaatattgttttcctcattacattttcaatttatttgttcatatcaatataaataaattcatggtttcctattttaccctatgggttatagtcaattattttcattatttattttgatcttcagattgttccatatttggccagtagaaactccttcataatgctttctgtgtccttttgacttgtctccgttgttttttgaacactttagtactttttggcactataaaatattctgggttcatcttacaattttcatacctccaccctgggatcagccatttctttaagtcctgtttccttttagaagccaagacctggatgccaggtgtacccattgctatttgggttttgctgcagagagtttctctcagtgaacaggggtagggtgtatatgtctgtgtgtatttatttctgtatctatctattgaaacctctgaattcacattgacatctccagtccggttaaaagttccaattaaacaacagagttcatttccatatttgcgactcccttttcaaatcgtgagaaatctgactcccattgaccttaatgtttacttagttgttcagtctccctgtatgtaacctatcttccaacacatgtcctcccctccctaccccctgttcttctcaccctacctgggcactgctatcctctgctgggctgcacacacgtagaggcattcttcttaccctgttcaggctctgacttcccacacctggctgctgttctgcagagaggctttcctcaccctgcttgggctctgactccccacactggacactctcctactctcttcatgtggatgtcctcattacctgcctaggctctgataccccatatcaggcaatccctttgcacaaaaacctttcttgctctgccccatctaatggttttagtatcgaatagttcaggaagggcgggagactttatttacttttaattattttctcaatctaccatgaagttcaaaaactagaataatataccttttcctgaatttgattttgttttagcaaaaaccatcacaagataattaatgagctccaggctgttgaatatcagtgaaaaaccaaaaggaaagttggaaatacctgtacacctggcctaggaatatctagataacaatatttttattttatttctactaatttgctctaagattttgggcaaatttctgagccttggtttcctcatctacaataagagttggtaccttctgtcatcttattctttgatataaggtttgtgcttttggattccacgattcttcttgggctttgtgtccccgttcattggctgaacaggaaaaattaaataaacatgatatttaaagtaggatattaattttgtctttttttagaggtatagtaatcctgagatttgtacttgggatttatttttatttgtttacttatttattttatttttaacttgtaagttcaggggtacaagtgcaagtttgttacataggtaaacttgtgttgtgggggtttgttgtacagattatttcaccacccaagtattaagcctagtacctattagttatttttcctggtcctctttctcctcccaccctccaaaagaacccattgtgtgttgttcccctctatgcgtccatgtgttctcatcatttagctcccacttataaaaacatgaagtattaggttttctgttcctgtgttagtttgctaaagataatggccttcagctccatccatgtccctgcaaagaacatgatcttgttcttttttatggctgcatagtattccatggtgtatatatactacattttatttatccagtctatcattgatgagcatttagattgattccatgcctttgctattgtgaatagtgctgcagggaacacacacatgtatgtgtctttataagagaatgaatgatttatattcctttcagtatatacctgataatggaattgctgggtcaaacagtatttctgtctttaggtcattgaggaatcaccacactgtcttccacaatggttgaactaatttacactcccaccaaccgtgtataagtgttcctttttctccacaacctcaccaatatctggggtttattttattttattttattttattttattagtttttttttacttgttatagtagccactctgactggtattagatagtatcgtattgttttttattgcattttctaatgatcagtgatgttgaacttttttcatatgattgttggccacatgtatgtcttttgaaaagtgtctgttcgtgtccttcacccactttttaatggggttgtttggttttttccttgaaaatttgtttaagttcctgatagatgctggatattagacctaatagttaaggtttgcaaaccatagtttgcaaaaatgctctcccattccataggttatatgtttactctgttgatagtttcttttgctgtgcagaagctctttattttaattagatcctatttgtcagtttttgcttttgttgcaatttcttttggcatcttcatgaaatttttgcctgtgcctgtgtcctaaatggtattgcctgggttatcttccagggttttatagttttgggttttacatttaagtctttaatctatcttgtacaggatatttttaaatgaaaaaagtatgtatactataatttttaaaatttatagcagatgtttaaggtatatagctctatgcatgtatgcactttaacacatacaaggatcagttctgagaaatggaatttctggctgggcgccatggctcacgcctgtaatcctagcactttgggaggccaaggcgggtggattgcctgagctcaggagtttgagaccagcctgggcaacatggcgaaaccccggctctacaaaacacacaaaaattagctggacatggtggtgtgcacttgtaatcccagctacttggaaggctgaggtagaagaatcacttgaacccaggaggtggaggttgcagtgagccaagatcatgcccctaaattccagcctgggcaacagagagaggagactttgtctccaaaaaaaaaaagaaatggaatttctgagagtgtcatgttaagaaaagtagattggggtgggaatatgtccatatgggagcagtaccagcagcaggtaactatcagacctgatgtttttgtagagcacaaatttttcatatttgctgtttagtcctttcagtcactctgtgtaataaggcaaggattcttttaacaggtaagaaaattgatgtttcaagatgtcagttacatggtcatcattggttgagcatggactaaatcctaggtctccacctcttaactccaggcttttcctactacaacaagcattataacatgtatctctcattccagtcatttattgtaagagcacttatggctttgaggaaagggatgtattcaaattgaagggatcctgtgtaatttgtatattctgtagacagtgacttatctgcaagaaattcttcttactgaaggtagggtactttttgcttaagattcatatagtccatccaggatctatattctttcctactatattgtaaaagaattacaggatattttaggatgttgcaggcctgggaggggcttagtcaatcatttattcatttgcccattcatcagtatgtgtttttcagatattatgtgccaggcaccattctaaacctgtagatacagtgatgaagagatgtagtacttgccctcagggaactatctttacagtctagtggagggaatataaaattgatgattaggaataaatatgatatgaattatagtaaaagtatttacaagtggtaactattataagcttgttaaggaaaaagataattcatttgtctttgtatatctagaaccaaacataattctttgctctataaatgttgaatagaaacacttcctgaataggaacattggaagaataaatacatatgtcttcctgggaaaactggggaatgttttgcagaggttggagctgagacttgaaagattttattgatcagggccatatcagacaaaggaaacaagtgcggaggcttgaaaagttgtggtgtatttgaggagttacaagttattgtggtatatttgggggtttacaagttataagatgaagtgtgaggagatgcagatgaggctggaccccagtagtcaggaaccagaacacagtgtttatgtccaccaggacaagaagtttagattttgtcccacaggtagcgaagcaacactatagaatttatagtgctttcctcagctccagaacactctaaaaacgaagagaatcagaaaaccaagatgactaaatgatatatatgacctgacaatttgcaagacatttttctccttcaatcttcacagcagtcctgtgaagtataataattatctttaaactacaaatgagaaaagtagatacaagagagatttgtttattacattctttcattcattcagcaaatactcaggcactactctacccactggagatataatgataaaatgaatgcactttcctcatagaaagtgaggatgatatgtacatggtcaaagctaaaaagaagtgcactagatttgataatctgattcaaaatctcaggctttttctactatactacacagtctctaaagaccaatagaatcactgaatggtgaaaacattattaaattctttttgtttcagctatgtttgtagctctcataattagctttattttatcctgattgtccagctactaaattgtgatgtaaaggagggagctgataaaaggatgtctcatcctttgggaatcctggttctattctttcccttttaatttatctctccaagaatctgctcttaagtgttcattttaatgtgggacaaacaagtaactgtaaaatgtggtttttataatataaaaagattatatggggttagttttcttttttttctcctttctttctttttttttttttcttttttgagacagtctcattctgtcgcccaggctggagtatagtggtgtgatctttgcttactgcaacctccacctcccgggttcaagtgattctcttgcctcaacctctcgagtagctggaactataggcgcgggccaccactctcagctaatttttatgtttttagtagagatggggttttgccatgtgggccaggccagttttgaactcctgaccccaagtgatccacctgccttggcttcccaaagttctggggttacaggcgtgagccactgtgcccagcctggggttaattttcaaatttaattcagatgccacagaaaggttcctagcaatttagaaatggctgtaatagctgactatttattatatctgtagcagtaccttgatgataacactgtggaagctgtggcctttcggaagagtgcaaaggaattactgcaactagcagcgaaaacattaaacaaattgggagtaccattctggctgagcagtggaacttgtctaggtaaaattcttacgactttccatttgtctttctgtcattttgtcctctggctttagggattactgcttgagatgacaaaatatcagtgacatttgaagtgtcatgtgtatagacagaataaacatgagtgcatgcagcaaggatctattgatttccttaaagaaattaatttgagaattataaaaaagaatgttagaaaggccatggttgtgtttactcataattataaataatatgtataaaatgtatatcagaacatgtagactatacaatagtccccccttatccatggacaatacattccaagaccaccagtggatgcctgaaatctccgatagtactgaaccctatatacgctgctctttccctatacatacatatgatgtttaatttataaattaggcacagtaagagatgaacaacaataaataataaaatggaacaattttaacaatactataataaaagttgtgtgtgatctctgtctctcagagtatcttattttactgtactcactgttattcttcttacgatggtgtgagatgataaaatgcctacatgatgagatgaagggagatgaaggatgtaggcattgtgatgtagtgttagtctactattgaaaatttcctgggaaaatcaaggaatgtgtcacagaggctaaatctgagccctgaaagatttgatttaacacttctgaattgtttatttctggaatttaccatttaatatcttcagatcgtggttgtccacaggtaactgaaactgctaaaagcaaaaccacggatatggcaggactactatagttgattctcagataatccttaaattagcattttattatttctatcccaaagattgttattgcctttttttataattataaaaaaccctctatttctttacttatataccattcaaacagcttgcattgcaccaaatgtttctactgagaggaacattaaagacagtgtcataaggtcttccatcagcctttcctaggtcattggtagtatcactaactagacatcactgttcatctgacatggacatacagacttttctacagtccttaagcaggttgctattagaatctgtgagtgatttctgggtctctgtccactgtccattaaatcaaacttctttggaatttagaattatttagaatcttaaattttgttttgtgtttatttgttgtctcttgattatcatgatagttaattatagctgtatttgctttttctttatagtaaccatatctgtacaaaagttaattcaactcctgcctttatagggatagggttgccatccaatttattgttcaattcaagagacttgagagtgaaaggaagcaccattaataattatgttggtacaacaggcataaactgggatatacggttatcctatctattagcctttgttgaaaatttacatggttcttcctgccaaggagcttactactagaataagccaaaaaaaaaaaaaaagtacatctcacacatttatgtgatatttgctttaaggtttaattttttagaaacaagattgttttataatgtgtgtcatcaaagacacttcatagtcatttgacatgatttgttttgagttttcagtcccatggttttctgtctgatttaagggcacttatgagggagttgtattagatgatatttaagaaaacttttatttttaattgtttataattctttaatagaattattttagaattccaaacaatattatccaacagcaatgcctataaggataatcgcagtcatttatttacttttgaaataattggaatgaaatgattagaaagatcataggggagacccaggagtccttaataatattaaggtacatgttttatttcttcagaacagtgctatagcaatgaattagagcacatacgtggtaaacacttagaaatatcatttggcagtgtgttgaacattgaagctgctactgcttttctttttcatacggcccatcaggtggtcactgttgagagctgttaggttctacaaattattgctcaagaaaaatatattggttaagcaaaagaattaaatattttttgcatatcttaacagccccctctatcactagagattaatgattaaacattcttatcagcaacttagtgttattaaagctaatggtttattcagaaactaaaatatatcatgaaagtttttgaggaagctgagagtgctcagacagtaaaaatagatacatagatagatagaaggttcaggtgactgctcaaacaaagtcatttagtttgaggtttaatttttaaaaataattttggtgaagcatcttaagtctaatcctgtgaaataaaatccattctatagccccagccactcaagaggccaaggcaggaggatcacttgagccaggagtttgcgtacagcctgggcaatatagtgagactctgtctctttaaaaaaaaagaaaaaaaatccttgttacaaatataatttgttataataactaattttttccaaacctaaattttgttaaaaaaatttaatcttctttttaggatggtatcgacaatgcaacattattccttatagcaaagatgttgacctaggaatttttatacaagattacaaatctgatattattttagcatttcaggatgcaggacttccgctcaaacacaaatttgggaaggtcagtaacaaaagtcggcttcatttcataagtaacatatctcacttgtaaagtttacattaagcaactcagatatggttaagaatgctacatacataattttatcactcagtattgactaggatgagttcagcagaagcctgttaccacttgtaatttctgcactgtctaggcaaaagcaagaaaatctggctttctactgggttggtgcaaaagtaattgtggtttttgccattacttttgcaccaataatgataagaaaagaaggatcttgaactcttataggtgaatgtattgctattatattaggcaacaatgtaatataaaatcaatataatgtataatatacaattaataagtaagaatcccacccgccgtacctgattgtttctcatgagtcatttaatttacagatgtcattatcaacataaaatattccattgattgctaagggatagaaatatagaatcatttcaaataagtacttcaatttcttgtttatcttatatgtcctaggctatagcagtttgctcagacatcaactagggataggtcattggggcctagatgaaatctccctctagacaatttgattcctatgccctaagcccatgatctcttgcaatcatcttgttcttaatttgcttgtcccctcggaggtgttaccctacaagcaagtaaaaatatgtttagtcggctgggcgcggtggctcacgcctgtaatcccagcactatgggaggccgaggcgggtggatcatgaggtcaggagatcgagaccacagtgaaaccccatctctactaaaaatacaaaaaaaattagccgggcgcggtggcgggcgcctgtagtcccagctactggggaggctgaggcaggagaatggcgtgaacctgggaggcggagcttgcagtgagctgagatcgcgccactgcactccagcctgggcgacagagcaagactccgtcttaaaaaaaaaaaaaaaaagtttagtcaccagaaaattattttttccatcataaatagttattttatgttactaaaaaatataaataaaatattttactgaggtcaaagtcaaataacagagctctagttattcagcaaacatttaccaaacattcactataagtatggcactgtcctctgcacctgggagacaaagatgaataaatgatagttcttacccttgagaagctcactgtctaattgggagggggaaaggctgcataaataattctgtgatgagtgctgtggcggacagatgtaccaagtccaatgggaacgtaattatttgtatgataagttttctttagggaaatgttctcagaattatttatttttttaccttaacttttatttttttcttttttccatgtgtgtagtataatgagctagactatttatgtatgtggctatgaggaatgccactttacttaagtacttattgattgttatgagagacttatttcctgatagttttatttggattattaaaggaaataatatttctttggttcttttccttttttagtcagaaagctgctctggaataggatatttctattttttttctgcagtgataattaccataagtcatttactctgagttatcatcaattgtaagaaacattattttagatgcagttaagaaattaaatgatatgttactgatgcatcccaatttcagaggtgccttaacttgaaaaaatgtgcatcttagaatgaatactctatgtatgtaaaacttaagaatctgtttctttatttttattttttaaaaaaaggtttttaaaaatgtatttcctttgtttcagtgtgtgaaggttttcatcttccccataggtagaagacagcttggaactatccttccagggaaaagatgatgtaaaacttgatgtttttttcttctatgaagaaactgatcacatgtggaatggaggcactcaggccaaaacaggaaaaaaattcaagtatgaatcaaataagtacttatttataaaggtactacagaaataatttcaggaggtagaaataaagaagtaactgaaaagaaaaccaaaaatctctttcaagactccattattagctaacactttcttagcttacccatagagtccagttatgcctgtgaagtaagaatacctgtaaggacggtttgtgaggaggaagtgtccctgggtttgtcagtccaagttgatgatacagctggtctattctcagttctgagagagagaatgagaatgagaacctgaagagcatgggttttagagtcaggctgacctgggaaaccttagctccaccctaatttgtggcctttagattttctgaacgtaatcattttatccattacattgagtaatactactgtgtgtcaggcactattctgaacgttttacatatattaacccatctagtcctcaaaataaccttcagaggtagatattctgaagccagtgtgattgctgttgaatctcagctctttattttaccagctatattaccttgagcaagttatttaacctctctgcctaagtttcctcagctgtaaaatggaaattatagtagaaattgccacatagagtggttttaaggattaaaagaattaatacacaaaaagagctttgaggtgtgtcaggaggtcctgggtgctaagtaattattacctgctgttactaatactactatagtagtagtagtagtagtagtagtagtagtagtagtagtagtagtaaagaaaactatttctcttcttattctcatgagaaatttacagattagagacatgtataattatctcaatattaaactgttacatctattcttagagaacttctgtaagagtgtcaccttttttctaagaaagataatttctagagccagtattagagtcctgttattcttaaattactttctaaggcttgaattttttctctcactgacatgatccgaaacctgcaaacctcaaaagaactgttcatttccaactactacatttctggagagaaaaagcttctttcattctgctttaacagctctttatagtagcagtgtttgggaagtgtgaagtgttctgattatttaacaagagaaatgagcagtgatagaactgtctggacagatggtgtgagtcccagattttctatcatgttactgtgaccttaaaaggcagagaaaagaacaggagatggctgagtagagtagtttctttggaagattcccccagccatatgccatttttattcttttcggcactatttactttaagaaaatgtagtatttttaacactactattccttggggatgaagaaaaacaaaatgtttaaagctagttcaagggtctttttaatgtattttaaatttttgaatagattatacattacatagttaaaatattcaaagaatataaaggatgtgtatgaaaagtaaacctttctccatcctctgcccctcattttcccgtttctagttgccctttacagagataaccatgattactcatttcttatgtatcctttccgagacaaacatatgctcgtatacatatagtatttacgttcatctctccccctttacacaaatagtattatggcatattacacactgtctgtatgttcttttcctcacatagctatgtatcttggaaaatgttccaaatgagtatgtatagaaatagctgcattttattccattgtatggcaataccataatttattcaaccaattccctattgatgaatatttaggctgtttccagtagtttactgtgaccctcagttctgcagtcactatctctgtccatatgtctttatgcacacgtgtgaaaccctgtgcaggataaagtattagactcaaattttggggctaaagggaatataagcatatttcaattttgatagatattgccaaattgccctccaaagatgtttccccaatttatattctcaaccacatggtttgagaatatgggtttattttttaaaagtgcactatctgtaaagagaggtaaacttgctcaatatttgccactaatcagtaacttatcaattacttgtaatcagtaactaaatctaccatacaccaaatataattgggagcacattagaattactgttcaaactagtcagtataatgtatcatctcaccttctccaaaggtctttttgtctttataataacctattttttattttatatatagttcattctgagaaaagcttaataatatagaatgcttactattttttaaaaggcagaagaggaactcaagaaggaagaaaaaagattttctttctaaactactctgcaggactatagaatgatatctttggtcctaagatttaacagtatattaagagtaataaaaaagataaagcttccaggatatctgctacctatcaggcactgtgataggtagttcatatatatatttatatatataatctggttaatcctcatactatccctgtgggttcggtattctcacctccagttagacattaggaaactaaagctcagagtgaagtaacttactcgaggcttttgactgttaatggcaagatcaagatttaatgccagacctgtttgacccctaagcctaaatgctttcttcttagagttaataggttaagtgagttagtacatctaatgcatttagaacagtacctggcacattgtaagtattgtgtaagtagtagctactgtcagtactgtattattattattactgttactgttattataattaccatgctgcactggcataaggtatggtactttcagcacagtggtaaattggattagtaattttctaggcaggcatattttcttcctccatctcatgatactcattccgtctttagttctcagtctttcacttctttataggaagcccttcttttacctgaaatccaaattccatttaaaaatattgactggattctttattctgtttttctccagcatccaaatctgccagtaataaaagtgatgaatataataactatgcctccagaatgtgaagttcttaattcaacttcacatttcctaaagatgctgcctagatttatttggtttgcttctttccttcccattttgaatcaactggtatgggtagaagccagaagtttgaaaggtaataataatagttaactttattgaatacttactataagccaatcaatatgccaagcttttatatgtgttatcttatttaatcctcacaataagtttataaaggagattttatcatcatcacctttattttatggatgagcaaattaaggcagacctgagtcagacctaggtgtgtatcacttcagagcccatgttcttactaagttagtgtcaccatgatctctatcatgttgttaataccccttccatgaaaacattatcagggtaatacaactactgctacatcctctaataggaaatctactccttgggctagtagtgggttccttataccttctgacagttgcagcttctgattattggatagatcttcagaaaattcagattcatcctctgtggaccacactcccatccaggtgtggatcctgtgtaatttatcacttcatttctgtaaaatgtatttaccaactgctatgtgctaaggatactgatgtgactgtaacttagtttctgctcttaaggatctcatgatctagaccatgagacatgttaaagtactctgatagcagtactgtaatcaaatatgtataatctatagttgaagtaccaaatcagccatatctagaaacaatggcaaagaagtgtggcttacaagtagagaaatttgttaggtagacttaggagaaatgtgggaaaagtcctaaaaatagatttatttaatgatttttaaattagtttatttctattttttaatttaaaaaattctgtgggcatctgtatacgtaaagtaaaaactttaaggggttgtttccttcaatagatacccaaaggtagaattattaagtcaaaagatatgagccttttaaagagttttgatacatattgccaggttgcattcctaaaaagttatgcaaaattttatacagtcaccaacataaatgagcatgcttagtttgctatatcatactgagtgttgcattgtactcacagtcattcatgactcccctgatagtttctttgagtaacttttcttttcactttcttcttattatcccaaggtatcttctatcataaaaccaggtcagtcattagtagcaagttaccaacaattattacctttctggccaggcacagtggctcatgcctttaatcccagcacttcgggaggccaaggtgagagaactgcttgagcacgggagtttgagaccagcttgggcaacagaataaaccctggctttatataaaaattttttaaaaattacccaggcatggtggcatgtgtctgtggtcccaactacatgggaggctgagacggtaggatcacctgagcccaggaaatctaggctgcagtgagccacatttgcaccactgtactccagcctaggtgacagagcaaaaccaaaaaaaaaaaaaaaaaagaaaaagaatcattacttttctcttaactattcctaacatcaactggcttttagtatacatctaaccccctccctgtcgtcccagtctccctttcaaaatccagctttaaaatattacagtgcattttgaatgtcttgttataggtgtttgttagacacttattatatagagacttttatatttaagctttatacaagtgtgattttagctgagtgagcccaggaattagaagacctgaattcaaatctgagttctatttttttgtgtcatataaccttctgagcttcagatttctcctcttaaaatgggaataacactgcgtacttcacagggtataatgcttcgattaaatactgtgtagttacctgattcagtgcttggcacgtaatagattcacaactgtttgctaattctaaattaggcaggcagagcatagaagtctgattaggaagattcattgctaggtagcaattagaaaaaaaatcacatggtagtgaattaaagcctaccaaatgttacagagatgaatataaacttgtattacatataactgcagagagatatagtttataggaaaaaaacgtgtaaagagtactgattctttggaagttttctctgaaagtgagggttgagtcagcacaatttgaatgaatattgttgaatggggaattgctattaagttagatttggttgcctctaggaaaagagacttagggccatgtaaagatgatatttggcaatgctggtaaactggttaattgccagaaagtcttgttgtttggtggggtttttgactggatgtaataaagaatctctctcataaggcttttggtggagaatgtagtaagacacaagtcctgttgaggaatattgttcttgctagtgtgtgtaggcatggaaagctggtatagtgaggaagacttgggtggttgaggacctatgctaaacaggaggtgaccggaagaaatggtaaaagaacttagcaccatgcctggctgtgaacaaggggagtccaagaaaactaagtgtccaaaataacatataagtttataatcttagagctagagaaaaattaggaaatagtggattattatgtttttaattgaagtgtaacatacatacagaaaactatacaaagcaaatgtatggctccaagaattatcaaatgaacaaatgtgtaaccagcaccccagtaaaaaaaaaaaagtatttgtcagcaccccagaaacccatatcattttccctcacgatcatagctcctgtttcccacaaggtaacagcgatgctaacttctggtattacagtttagttttacctgtttttttattttatataaactagatggtatgttgctggcttcttttcattcaacattgtatttgtgagaaccatccatatttttacatgttgtggctcttcattttctttgctgtgtagtagttaattgtatgaatatatcacaaatatttattaagtccactaacccaaatagtagttggatatttgggttgttttcaatttggggctattataggtgatgctgtagtgaacatttctgtacgtgtcttttagtgccctggtacatgcttatcttagtttgctcaggctgctataacaaaataccataaactgggtggctcataaacagaaatttatttctcaggtttctggatgatgggaagtccaagataaaggtaccagcatggtcaggttctggtgaaggccctcctcctggttgtagactgctgatttctcctcacatggtgaaaggagcaatcaagctcccttaggccttttttataaagtttccattcctgagtgtttcaccctcatgacctaatcacctcccaaaggtcttacctcttaataccgtcaccttggaggttaggatttcagcatatgaattttgaggagacataaacattcaaaccacagcaatgtttttctattgggtttacacataaagtttgggattgcttggtcgtagggtattcttgtgttcaatttcagcatattgtttacaaatagttttccaaagttattccaagttatattccagtatgttatagaactttccattgccccacatttttaccaacgcttggcattgtcagacttcttaatttgtaaccattttggtaggtgtgtagtgttaccaaattgtagtttagatttctttttccttgacttaatgaaggcaagttcatgtttactgaccatttggatatcctcttttgtgagttactggctgagtatcttgtcagggtttttttctgagttgtctgtctttttcttacttgaaaatatcttctcccaatttgtgcctttcttctttattcttttttttttttttttgagacagagttgtcacccaggctggagtgcagtggtgtgatcttggctcactgcaacctccacctcccaggttcaagcagttctcatgcctcagcctcctaagtagctggaattacaggcacattccatcatacccagctatttttgtatttttagtagagatggggtttcaccatgttgcccaggctagtctcaaacccctgacctcaagtaatctgccctcctcggcctcctaaagtgattggaatacaggcatgagctgccatgccagcccttctttactctcttaatagtgatttttggtgaataaaaagttattttaatgtagttcagtttatctattatgggtagtattatcgtgtcctgtttaagaaatctttccctatcccaagataatgaagctattcctcttgtactaccttctagaaactttattgttctatatgtaatatgaagtaaagatcaaatttagactctatactttatttggattcactagcttttctaccaatgtgctttttctgttctaagatctaatccaggataccacattgcatttagacactctaccttttgaaactttattttggtccaagattttaagcttgtcactagtaatactagattatcatacatcactgcatgtcccacttctgctcattcaagggccttacgttgctgtctgtttgaactagcttcttggtaccttgatctggaaataatcttctcttcctctgcatttctatagattttctttttctttccctctctcatgctttattggagtacttttgctgatttgtctgtcctttctatgtgatagataaaatcaggcctggtacatgtttggctaagtgagacctgagccctacatgaaactaagtcagatcctcttaagtgtagtctacactgttttgttaagatgataaggtgacactgggttgatgacttgatccaacctaacgtggttggagaattaaaactatagaattaagttagcctagttgttttcaatcattctgcttcacaagaagttaaaagactagaggtatttgttgaatcctcactcattgtctctctcagcttcacagattgatactgtgctcctacagttgtaactccaagaaacacatttgtctttttagtacttacagctgtgaagctaaaggcaaatttgaataatttctttaaatgagtgtatttaaaacattgacttttctatgaatgatctcgtattttctgctctgtttatgcgtttatattttacaacatacagattatgtcttaggtctccttaattatacctccaaaccgctagtaagtagcaggtgcaaaattgaggaattgagggaagaactttgaatgcatgttatatgggaattgtatacttatacaatatgtagaagtagcagttatttatatagcaagctttgtttatttttttaagagaagattgcctccagatgaataagcagtaaatctttcatttatgtgaagtaagttatgttttttaaaactgtcgaatagtttgttgtttgaacataattctataagatattatataggatagtattctaagagaaataaaagcatattttcagtaaaagacttgtacacagatgtttatagcagtcttactcatactagcaagaaatggaagcaacccaaatgcccatcttctggtgactagttataaaattatgatatattcaaacaatggactaccactgaacaatgaatagcaatgaactactgataaatgcaataacatggatgaatttctaaaacatgatgctaagtgaaagaagtcagataggaagagtatatactgtgtacttgctgttatttgaaattgcacaggaaaaaccaaccaacagtgtaataagattagtggttgcctaggaccagggtgggttgattgcttgactgacaaggggcacagggaactttggacgaggggttggtagaaatgttctatatcttgattattgtggttacacaggtatatacatttatcaaaactcatcacttaagatagatgcatttcattatacttaacttatacctcaaaagaagttaccttaaaagtttaagactgggcacagtaacccatcagcatttggggaagacccggtgagaggatcacttgagcccaggagttcaagataagcctgggcaacatagggagaccccatgtctacaaaaaaataaaaactaaacttaaaaaaggttaaaaagataaaaaacagtttgtgacttagaaaactgatgctaagagaaaaagggtctgagatcacaggttgaaacagagggatatatgggaccaaaagcaatgaatttggtcagggcagacctaattgcaatgataaactttgagactttcacatatgattaaacaaattgtgtaatctgatagtaaagccttttgtattgagtatgaaaattgaaactataatttaattcttttaaaaattatccattatatacaaggagaaatcctgtaaaagtctgaaggaaagcaagcacaactggagtctaactggttgttgaagtgctattagatctagttctgggaagttatgtggttatgtagagctatagagtttttggaagttatgtagttatgtcccaaggctttgtcctctggcattgaggaaaactttagtacttgttttaaattgatagtttttaatgtagtcattatgtatatgtatatatacatgctgctctaaagacacatgcacacatatgtttattgtggcactattcacaatagcaaagacttggaaccaacccaaatgtccatcaatgatagaatggattaagaaaatgtggcacatatacaccatggaatactatgcagccataaaaaaggacaagttcatgtcctttgtagggacatggatgaagctggaaaccatcattctcagcaaactatcgcaaggacagaaaaccaaacactgcatgttctcacttataggtgggaattgaacaatgagaacacttggacacagggtggggaacatcacacaatcacacactggggcctgtcgtggggtagggggagaggggagggatagcattaggagatatacctaatgtaaaggacgagttaatgggtgcagcacaccaacatggcacatgtatacatatgtaacaaactggcacgttgtgcacatgtaccctagaacttcaagtataattaaaaaaaagaaaaaagaaaaatctgggatggctggctttagtttatactcagctgtgttacattaactctctcaaaacaaaatgcggtagataactaggtcaataaatgtgatcattagttaaaatgtgaaaatgataaaattttctagaaaaataaataccaaaatcaactcaaaaagatctagataacctatattcattcgagacagtgaattagtaatccgaaatcctcctttctccctcttttccctaccagagtatactaaaacctagaaagtttgctgcaaagtttcactgtgccttcacagaacagattatccctgtattgtacagcttatttcaggcaatagaaaaagagaaaactaaataactattttatgagagtgatagcaaaagtggacatgaacaataccaaaaaaaattttttaagggaaattactgtctcagtgaatacagtgaaaaaatactaaatgaatagaattttgtagtgtgtacatattaatgtaattctctgtattaaaggattaaaagattaaaggaacaaaaacactatgattgttttaatagatgacattaacattttttgataaattttataattaaccaaaaggagagagacctcttagcaaatttggattaaaaggaatctaggctgggcatggtggctcacatctgtaatctcaacatttagggaggccgaggcaggtggatcacttgaggcaggaggtcaagaccagactggccaacatggtgataccccaactctactaaaaatagaaaaattagccaggtgtggtggtgtgcgcctgtaatcccagccactccagaggctgaggcaggagaattgcttgaacccgagaggtggaggttgcagtgagctgaggtcgcaccactgtactccagcctgggtgacaaagcgagactgtctcaaacaaacaaacaaaaaaatctgaaatttcttttacctaataaagagaatataacaaaaacctagagtgagcaatcatgtttaatgataaaactttagaagcccttccattaaaatcagaaaaacgttaggaatgtgtgctagccctgcttctattaaacaatatgctagagggcttaggcactggaataacatgagaagaaattaaaagttaaaagaagagaaaaaattggtagtgagaataaaccatttatgttttgtaggaaattcttgtcaagaatggctctactgctccaattctagagttaatgtaaaacttaagtttaaaaaagccaggttcgggaacaggcaacctacaaaatgggagaaaattttcgcaacctactcatctgacaaagggctaatatccacaatctacaatgaactcaaacaaatttacaagaaaaaaacaaacaaccccatcaaaaagtgggtgaaggacatgaacagacacttctcaaaaaaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgactcctcagggatctagaactggaaataccatttgacccagccatcccattactgggtatatacccaaaggactataaatcatgctgctataaagacacatgcacccgtatgtttattgcggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaactggaaatcatcattctcagtaaactatcgcaagaacaaaaaaccaaacaccgcgtattctcactcataggtgggaactgaacaatgagatcacatggacacaggaaggggaatatcacactctggggactgttgtggggtggtgggaggcgggagggatagcatcgggagatatacctaatgctagatgacgagttagtgggtgcagtgcaccagcatggcacatgtatacatatgtaactaacctgcacaatgtgcacatgtaccctaaaacttaaaagtataataaaaaaaaaaatatatatatataaaaataaaaaataaaataaataaaaaagccaggttcagttatagttgatgttgtctctatctctctgagcctagtaataataaaacactgttggttctgggatagtggaagaacttccttttcatttagcagttgtattcataggttgtgcttaaactgattgtaattaaactgatgaaattatccaactaccaccaagtagttgtatagattttaaggatatctgtgagggaaaaaaatggtctattccaattattgaactactgttttatgtaaaaataatatgaaataaaagtggtatgaaatagaaaatggatggaaggatttttttgtggtaataatatctcttaaacttatattctgatttagggttgccttagtctgcatttaaacctgttcacatgctggatccaatcccagggccttaaagtacaaactgcttagccgaacttagtcttagctttaaaagccgaggtaacattgcagacccatggtgtattttagtcttagtcattatttactggtagcctggacagagtgcatggcatgtgctgttctgtgtcattcactctccttcacttcctccctacaatcctattttataatcagtttttacattttattgtttgtttatctttcctcttaggaagctgggattttctttttgctgaatggattgaaaaataattggggaaaaggaaaccacaaagagtttagagaggtttctgttaagtacaaaaattaacatttgagttaaattgtcttcgaattattttcacattatttatatatttaaaatgttttggctttgctcataaattcttcattgttcaaaacattgcttttgtaaaatttgtagtattccctttcaccttatctatcctgtatctattattatttttccctctttcagctttttgatgagaccacaaaggataatacttagaggagtttcctggcctgtattacaagatagaccatgagttctgcctcaattcaacttcattgtgtcaacttgataggataagacaggtggacattctgctaaccagcatctgattagagagggtggaggctggtgatggattgttaggtgtgatgacaaaataagcaattccgttaacatgagtgtgcagagtaaaattgggaccagcagatggtggggctaagctgtatcttatttctcagctatgagattttccgtggccgccttttcacagtagccagctgggattgtccattaactgggtttgagtaaaagggagttgttgctttctttagaatttgttcagcctctccttttcatgtatggctttatgttcatttggtagtaaaacacgatattcaaaggcagaatatatgagaactgaccttttcttggagaacatcccagttagatcccatttccacaatatgattacactttgaaatctggcttttccctgttctttctttaatcctctgatattttaaattcctgtaatctctgctattgccactttaaacctcattactgaaagttcttcccacactgaaacacttctcagaaaaaaaatgcagaatatagagcagagctataatataaacttaaacagacctgctagttttagctttcttttctagtatacataatttagtttacttgatccaaaggatctttaagaaacatgttttggtttaatttctgtttgttttgtttttttttttgagacagggtctcactgtgtcacccgggctggagtgcagtggcgtgatcttggctcactgcaacctccacctccagggttcaagtgattctcctgcctcagcctcctgagtagctgggacgacaggagtgtgccaccacacccagctaatttctttgtatttttagtagagatggggtttcgtcatgttggccgggctggtctcgaacttctggcctcaagtgatctacctgcctcagcctcccaaagagctgggattacaggcgggagccaccacgaccggcctggtttaatttctaaaacttacctactaatcgacttagttctgcaataaatatagttacaatcattataactagtattccttgggctggtttaaagatgttctttagcatttgagatgaaaggcagaaaccacaggtaggatcatgtaagctatggaaccaaaggaaaagcctggaaatgcaacttggagtcctgcttactctgtatccttggaaaatccagattgtgaaagaaaagaaaaagatcattttcatccatcttttgacagctttctactttgacacttctttcctctacagttccaacagaaagcccaaggctgactttgatttgcctgacttgggtatgttcccatccctgcctcaatcattaacttactggcctgagtcttagtgatggggtcagcctctcctcaatcctatgagcttggaacaggaaaggaaaattggagaagaggaaagggattctggacagtcaaaaataattaaatatccactctcttcccaaagctgtgtaatgggagagcactgtccttcagccaataatgcactagcagctagattccttagctagaccttcttccactgttgaagcctaatccctctgttttgctgcagatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagcctagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaataacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctaaaacccaagactgccgtgactcctagtccaatgtctgtttcgcatcacaacacagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttgagatatcttgtatttatttttgagacttgcagtagaaataacagacactaacattcacagacaatctgataaaatagtaatcttgccaccagtacagtatttctaaaattcaactatggggaccctagtagtctgcacacatatacctgggtatccaaaagttctcagagataaaacctgccagccaaagaccaccaggaacacacctgtaatcaaacaaagttaggtttattagcttgttgtagtaagaggaaacagccaccatggggaatcataacatatttcagggagaaggaactagaaaggtcttttataggctttgagctgatgtcaaaattgttaaaagtaactgtggtggagtggaaataacacaggacatggagtaaaaagttctagtttgtctgaatccaacagtgccatgaccagtaggattcatttcaggtgtacatggctagttcagccttaaaacagtcaatgtaatgcactgtatcaacaaagtaaagaaaatcatatcaatagacacaaaaagagtctgacaaaatctaaccctcattcatgagaaaaactcagtaagttaaaaatagaagataattacctcaacttgatgaagaacatctaaaaccaacaaacaaaaacctgtatgttttaatagcaaaaaactgaatgtttttcctctaagattaggaacaaggcaaggatgtctgctttcatcactcttattcagcctaatactagaagtgctagtcactgaagtaaggcaaaaaataaataaataaataaataaataaaagacatgcagattgcaaagaaatttttaaaaacttttcatttgcagatgacatgattgtttacatagataataccaaggaatgtattttaaaacaagcaaacacctggagctaataagtgagttttagtgcagtcacagtatacaagatcaagaccaatacccccaaatcaattgcatttctatattctaacagcaaacatgagaacaaaaacacagtactatttaaagtcaccctgaagaaaatgaagtacttaggtataaaattaacaaattatatacaagatttgtatgttaaaaatgctgatgaaatcaaagacctcaataaatggagatgcataccatgttcatggattggaaaacaacacagtaaagatgtcagttctactcaacttgatcaataggtttaatgcaattcctatcaaaatctcagcaaggtttttaatagacatagacaaacttattttaaaatgtatgtgataagtttatttctctagaatatctcaagtaatctttataaggaaaaagtagcagaaagatttggtatcagaagacctaagttcattcttgcacttcaatagataccacatctgatcttataaggtagatgttatttccccttgttttgcagatgaggaagctgcaatttagaggtaacacagatcttaaatccttgttttctgacttgaaatccagtggctactcactctgccaattctacttaactgttgatctgaaaaaaaaaatttttttttaattattacttaaaaccagcctctgatactgaaagtgagaaggatcactctacccaatattaaggtttattatatagctatagtaattgttatgggctgaattgtgttcccttatatccctcaaaattcatatgtttcagtcctgacccctagtatctcagaatgtgactgtgtttggagatagagcctttaaacagctaattaaggtaaaatgaggtcatatgggtgattcccaattcactggtgactagagtccttagaagagcttaggacaaggagaggcacagaaggaggaccatgtagagacatagagagaagatggtcacctacaagccaaggagaggatccctcagaagaaaccagccctgccaacaccttagccttggacttctagtttcctgaattgtgagaaaatagatttctattgttgaaaccactcagctgtggtactttgttat

SEQ ID NO: 15345 - DNA, 18448 bp, Human
tctgaaccagagttttgttatgcataaaatgggggtaataagcgtttcttcagagagtcgctgatattggagataatttatgaaaagaaccaggtacatcatagactctcaaaaaaaggatagctattattgttgtataacaagaataattagtactagtagcatctctcagcaggtagaatgttttagctatggttctgactaccccagccctgactcctaacaactttcattacacccactctctattctttcatcaccatccacctcttgttcctccattctcctttaccaaaaatcatagaggatgaaacctcacatagccccaaagctggtcacattggtctgacaaatatggtagcaggtgcttcaatgagcccagttgaagatggggaaaccaggaaatgtgccatcagatactaagtggagtcaagggagctgataggacctttccctggtctatccctctactatcctcaggacagggcttggtgggaacttccctagccaaatgagcctcaatattgtgtttcaaatacttcaatttccttcaatattcacattcagtgatgaatacttactgttctcagaagcctttgttttcaggaaaaacttgatggtggctgaaaacatgatggctctgcttggagggaaatgcttgttttcctctctctaagtataaatgctcattcacacctttcctggctttttgagaggtggcaaaatgcccaagattgattgccagttacttgtgttacctgaatgaggcccttgtgagtctctgatctaggaaaaacaaccaaaactaaaccaaaactctttttagatcacctagttccgtttattttttccttcattttgttgacatttcaccttttcatccataaattctggtgttacactctgcacaatcaagcatcttagttttgttttccattttatgaattattccagaggaacatgttcatgagaatttacccttttttgtaattacggtcattccatcacttttagatttccctcatttatttgcctcattcatcatttgcctctggaagcatataatatttttatttaccttttctggaattaaatttgggtttcatacttaggaaaaagccctgcagaatgaacccatacccagacagtaccatatttaggggtgttgatggcttagttcaatcactttaattctagtttttaaccaaatttgaagacaaaagtacaaaggttaaaagagaatgggaatacaaaacaatgatttctggcattaaatacatcagaaagcccagctaggttttggaggactggagaagatgggagagacaatgatttttaaaaacagaatgttttgaattttatttccaatttggacaaaattcacacatgggaaattcaaggattcagaatcaatttcttttattgaaagattatttaaatttaactataaattatagaataaattgttggaattgactactaatgatatactgaagataaataatgaaaatatagcattgattacctaatttggaaataataattcttgaatgcctactgcgtacagacactatacaactcacttaatgctcctgtgaaattgagatcccactttacagagaagaaaataacggctcagacaagtaaaaaacaaaaccaaaaacccgtcaccaagttcatgtgttttgtaagtgttacagctacactaacattcttcctagtatcatttaatggaccctagagctccatcattgactagctgtatgacttaagggaacctccttatcttccttgccttagtttcctcatctgtgaaatggagggtctggattaggaactccacggtctaaagacattccttgcagctttaacattctatgagcataaggagtatatgggcatgattttaaggactggttgtttatgagccaatcagaggtgttgaataaacacctccctactaggtcaaggtagaaaggggagggcaaatattggaaaaaaaaaacatgatgagaagtctataaaaattgtgtgctaccaaagatctgtcttatttggcagctgctgcctcacccacagcttttgatatctaggaggactcttctctcccaaactgtaagtaaaaaagcttcctttgtatacctggacagcaccagtgaataaggggttaataatactactaagcttatagaagggaagattggtttgcctttgttttcgggaaaaacttgatggtggctgaaaacatgatggctctgcttggagggaaatgcttgttttcctctctctaagtataaatgctcattcacacctttcctgactttttgagaggtggcaaaatgcccaagattgattgccagttacttgtgttacctgaatgaggcccttgtgagtctctgatctaggaaaaacaacttgaacactcctatcgttaggttctaatcagtttttgagattcctgttcatttcaactctcaactctcttttcataacaactacttattttagtgatttatttacatatctactgccttatgtcattttctacattctcttcccacacctactggtaccgacactgaagtttctttgtcacagaaacaaacccttggagtattttgcccttcgccttcacccactgctcaaatgaggaaatgcaacagggttggaaacttcacagagcatagtcatcatttgattatgaatttccaaacccttcatgtttgacactttctagaacatttcctgctggccccagacactgtgaagaccctacagcttaagatagtaggaatcaaaaggttgtgtattttgatacatttgctctactatctgaaaaataggcattgtgagaatatgttgcctttttaaaaaataacttctctttaaatagttacctagggctccattagacaatttggatgcaccagagcttgaactctgctaccctgctattcatcactttagctaaggcacatctgggtagcacccaggcccaggttagagccagagatactggggcagggaatggggaaatgttgaatatctaagaggtcctttggcttcattccaagtttagaggaaagagcaccattcaggactcgttctgggctgctccgcgtgtgttaaagggcactggaaatcaggctgtcctaggactgccctagatcatcccactgcacttgtcactgggacattggggtggataatgaagctattggcagctttaagcatcatgtacaaaagtgctgcatgcagtgcctagaaatcatgggctatcaataaataagcctcctcatatttgccttaaaaatccatttgtcttgtacatagagaagcaaatgaactttctgctgccttctatttctccaggaattaaatatccatgttacaaataattatgttttcacagaacatcttcaaggaaggcagaaagaaccataccataggattctacctgctattttgctgaaggattagaaatagaattctaagtcataagccaataggatgtaacttgcaatcctagaacatcacaacttagaaggcacatcagacatagtctctctggctttagtttcctcatctctaaagtgacagggttgacgcaggtatctctgaggtcatttgtagctctgtttttctgtggttaccttctgttgttaatacaactttcctccagatttatatacatattacttgttacacatatgtaataaagtgcgtgataaagaatgtataaaatgaaatgtggccgggtgcagtggctcatgcctgtaatcccagcactttgcgaggccaaggtgggaggatcgcgtgaactcaggagttcaagacaagcctgggcaacatagcaagactttgtttataccaaaaataaaaaaaaaaatagctgggcatggtggcaggcgcctgtagtttcagctgcttggtgtctgaggtgggaagatcacttgagcccaggaggacgaggcttcagtgagtcatgattgtgccagtgcactccaggctaggcaacagagcaagactctgtctcagaaaataaaaaagaaagaaagaaaaagaaaagaaatgtgagaatctctccaccctaccccattcttcagaggtaactccagagttgttactctttgtttatatagacacaaaaacagtatgggtatatatcattttttaattaaaaaataggaggacagtatatattgcatacttctctgaaacttgtttttcatttaataatataatgtgaacaacttccatcacactgaaaaaagttggcttgagatctgagagagcagaggcttaggagtacggaaatcgttctttgtcattacccatcccaggttgtcctcctgtctccttgtggtgaacattggcctgtgaccctgttttatgattaacagagaggtgacatttgtgctaacgtggtacagacctttaatcccactgtagaagtttaactccctgtaaacagtattagtttgaattatcattttcactgttattctggttgagtcagcatacccagattgaagaaaatagtttagtaataggcagtaaacagaaaaatggaggtcacttaggtgatttttttcattaaaaaaagagaattagtaatacattgcattttatagtgctttgtaaagaatcttcatgtttatcatgcaatttaacaaatatattttgagcaactacaatgagcagggtgctcatagatggcatttgagttacctggcaaagagacaaccagaacagttattatcaccatttaatccatagtaaactgagactcaggaagctgcctgacttgcctgaggttccagctagattaggcagagctggttcttaaaactaggtctgtctgatctgctagcagcaaacctctacataaatgtgtcagatgtttatgaataagtaatgtccatggtgtaatcacccacagcgtaaggtactctggggtgtcatcaaggacattaggagtcatccaaaggccatttttttcatcaagctcactctttcccttgaatggaaaggagtactgccccttatctcaacttgatgccttattagctatttgtccttggataaataatttacactctcttatattctttcctaatctattaaatgggaggggaaaagagcccaaccaccttctgggattattttcaagaaaaattatatagtgcatgtaaagccattagcagagtgcttgacaatacatgatcacttgttgttattattattattgggctgattttcccttttgtttcattaagaaaatatctttctttcttggtaattgtcaactcctttgtacaaatgcctaaactgagagagaaagtttgcaccttgctctgaagatcacacccaggttggcttttttcagcatgatgatctggaggccaggtccaaagctaaaagtctttgactccaatattacagctaatatataaacagggcaaacatgctctgctggtggctgggacataatgggccttagaaggtcatcttctctagaaattgttgcccactagcttgtcctattaccccagtaacagcattgcagtttcattcttttggggtaagacaagaacctctgttgaaatggagaggcaacaatgagatcatcagttataccttctcatgaattagctcagtggctactgactttttatatcaagggacagagtactgacagcctaccctgaagggatgcagaaaatgtggagaaatatatttgtcatgaggacaggactggatagggactctgcttcatcctagctgggaccttgaacaagtcagttagcttctctacgtcttagcttgctcattaattaatgaagataatacctgctataattacctcattgccaatggatcagatgagacctgaggtgtccctgggcttccgggaagtaatatgtagacatggagcatccaccctgtgctgagtgtattggagggagagaagattagagaaaggaggagaccctggcattggataggaagctacccaagataatcttcattaccattttttctttggtagcccaacctatgcaaaaagcactctttgtaacacccaaagtgagggctctttgagcttgcattttcaagattaacccaaagtggcatccgaacaggggcaacgatctccttcagagcacaaccactgtggaggctgcttggttagggggtcttcaagccagagtctccccttgctaaagcagtgaagctggagcagggactgccatacaactttagcatcctcataggcagtgagaaacccaagcccagaggcacttaggaaacatcctctctggtctgccccaagtggtttcatagagggttgaatataaggaaaaggaaacttgcacccaaccctctgtagcccgaggccaaatggaagttagctttaagactatgtatagatttctcctttcaagtttgtttcctggagaataatctgttggaactacagactaacagagcaaagcagaggataactgcagaggtcaagagcgacattgtcctggcctcaagccattaaggaaatccagtggcaccaggagtccacagaatagagagacagtccattactgcagtcccctctattagtcatattttagtgggtcactaattagctggttcagtgttttgattagtgattccaaaggcctgctggaaagcattctgtctaggatcaccatgaacattcagtaacccaccttcattcattgcagctaattgcaactaataagtgatgggggaaaaacaaacctcatttgcttatccacctgtggaaatgggtcagaggtgtcacagaggtctgcacagcatgtctgcacccccaactgtcttggtcatgcatccatctgagccacccatggttctgtgcacaactctcgcacactcttttccagacctgtcaccatggcccaccgatttccagccctcacccaggagcagaagaaggagctctcagaaattgcccagagcattgttgccaatggaaaggggatcctggctgcagatgaatctgtaggtgagtgtaaaaagcagtctcatcatataacaacatattattttttctacacttagcaaaaacaacttgataatcatattctttatggaagtaaaggtttatgtacacgggagtgggagcagaagactcagtaagcgtagagcttttgagtcctgtaagtagtaggcacattcctgaaagccaaggaaagaggctcaagcccttcattttaagccaggggtcatttgaatccagccttgtagtaaggccagaaacttagtaactagcataaggtcagatacacaggcatctgctactagtgagaagtcagtttaaagtcagtttaaattcagttgagtcaagaagggcaggaaagtatctgcatctggaataggacagggcttatggatgggagaacctcaggatggcacaagggagagctgtggcagagttgcacagcctgccataaaatcacagaaccctgagaatcaagagcatgccccatccctccttctgcatgtacatccagcaagactgaggaccagatcagggaggctagagaggcctgagggccttccatatccacctggacctgagggtggcttccaccctgacctctatatgcccagcccacatactccctaactagccacctgagagcaaccagggtcttctccctggaacacaaaaaattgaagcaggagctttgactatctgaaaaaagaaagtcttgctttccactgtggtgagggtctctgagatgatgtggagaagggtgacaggaaagccctggcttgctccttatgctgcccttggccctcccaccataggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaaggtgaacacctccattcacacctcacttctgctttgtcctaggcaaactccaagcacactggcaaggacagggccaacactctgaacattctcctcatcaaatttctcttctcacccttttccatcgtcatcttcccacagagaacaagatcctcttctagagttttcctccagtgccctcttctttcactcaaattttctacacgttcttaatctctttgcatctcaatctcatttcttaaaatgggaatctacctcatgatgttcttacagggatgaaatgactaaaagtttctaggctggacgtggttgcttactgctgtaatcccagcactttggaaggcagaggcaagaggatcgcttgagctcaggagtttgagaccagactgagcaacacagtgggaccttgtctctactaaaaatcaaaaacattagccagatgtgttggtgcatgcctgtagtcccagctactcaggaggctgacgtggaaagattgatcacctgagccctggaggtcgaagctggagtgagctatggtcataccactgcactccagcctggatgaccctgtctcaaaaaaaaaaagagtaagatcctgtctaaaaaaaaaaaaaaagaaagaaaaaagaaaagaaaaagtttatattgcgtaattattgttaatggtaactatcataattattgaagcatttactattctatcttataactaggtcttccaatagtgcataaacttctcaaaagtgaaaactagtatccattgaataagagtttttaccattccaagcattcatttaattctcataacctctggtagtagactcaattattacccttatttagagatgaagtgagaaaactgaactacgaagagtaacataacttgcccacacaacaaggcaaggtcagagccagtttaggctaattctcaagctcatgacttttgcctttgctatgtagagagtagaggttgtatccttaattctctttacctcctgtactaacacaacacctggtgcatgcaggtgctcaataaatgttagggtagacactctcacagtgtaccttctaggtaacttcccttctgctatggactgaactgggtccctcgcactaatacactttactaattcaactccttgatctgtaaaagatgcaaactgttagttagttcaagagttctgcttgtgttttcctgacatctgacacctgttaattatttgtatccacagttagaccaaggaggtgctcctcttgcaggaacaaacaaagaaaccaccattcaaggtaaggatattgcccactgagatgaatcatgccagtgtaagctagaaatgaaggcaagtaaagaaggaagcaaggaaaaacaaaacacaactattacactggtcttagagccacacgtacctggttttcaataccagctcctccatttaacaactgtgaccttgggccagtcactgaaatattgtgagcctcagttctcctatctcaaaatggggatttctcaaaatgttgtggggattaacttagacaatgtacataaggtgcttaccacagtaccttggacaaagaagattaaactctgcacccggaagtattatttttagaaaaaaattagcagcagtagagtggaaagtccccacactttgaggtcagacacacctgggtttgaatcctggttctatcacatgctacctagataattttgcaaggtacttctgcccaagtagacaagcattaactcacaacattgggttagctaagcagaatttgaatcccagctctgtcactcttgagcaattcaaacttggtaaagttgcttaaccattaggagcttcagtttccacctttgtaaaatgagtatcatattaactattggtttcttctattctatatatggagtagatagtatgtatgtcaaaacactatttattaaatctaagtcttctggttcagtgttgtgattaatgctgatatgcttggctgttttcaatcctcaagcacagtggattgaaagctaagcaaagggagaactccttccctttattagaagccccatggatcaggtacaaaggtacaaagaagcctttctctcttttgtgacttgcagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcaggtgctctgccttccccttgggctgaaaaagagtaggctagagttttcttcagagcttttcttttcaattatactataactacaaatggacctccttttccctcaccagtatatcctagtggcatttttcacaacttttgctatagccaactgtggtagggaaagatttggtcccacaagccagtaggagtccaactaagctatgagttcaaaggataatgccatcaactgctgccctctgtcaaagctccataagctgtcttataagtgatcgggcttttgagggcagggaacttggttgtctatactccgtaacatccaagacatgatcctcttagattcctagctgaagagtgacagctctgaccgagttccaatccaaataattctttggaggatggtgaccagatgctaaagtttccaacacatactaaaatgtctctgggtccgagttaagtttgattttcttctgtgagtactatgttggggttactagagttgtggacagctggagatccccaattagaactctaaacactgcttgaatttcttcattaacccaacttagagacatctttcttaatgatttatgcttagatgccctaaaaaggcagtagctaggttctgaggcagctagaataatctctagaaagaaatacagtaattacgggtttgtatttattttttatctcattctgaaaaattctactgtctttaagtcatctatgtagtatttctccataatggcttcaatttataccaattgcaactgttgaatctcctcctaaggaaaggataacagtgagcacagcttcacttttgcttccttgattttcctttttagaatggactggtacctattgttgaaccagaggtaattcctgatggagaccatgacctggaacactgccagtatgttactgagaaggtaagttttaaatatgaaggccccaattctagttgaaaaatcttagttttaggtaacagctgttacttaacatataacagctgttatatctgaagtagcctttaggatggatagcatagagaaggtagggaggtgctcatcagcccttcacctttttggcacatggtatactccatatagaaaaagcacaggagttgcagtaccaagacttgggttggagaatccgcttttccacttgtgggatcttgggcaagtcatattatctcttttgacttcaattcaattacatgtacacaaagaaattttaaaataagacatgtggctcaaatgagaagatgtaattagaaagtactttattccatctgactttctaaattagccacagtggatctgaaagagggtggttctattcatacactgtgagaaagtaggagagtcataatgtcacctgaccttagtttctctacttggaaaattatgtggactgaaatgcaatctaagagcacttccacctctaaaatgtatgattctatgactactcagcttctgtaaacatggacagtggaggcccgtttagatgaccccaaatagctaaagcaatgcagtctcaataaggaatgacattgaccaagggagtaatggaaataaaggaatgaagggcttctaggaagcagagccatgcctgtcattcatgcagtgaatgagaagctagattaggggtgatgaagacaggccagtttagttgtgctcagtggctatggattgcaacacattggtctaatgaggcctggagattggttcagaagcttttgccaagcaacaaataagaattccttcatcctgcctccctgcagtgtaaatgtgccaaggtcaagtggctctatgactagctttgagtttcacctggtgggacctcttgtccttcaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggtaaggccttctttcttctctaactcaaggtcttagccctcattctttggagagccacaagctttctgtttgtccagaaatctgcttctattcatgaaacaaacctctgttatctcacaggcagccagcacttcttctcccacttcagaataccaagcatcccaagtctgcccaaatgcccacaatccatgtatttcttcaacatttcactgccttccttacgtatttaaagcacttatctctagcccaactagcttcagcaaaagcaaactgatttctcagtttgctttaaggcaaattaagcagagaaaagactgagacattacttttctggtaggttcattgcttgctttctcaagcagggtatataaggtgggactaatagagtgaaatggcttctctcctaccaggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggtaagatgctgccacctcttatctacttgatgatgttcacatttggggcttgactttccaacacggagaagcattgttttctttgggccaagaaggtatctaccgatagtgtctattaggcatttgaaaatgtggcagtagaggtcagtatgaggattgaggctagagagaattttgaattatccacactagagtatagttgatgacaggagactgaaggacaatttcaacagaaacacttcagagggaaggagataagaggaccaagaactgaacctaggatactttttattttgggaagatgaagaagagaagcaaccaagaaaagcagcgattatattgtagggtgaaccaagcattctgggaataaagacagaagaatttctttctttcatgtttatttgtttgtttgtttgtttgttttgagatggagtgttactctgtcacccaggctggagtacagtggcacaatctcggctcactgcaacctccacctcctggattcaagcaattcttctgcctcagcctcccaagtagctgggactagaggcatgcgccaccatacctggctaatttctgtatattttagtaaagatggggtttcaccatgttggccaggctggtctcaaactcctgacctcaggtgatctgcccacctcaacctcccaaagtgctgagattacagacatgagccaccacacccagccgggtaaacaatttcaaagggccaataataacatgctatagagagattcaaaagaaaggccaagaaaagaccctgagattggcatttaggagcataccagtgaccctcactgaaacagtttcaataaagaggaaaggaaaggtgcccactcaagaagtttttcagaaaaagacccagaaaggttgccaggagaaatgaggaccaacaaagtttttattcaaataataaccaaaatttttaaaatacgctttatgagccaagaactggggtgaacaaatgagacatagccatgtcctccaggaagcttggagtttagccaaataggagagagcttggcatgtttaaatgtaaagaaagaggagccagaggagacagtaaagatgaggagagtggggataattgagtggagaagaacttagaggagcaggactgcatgagactcaatattaagcataggtggcacagctggtgtaagacaaaaaggagggaagaggcagaaaagagaatacagttggaatcagctctatataagtcaagagatgtagcagttgatgactgattacagttgagggtatctgctgagaatgatgaagaaatggaaatttcaatactgacagtcggaaagcgtagaaaagcagttaaaggaacttgctaggaaattgatcggacgttatggccagacatagccaagcatcaggtaatgtgcagctgaaataagagtgagtgtgtggtagcttcattcctgagttttcctaacagcagtctaaagcatgcaggaagattcagaacgcaaaatagcggggtagaagagtgaaagtttaataggaaggtagaagagtgacaaattttaccgatagcctctgttagcttgctgaccatagaggaagctaggcaaggaatcaagagtagtcagaagtgtggtgatgaggccctaaagggaaggaaggccccagggaagctaaatcatcatctcacaggcataagagaggtatcagattttcaaagtagtgctttaccttgactgtggaaagcagggtgcagcagtgctgctgtgtggctgatggactgaggagacctagcttacatgatggagggattgtgaaagcgcaggtcatcagggacatccacacagaagaagggaagctgagtttatcatcaaggatggtgcttcccaagctccagtgtggatctgaatcacctgaaggtgattttggttttgttgtcatgatcttttatatttacacacaataattgtatagatctgtggggtatctgtgattttttatatatgcatataatgtataatgatcaaatcaggataattagggtattcactccaaatatttattatttctttgggtttggaacattccaaatcttctcttccagctattttaaaatatgtaataaatcattgttaactatagtcatcttactgttgtatcaaacactagaacttattccttctgcctaactgtatttttgtacccattaccaacctcttttcatttcccctacccccacttgaagcgcttgttaaaaatgcagattatgggtctcacccactgagtttctaattcagtaggtcaggggtaaggccagggaatttctatttttaacatgttcctaagggatgctggtagaccatgaaacacagttggagaaccattgatgtaaaatgtagaaataagtcctggagagaacagacaatagcaacactgactggaagaagtggtaccactgagtgacattcaaatattgtcgtaagtttcataattctgaatttatctttaactggaatgtatacaggaaagcaaatgatactacaataactaaataaaaattacatattcttctagaccaatataggtagaaaatggaaatgtttttaaaataaacatgtttttcttttggtatagtgtactatactagtgagaaatttttcaactttagtttctagtactgttgctgcaatattgttggtactgaacagagatttccccagtaactgacacaaacctcaagcttaccaaagaaatgctcagaaaactgggataaaaaggggagatactttatagaaggggatggtatccccagcaatattcagcaacattgctgtaaaaagaagaaaatctgagtgaaggtttgactggtttcccatgagaggcagacagggtcaaggtggggtcacatttactctaaccagtctcctctctcatatttgtcttctaggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttcagctgctatcgggtttcacttttctgctcttgctgtccaaagactcagtgtatttcattacttttgactctactagacatgactgggtttcaacagtaaaggtcttcaactcttgctagtcattggaatcaagccgcaaaattttaaaaactgagatgctcaggccacaccccagctcaattaaatcagaaaccctagacttgggatcctctaactattagatttcttaaagctccctcagtaattccaatgtacagtcaagtttgagaactaccaatctaaatttcaagtttgagggtatttgaaaattaaagccattcacaatacgaagccagctaaaaatgtagaatgattttgagcaacttgtggagtataataagagaattaatgtgacttcaatgcttggagcattcttgttcaagtggcccaggtttggtgaaacaggactaccttgtcatctgcacgtccaggcatatttcgtagttttgcagtaaataatattcacataatgatactgtattgactttcaattttcagaattaacctatagttacagcacttaagacaaccagagttataaaagagaatttaaatattataactttggacaatataaaagtgatgatttaactgacagaagctaggaaatataagggggaggagaagtggaagaaagcaaagagagtcaggaatactacttaaaactgatgggttaagaaatagtgctttaattctatttaagtaataaaagaaatggatgtaaatcataaaaatatatatctaaaattaaaatattgatggtagtatgctaaatttcttaccttgaataatacaaagacaaatggtattgtgtagattaacaaatgaagaaacagagacttaacatattatttagaggaataagacagaattagccaaaggggcttactctaagacctgggagaaagacctgggagtcagggcacaggaaagatgacatttccttattacctgccctctacagtatttgaatatttatttccatgtacttgtcattacttttctaaaaacaactacagacagtcatacaagcaactcaagcctatatgagagatctattaagcccacggttttcattttacaggtgataaaaccaagtccagagaagtaaaattacttactgaggatcccacatttatagcagagctgagagattaaaattcaggtcttctgaactcaagtctcttgctcaaaaagtggatacacagccagagatcttacagggcaaggtgacaggctgtgttcaatatctctgccacccgtggtgtagtcttgtacatttctccttgtacatttcagtcaatcatcaagcacttcatctcctactatgtgccaagctgtcctaaaagcaggtaggtaacaccttgtgagacaaagcttttctgccagatagtttttatctagatcctactcagcatcgctgaattctttagatattttaagaggtatctaaagaaacctctcagattcttatcagttaaccatgaatttataatcaaggatgagttacttatatattttggtcaaggctgaattacattttactgggaatgaggatttatataatgcattttcctggctatcatctgatatattttccctactaagggactactgttgtctttgaaatattaatcccagtaatttcctcctttcacggtaatatgcagacaagtgttttacaaggctacagagttcaatttcgctgtgattactgagtgagtatttagtgacttcccagctttggttactttttcagatttactttagtagttattaaacacctactaaaactaaaacctggtactagacatgaaaaatagagaaatttcagctttagggcacaccagacaattaagcttaaatagctaagcaagaaacacacaaaccattgactgggggttggtaagtgggatggagagtcagggtgtagaatcagatgtctgggtgtaggaaagggag

SEQ ID NO: 15346 - DNA, 5899 bp, Human
ctgggttattgatagcatcctaacgggtcttcctgtttcttggttcccctatattagcaacacagcagtcagaggagtccttttagaactcaatcagatcatgtcacgtcactcctctacttaaaatccttcaatgggtcccattacacaaagagtacaaaccagagcccttacactggtctacaagttccaacatttgactcctgttatctctctgacatcatattctaatattactgctgttgtccttttgctccagtcacactgtttgattagtaaatatttattaaacaaagcaatcctagtctccaaagagatcatagtttattggaggaaacaagagcctataaatggttacacacagaaggtagtgattatggttctccctcacctcccatcctaaactttgacaggtgaaactcccctggatgttgaaggttgaggaatttgccagggttcagggtggtgttggaggaggcagggaggaagcaaggacatttcaggcaggaagaacattacatgcaaagatctaaagatatgaatcagcaacatatttatggaattacaagtaaagtagaaagttcttgctaaaacatcaaaaaataaagatttgtgattagggggccagaatgtgggagggaaagagagatacagttcacactttagacaggagccagatcatgaaatgttttctctttgtttgtttcttccttcacagcttttgatatgctcttggagcaatttattaaccatattttttaatgcatctcctgaacagagtcaaagcaatacttggaaaggactctgaatttcctgatttaaagatacaaaagaaaaatctggagtcacaattaatttgagaaggtaaaggagtgggtgtgctactgtatcaaatttaatttgtacaaaatcatcatctctagtaacattattttttctaatctactgcgtttagactactttagtaaagcttgatctccctgtctatctaaacactgattcacttacagcaagcttcaggctagcattggtcatattaatacccaacaaatccacaaggtgttagttgcacatgattttgtataaaaggtgaactgagatttcattcagtctacagctcttgccaggcaaggcagccgaccacaggtgagtcttggcatctaccgttttcaagtggtgacagctacttttgaaattacagatttgtcaggacatggaggacaaaactagagcttctcactactgttgtgtaggaaatttatgcttgtcaacctggcttgtaaaatatggttaatataacgtaatcactgttagcaagtaactgactttatagaccaatatgcctctcttctgaaatggtcttattttaaacaaatgtgagcaaaagaaaatatttatgagattctaaaaatgaagacataattttgtagtatagaattttcttggccaggaatggtggctcatgcttgtaatcccagcactttgggaggccaaggtcagaggattgcttgagcctggaaggttgaagatgcagtgattcatgattataccactgcactccagcctgggcaacagagcaagaccctgtctcaagaaaagaaaagaattttatttttcttttcagacaaaaatagactttaaaataataatggaagaacaaatatgatgatcacaattatcagagtaattactttatgacagtcagcaataagattctaatctttaaatattcctctgcttaaatcattatattggagttttgatctataatatattcccaccctgacccaaaaattgaagaaggacaaggaaaaatgttgttccaagaaacaaagatgtaagtaaaaaggcataaggaaggaaaaaaaacttttgaagcaaaatgtgattgaggaggatgagcagaccaattatttttggtttggtcagcttacataatgattatcgttctttggtttctcagtttctagtgggcttcattgtttgcttcccagaccaggatgaagacactccagtttttcttccttttctgttgctggaaagcaatctgctgcaatagctgtgagctgaccaacatcaccattgcaatagagaaagaagaatgtcgtttctgcataagcatcaacaccacttggtgtgctggctactgctacaccagggtaggtaccatgttttgctggaagcaagggtgttgaaggtctgtattaggccggtttcattagtttctactttatcaatattttatgtattctaagtaacagccatgagtcctttagccaagactgtctgtgttgtgattggggttaatgaccacgatatcacttagatgtttgggcttggatttgatttgggtaaatttaggaaagcctcagatttaatctgatcaatttggtactagtccaactttgcatctacagggaaaaagtatttctatgttacgtttttacacatagagagataaacatggaaacatacatatatttaatcataaaggacctataatattctcataaaggcaatttctttaactgacactacatctttgacacaaaatcacaccaaaatatgtctccaagtcacataaaaacatagacagccacttaaaaaaattgtcttcctggccctactaaatacaaatgccaaaaaacagcctgagaacacaatcaattcttgcagactgttagaacaaaaatgaatcagcaaacccactcccttcgttatagcattgagaaaaccaagacatagaggcatcagttgctagtctgtgtttgcagtttccttgcattaatacaagtagagaaatagtttccatggtgctttcttttttctctgcagcacccctaattatctatgcagaatttcattctataaactaaaattgaaaatggcaactttttaaatgaacgatactttatttgacggtaaatgagtttgatcaaactccatttattacacaatttattgcaccttcttgggatatacatttggtaggatgatattaaaataaacagaagccccaatttctctacgcagtataaataatttttccactggaaagtgctactacaaataatttctacctggattaaaaattcttatatgcaaactgcatatcctttgaaactaggaaccctgcaaagtatacagctttcaagggagaaaaatgtccacaaggagttggaatatttaaaatcttatgttagccttagcaaacatgttaacttaagcattaacatttaaaattatatatttttgaccttttataaatactcagggcagtgtattttaaaatattttttctgagacattggatatctttgtttatggtttgttattaatacagctttcaattaaatatgaaaagtcaacttaaaatcctgtcatgtttttcatcatttttctatgctaaaattcaaagttcctttatattttgaaaaatagttaatattttgatatagccataggaagtaagaaaagaaattacttgtattttctggaagatttcaagaacaatttagaaatgtaaatagcatataggtcatttatgaggtcatgttttaatgggtaaatgttagagcaagcagtattcaatttctgtctcattttgactaagctaaataggaacttccacaataccataacctaactctcttcttaaactcctcaggatctggtgtataaggacccagccaggcccaaaatccagaaaacatgtaccttcaaggaactggtatacgaaacagtgagagtgcccggctgtgctcaccatgcagattccttgtatacatacccagtggccacccagtgtcactgtggcaagtgtgacagcgacagcactgattgtactgtgcgaggcctggggcccagctactgctcctttggtgaaatgaaagaataaagatcagtggacatttcaggccacatacccttgtcctgaaggaccaagatattcaaaaagtctgtgtgtgtgcaatgtgcccaggggacaaaccactggatcaggggattcagactctactgatccctggtctactggcagagggaactctgggaattgagagtgctgggggccaggactccatcatgattcagctctatattcctaggtctgatttcataaggtttattcagtcttaactcacagacttgtgcctggtttcttctttaaaaatcttagaaatcttctcaggcaatgcctctctcttagggggaaacataagcctagaaggaggaagcagtaatgggagtgagtgaaagaactaactgcagcagtcttctggtagactcttgggccctctagagcaaggtcagcatcttcagcattgtagcgtcaatgcctagcactctgcctggaacttagaaacacaacaatgacttctttagatcagaaaggtcaagggtagaaaatactggaagacgatgtttgaggtaagctgatgaggctgcccgcagccacaccagtcccatgaaagttagtggcatcagttccacctcgccttttctccagcacatggagtattgagacatgatgtatctttctgaattgtttggtacagatggggagtaacagagctcaagatttccaagctattactaccaagcctgttagttaagggcaaaggcaagaaattgtaatttggggctgtggaaattagcctgcctctattcattacttaaacaaattgatcacatgctactaggctcctgcaaaactcctttttgagataaagggaaaaaaccaaactatctcaccctaccctccctaggatccacttctttggaatgacaaaggatttgaaagtaggtttgaaagcagtttcagcaatttaataaatataattaatttgtctacaaatatatttgtataaataaatagctcctttagaaagaattagccatgggggacgaggggaaactgctgttttctaggatcctgtctacatcaatcttctattttatccatccatgttctcccaaatctgtgctttctttcaacaggttatatattaaaactatttcatgagttgatttcttttaaacgtgttaactgtcttagttatgcactcagtttcacactcatattgtttaactaatttatttaaatcttatttttttaataaagatgctagccaccagagtcacaggcttggattgttttatgtacaaacagatgacttagatattctgtattttataatattagtggaatgaaatcttaaaatataattcccagtgtttctataaatattacctttccttatctttggagatattaaaaataattttgttggatttctgaagtgttttgtcacttaaatttcctgtcattttttgaagacattttctgatgtaatttgggagaaaaaaagcatagagagaatcacagaatgggtggagatactagagtttctatagtttacttcttgaatttttgagatggaaaaattaaagcccagtgatattaagtggcccacccaagatcactgtcctagtccttttgggctgctatgacagaataccttagactgggtaattaataaacaacagaaatttattgctcacagtctgtaggctgggaggtccaagatcaaggtgccagcggatttcttgtctggggagggagggcctgctccctacttcaatgctggtgactttttgctgcatcctcatacagtggaaacaacggaaagctccctcaagtctcttttataagagcactaatctcatacataagaggtccattttcatgatctaatcacctcctaaggcccaacttcttaataccaccacaataaagatcagggttcaacatgaatcttggagcaacataaacgttcagaccacagcaatcacaaagactgtttgtggcagagccaggattagaatcctagcctccttg

SEQ ID NO: 15347 - DNA, 80706 bp, Human
  misc_feature (1)...(80706): n = A,T,C or G
cttaaataacagaaacgtactgtcacacagtgttggaggctagaagtctgagatcaaggtgtcggcagtgtgggttccttctggggctgccttctggtggcttgctctcaatctttggcattccttggcttgtagtagcatcaccccaatctctgccttcattgtcacatgatattctcttagtgtgctatatctgtgtccaaatttcccgtttataaggatcccaggtaaaatatattggattaggggcccactctatccagtaagaccttgactaaacttaactacttatatctgcaatgaccgtatttccaggtaaggtcacattctaacttgcaatgtgttgctaggttactgagatactgggggttagaacttcaacatatgaacttttatttgtattttatttatttatttacttttttgagactggatctcactccgtcacccaggctggaatgcagtggcgggaacatggctcactgcagcctcgacctcctgggctaaagcgatcctcccacctcagccttctgagtagctgggactataggtgctgcacgaccacacccagctaatttttgtattttttgtagaggcaggatctcactgtgttgcccaggctggtctcaaactcctgggctcaagcaatcctctcacctcagcctcccaaagtgctaagattacaagcatgagccactgcacccagccttatatatgagtttttaggagacacatataactcatcacactgattctatgcacagtactacatttagccaagctggaggacaatagcgctcgaggtcctgctgtccctcctagctcagcggaggcagtgtggtggagtagagagcaccctcggactgatgtcaggggtcctgagtcaagccctaggccatcccttagttttttcactaataaaaatgttttaattaaaagacctattagtatccaagaagatcttcaaggtataaaaaaggggaaaaaaaagtgtgtgtggagaggctcagatgagttaacaggtctgaaaatgtcatggttatgggaagtagcagagacagggtccaaacacacagggtccaaatgcgttgggtgtcatctgtgaaatgggaaatgaacagtaggcttctccagcaagagagagcagtctgggaagcagcagaggtgaaccctggtccccagggtcctgctggcaaaccaattcttccctctgaaccggctccctctggggggaaatgggggctctggactaggcagtcccctggccacgccattgggtgactccgcagagaaggtctgcagccagcagacctgagtttaaatgtggatctgctgcttcctagtagtgtcgtttgggtaagtcacttaatctctctaagtccttctctataaaatggggataatggtaatacctacctcacaggttaaatgagaaagtccttgtgaagtactgaacacacagcttgatatgcagtagtaaaagttagctatttctatgaactactttttgtaaggattgaatgagatggtgtaggtgaggggcctgtatgcagtaggtgcttaattaaccaccgatactcccctgccccttttaaactcagttttggcagagtttccagcattcatgattccctctggggtgtagggtgaagggtggagagttacacagaaaagtatttgaactccttaaagaataacattgttttcaggcactcataagccatttacaattgcccatttacttgtaattaatgtccatgccaattctaaccaattacaattcattaacttacatgctctcaggactttaccttgcacagttttattagagaattagccaaacttagtgtagtattccaccatagtaatgattatcctggcaattcataaaatgtacccaggccgctgtgtgaacgatgagcctccatttgctctgagagagcaaatctgagacgggtctttctaaggttcttgtctttctggtaggtattactcagcacagaaattcaggagacacagacaagttcttccacgatgtcgtacagacgagaactagagaaataccgtgacctggatgaagatgaaatccttggagccctaacagaggaagagctgaggaccctggaaaatgagctggatgagctggaccctgatgtgagtaggtgctaaagggaagcacattgtcactagcgaggggacctggggagggacaggtggatgcttcctaaagccaccacttcctttttccttccatggcaatgacattggtataactttgcctttgcagatttttcttttaatgtgttgtattagggttctccagagaaagagagaaccaatagggtgtgtgtgtgtgtgtgtgtgtgtgtgtgtgtgtgtgtgtgtgtgtgttgagacagagagagaaggggagagagagatttgttataaggctttagcttgcaaggctatagagaccagcaagatctgcagttgctaaggtggagacccaggagagccaatggcacagttccaatacaaatacaaataaccagcaggccgaagacccaggaagagttgggtctgggaaaagatgttttagtttgaatccgaaggcagaaaaaagccaatgtcccagctcaaggcagtcaggcaggaggaaattcccgcttacttggaggagggtcagctttttttccctactcaggtcttcaactgattggatgcccaccccccaccgccatatcgggggaataatctgtgttactcagtctactgattcaaatattggtctcatccagaaacaccctcacagacacacccagaaaaatgtttgaccaaatgtctgagcatcccatggccaagtcaagttgacacccaaaattaaccatcacagtctaccccttgtcaacttggcacacatatacatctctttaaaccatacttaatttccaaataaagacagtaacgatgtcataattctgcctaacatgatacaactatccctgggtacaatggaaaacacactatcaccttccccagaagaggaggtaaagtccatgagtgatgtttattcttctccttgctgtcctgtaacttaaatattataatgtaaaattaatgatacttaaatcctattatacaaagccaatacaccaataacagtaaagtcggtatcaaacaatcttgtgttacatgataagggaataagagagggaaaaagcaaagatatttgctacacacacacacacaatacaagtgttcataaaataaggaggaagtactcatgacaattacagtcttcatttctgtaactactcagatagttgtagctggtatttataactaccctgtttcattccccattctttgcctttagcaagcacctcagctggttgtggttctttacccgatggggtgacctaagctttcatttctgaaaggcctaggccattagtagtcctgcctggattagtttgttgtagttttccattgaccctaatcacagggcatggtaatactaaaaaacgccctaagggctctcctgtatccagacatactttcttacctcccttgtgcaatagctatccaatttctccttggtagtcagcatctgtcaccccagccagcccagtaactcccttctttgctcattgattcagagtcatgaggagcccaaagtggcctggtggcagttttaacttccattttaatggaattgttgtgtctcctagtggaactttggtcctttgaaactaagacttctaggccagcagaccacagggtcatgggaacaatgaacaaaagttttgctagtgcatcactaggagtaatggtgagtggtgccactcctatttccaatcttgattccctgacccatgaatcctagctatgggagaaatggcatccgcaattgcccactgattcagagcatatacagccttctggagaatgttgccccggcctgtaaggtgtggccacctagctggcactgtaactgagtcttcaaaaggccgttaccccgttatatcgagccagcagcttcaggatggtggagaacatgtgtcatggaatgaatgagctgagaaataaaggaccagaataattcttctcatttaatgtttgatgttttatcattgcatttcatagttggcacatttagaagtgtgtttaatactcagaattcatccctgcagtcagggtacacagtgtcaagagtcaaaagtctctttggttgtgtatgtggtttagcaagtcacactagaactgtgagcatgggcatagaggggttcgtaggtggcctcctagacaagggtcttcatcctacagctatatcccaggcacccaggtcaataaccagcacagagaaggtagataatcaaagttactgaactgagtaaatgttccatgttatatatttttaattaaaaatggaatgtatcacaccctttttttaaaccagccattgctcaactctggtttaatagtgatccataaagaaaacaacacttcaatctcactcacccagagatggtcactgctaacatcccgggagcacagtttgatgaaaaaatgcaggactagaagttaggtgtttcgcttccaatcccaaccctgtctcttccactccatgtgaccttggaccaagctgccatccttcctagacctcaatgtccccagccatggaatagcagagttggttggtcattttcagggttaagctaacctgacttataatctggtcttatacccaggtgtgattaagtggcttcattccagataactcagaatccttgcctagggctcttgggtcccaggccccatagaattacacatctctccaacagtgtgtcctcctcttcctgatattcacgatcttcccctgcctgccaggagaagatggtttcctgatgaggctgctcaagttgatcaaaagtcggcattggtggaaagagccttgcatttctctttcttcccccgcatcatctctccccattagcctgtgtttcagtaaaaacaagccatgtaggcaagaaaaaaatcaagctgcaaaattattctgttctaattctatcctagatcactgtcacacagaattccaagaacaaacaactttataaagggagaacaaaagaggcatgtagccacttccagttaactcaataaatgtgactcggttacctgccgagcactgtgctgggcaccaacagggcagcctggctgggactctgcctttcaggagcacaggctggtggggacacaggcataatacactgagcttgacacagagcagacaggaagctgtgccaggagattaactcttactggtgcaaggcatcacagagcaggtgatactggaactgagctctggatttttttaattccatgccgagtgagggcctttgagaaaggccgcaaggagagtgttgtgtagggaaggaattggggatgggaatcttagtgtggtttctgtggagggtcagatgcgactagaaagaggggttgggatagataacgcgggggaagagggggcggcaaggccgactgacgggtttagactttgctcagtgggttcagggagcccttgagggtcagagactcagaggggttttgggagctgatgctggggacacatggactggaggggtgtcagggagatgggtgagaggtgggaggcgctcccgcgggggaatctctgccattcccagggagaagtgcacctgagggccctgcaggccttttgggctgtttgagttgccctgagatgctgcatggggatgaggttaggtcaggctgtgaccgcaaataaggcaggtgatgacaagggtcagagccaagcgacagacctgggagtggagggggacagatggaggaggcctcgcagaacccaaaatacatccaccagcaactgcattctgtttcacccccaaactggcaaagagctcccgcaggtctgccacccgacatatcagagcatccagcctcagcagcaaatacccagggccctgcagctctcacacagccagctttcccgcccaggtgattagcagggaagggacactccacttgtgctactggagggacagagcacctggggctcaacttgctgacggtcgcaggacccaggcaggcacggagactcggatttcaaacaggctccagagtgtgtgcacctcccactctggcaggagaaaagtaattgagcacaggggtgtgggagcaggcatgggccatctgagacctgagattctcagaccactgtggtttcccagttggcattttcaaagacccctttctctctcagttcaaagaaaagagaagagaaaccagagagaggataggagataatggaggccagtgagtttctgtcccagccacacaattgatcccttcattaagatcagctctgttacctgatttgcaagacagtatgtgagcttcgaaaaggcctggagggcctcccttcttttggagagcacaaacattccagttctagtttcaccctcccttggcccatgctctgaaatcacagcacagggagaggccaaagatatgcagacaatgagagactcctagccagccagcaggtgtctgcccctcccacggcttcagagcaggagcagagcccagagaggggaaagaacttggtctaggtcacacatccaagcagaaccagatcagaaccctggtgccttggcacctaggccactgccctctctgttatagtccatattcctcctgtttttgtttaatgagtgcttagatggcactcactatgtgcaggtgctgttctaaggaatttgaaaatattaacttatttgaccatcatcatgatcctaggaggcaggcgctgttatcatccccattttacagatgaggaaactgagaggtgaagtaacttgtccaaagtcccacaactaggcgatggcagagccactgcgtgtgggtctggagtccacgacgtagccatgccactccaaggcctcatgggagtgttcagggagagagtttagactgcagatgtgctctggttttgtggttgggggtcgctgtaggaaaataatccctcttttttctgggaaagagcctgaggtgcagaagtccaggttccagtcctggctctgctctggacttgggtacgtgattttccttctttggatctcaattttcctgtctgtaaaatggatacagtcggcctagatggccttggaagccccctctagctctaaccacatatgatttctttgaaccattcctggctgtcttagtacctgaattcaacaaacacttcaaggggtgacgtttctggttatgcaattgttaagccccagtgtcatgtggcagaatggagtacgaggacttggaaagcagctctgtttgcagcagaggattccaaacttgtgcacgttaaaaaaaaaaaaaaagtccccaaaactttctatctctctctctggaaaaactcgagcttatcatgagattgttgcacttggactccctcgggaaaggaatgcttcatgtgctaaaagtatccgctgttgactgattccccagaggatctgccctttctcatctctctggagttaagtggatgctgctctgaagcagagccagctcctcagttcagattgcctttgtaccaggcagtgggggcaacacagagagaggttttgagaatgacaagtcatcgtgacttctgcagggagcagtgtacagttttcatatgagtaatagacgctcaatacttcctgggtgtgccataagcaaagccctacgtggattatctcatttagtcctctgggagggttcagtcattagccccattttaaagatggagaagccgaggcttagagatataaagtaacctgcccaggatgcaatctgagcggtgctgggattccaacctagacagtcttggcccagtaacctgtgctgttaaccctgggagcacctctgagactagcccagaaggaaactgagagagcagattggggaattatgcgtaaattcttatttccaacttgatttcttttgaagttgttatgttattttcacaataaatactaatctttcaagaaaagaagaatccaccaacacaaggaatttaactgtaaatattgattgttaatgaggatttggggaaaggcagaacattttttaaactgtctcagtaaaaggctcaaaatattcgcaggagagaagatggtagagataattcaaccttataaagaaattgggtcctaagagttgattttaaagtcagctgtcaggaatctgtgacacaatataaccatagaaacaataatggaaaacaacagaccctctgcaaagcctgaataataataacgatgattttctactgaggagttttttttttttttttgagacagagtctcgctctgtcgcccaggctggagtgcagtggcatgatctcggctccctgcaagctctgcctcccgggtccacgccattctccttcctcagcctcccgagtagctgggactacaggcgcccgccaccatgcctggctaattgtttttgtatttttagtagagacggggtttcaccgtgttagccaggatggtctcgatctcctgacctcatgatccacctgcctcagcctcccaaagtgctgggattacaggcgtgagccaccgggcccggcttttttttttttttttttttgagacagtttcactgttgttgcccagattggagtgcaacggcgtgatctcggctcattgtgacttccgcctcctaggttcaagtgattctcctgcctcagcctcccaagtagctggacttacaggcgcacatcaccatgcccggctaatttttgtatttttagtagagatggggtttcaccatgttggccaggctggtctcgaactcctgaccttaggtgatccacacccaccccccccaccaccccttggcctcccaaagtgctgggattacagatgtgatccactgcacctggcctctgctaaggtgttcttacatgccaggtgctatgctaagcattttatgggcatcatttcataaaatatttacaaggatcttacaagattgatcctcataggatgaggtttaatgtcattctgtagataaagaaataggttcccagaatcacacagctattaagtgatagaattcagacagaccctgctttccttagaccataatgtgtcaagagttctgagaacaggctgggtgtggtggctcatgcctataatctcagcagtttttggggccaaggcaggcggatcacttgaggtcaggagttcaaaaccagcctggccaacatagagaaaccctatctctacttaaaatacaaaaattagctaggcgtggtggtgcgcaactgtaatcccagctacttgggaggctgaggcaggagaattgttcggacctgggaggcggaggttgcagtgagccaagatcatgccactgcactccagcctgggtgacagagcaagactccatctcaaaaacagagttctgagaacaaagggccatgaattgcaggacgaaatatggaaaacagaattggagaatcccagagctccaaggacacttagaaatcatctaacagtaccccaccccaggcatctacatacgcggtaccggtagagaaagcctgattttggagtctgtcctggacacacttggtgttttatgtatttcatcaaatcctcatacccatcctgtgaggtgtcattattaccatttcactgatgagacatccaagcatcaacaaaaccctgaagtggaaagaggggtaaggactcattcaaggtcacacagcaagtcagcggccgagccaaggcgcccacctggtacttcctgtcactccacatggcttcccatcagacgatcataaaatcctccctacttgtgccccaaatcatatcctttaaggcaaagacactcttgccatccaggaagcagccaagtttggtccacagggccgtgattctcctttgtaacacaaaccggcagaatcgcaagcccaggacagaagtaaacagttgaaatggaaagaaataaatctctcctctaaaaataggcacacatccttagaaacactgctggctgtgcacagagccgaggatgggcctggtggggtgagggcaagtcaggccaggcatctgtgtgtccccaccctaccctctgccctctggacccatgaccacctctcccaacccctcctctggctggggaacctcctcgacctggaacccctcacttcctcacatttttcaaggcttgacctttcctcccctccctcgggaagccttttagactctttcaccttcacacccctagcacagcacctgctccaccctggcaacactgagctgtttcctatttgattttgacatgttgaataggaaacattttaaacacataggagagtacagtatatacctattttctcatcatctgaatttagcaaatgttaaaattttgccttatttggttctgatcattcttaaaaaaaaaaaagaaatcactacagataaaatttaaaccctgcctttctgtctccctttctattcatcatctctgccactctactgagcgctttctattgggaggcagcaaaccaagtatccacaacatcatgtaagtgacctacatgaaggaaggaagatgggtcaattttcttgagccatgtggtcatcttggcttatctattactttctcactttataaaggtatgtgtatgtaagaaaatgttcacttaccatttacattttcagaactaaaagcaacagcaaaaccagtgctatgtagtaactgaccgtggcctctgtgtcagagaaaacagggagtggtggggactgaggcaaatgggagtttgtctaaagcgcccagcattttcagctccactaattgttgccggtatgagagtgcagacctggtattgccacgtcacctaatgtttccagagatgttggaaatctggatttttaaaaaatgtataagctccttattttaaaatgctgacagcttatttaaatgcacagaccaaacaaacccaaccaagtgttagcttttaattggcctgtaggcctctcagtttgcagctctggttctacctcctatggcaggtgtttgttttagcataaaaaatagacacatacacaaacatatacatgtgtgattagatgaaaagcacctagcccagtgcctggcacgtggtggtccttaataaatgtgagcctgagtatatgatttgtccactagaatctaagttttttgagactgggaaccatactgtatggccacagatacagtgcagccaggtatagttgtgcaagttggacactttctccaggagacactgttcacatagactagagagtgaataatgtccttggcttagtgcagtgcacaacctgcacaaccagatgtgactgccctgacagaccacctccataatgcagtgtctgttcagttgaatgaaagtgaatgatcatacccagtgatggtaaaactgaatagcaagaagctgcttccatatggagtttaaacctttattctgaggtttcaagataaaagggctctggaccctcattttacagatgggggatccaaaaccagagagcaccagtgccccgtctgtggcctcacagccctgggctgagaacccaggttatcaggtagggtgcagcttcgctacaagtaacagagactcagaataatgtgatttgtgcagtgttttatccatccctcaagtaaaagtccacaggtaggcaatctagggctgggatggagctcagctccccagacttctcagagtcctagactttgtccagctcatctttctgccattcctaaggtgtagccctatagccataatagccacattccaggcatccaaatagagaaaaagggatggggagggggagggataaaagaaaggagaaaagccatgattcaagtcccttttaaggaaagttaccagaaattgccactggacatttctcatatcattgcctggaacttaattatatgactcaacctagctgcaagggagcctgtgaagtgtagcctttaatctgagcagccaagagctcaactaaaaagtggaggctttcttttattgctaaagaaggggaagcttgaatcggggacgatttggagtctgtcactgtgggttcactagtgtgatggcctgatgttctactctgctgaaagccctgagatggattgagaggagttggcaggactttaaccaaatccaggccctcaaagtaaacattataaaggtctcactctctagcttggcatttcccaaaacccacgacagtgaaccttggtctcatcctagacactccccaactctgacatctttcataatatgtccctctccccaaaacccaattggggacagcagctgggtggaaaagccaatggcttgggacagcaggtgcaacatgggcctgaagggagtccaagtcataccatcctgttcccagctggagcatcagtgttgtgtgactggacaactcagaccacattctcttagcactcatggcttggtgctggggattcagagaaaactaagatatatcccagctggcccttgaagggcacccagtatccttagggagagagatacagcatagatatgctccacagagtaagatgagcattattcaagaactggcaagatgcctaggggagtttggagcaagattcaccaggtcagtttggagaatcctgcaaaggctgaacagggtgcccaagggaagggctttgaaagatgaatgcaggggagctggagtgacagaattccaggtggaaggcacagccttgagcaaaggcatggcagtgggagagtgcagggcgtggctgtggaatatggagcagcctggagtggctagaacatgggctacttgatgaagggaagaggctcaggaggctggagaggtgggagtaggttggagtcaaatcatgaaaagctcttcatgcctggctgatgaattggtcaagaattcgtaggtcagggaagttggtgagcatctccgagtatgctggggagtgatgtggtcaggtacacatgtcagtggagtctaaggagcagaggtagagaggcctgaagcaggaaaccagccaggaggcttctctgctggtcccggcaagactcacaagggctggaacgagggtgatgcccacggaaggagacatttcggaacactgcagcctcagaccctaatgcctcccctagcaggccatgccgccctcatctgctgggcctctgctgcactgtgctttctctttccctgcgatgcccctgcactccctctcttcacctggctggctcttccctggtccctcagactcagttcaggaccacctcctccaggaagcccagggctgagtaaggtgaccacaccactgagatgtgtatctcccctgtggctgtgagcccctctgggctgggatcgtaccgtcattgtctcaggatacccagtccccagcacaacaggaacatggaacattttccctgcacatgaggcaggaaaggaggatttggagaaagccagggagggaaggtttgtccccaccttgaataccagagagagactgtgctgctatgacaaataggtaccaccacaagcaattattgggtttcagctacaggagtgcctttggacgtcggcattaatgccctgtaaagttgactggggaaatggcagctattgagtttcaccagccctgcatcaaggtcagggcagctgagccaaaggcctagctctttgtggagagaaagcaaagagagggaggaagagtcccagagtgtgtatgttagggcagaggctgtgtctggagggggtggggctcttagaggtttggatcctgctggtccctttgtaacatcaagacgctgtgactgaggcaagagttggctcaccccgctgcccctgccacactctcaggctaaagtatgtgagaagagcgctccactgcatcatttccagtgggatctggaagctgctggacagtaatgcaaaggcagaactctgtatattgggatgggaccataagtgcctaagtttttcataaggagaaaccgacctggcagataactggaaaataaaatcctcaaggccagttaaaaacttttgttttccagtcaaatcccttgtaaaaggcaactaggggagttgctggcctgtgataggtttggcctggcctggcctggcctgatgtggaggcaggtgggcgtctagggcacacttaggttaaattgtttgaaatgggaggagggaagaggagtcagctggaagttcgaaaagtgaggccactttggtttcactcctaccccaggacaattactcaatgcccctggacctcggtttctccatgtgtaaactgagactcatttgataagcaggggagtctccactcccctgctttctaacacttgtggaggagacctggctctcacgtgcggccacatctggtttccaggatttgttcccagaggacggcagtcaggtgggatggaaaattttctgtgggatggaagtcaagagtcctgggctctcggtccagcgtatgacttcaggcgaggcccctcccttccccggcccttggcttcttccaatccctgataaagaggttttaccacctgtcctgtcctcttccaagaagctgtgtgtaattcagtcacagaataggaacctgggaccgccagagcccagacccaggggtcacgttttgcattcccttgttcttagatatagctgatgtatttgggaaaagtgataaaaattccttgtttttttgtcactgtgaggaaccaggttaaggggttttgcatggttttatgcatggtgagccaccagtctgaagatagttatatagatccttgaccatgctaatatatatacatgctaattatatacagtgtcatttttatgtaagctcaggcttcccagctatgaggctaacaagctatgtgactttgggccagtgacttcagttttctatgcctcagtttccccaatggaaaatgaaaaaaatcattggtctagaggatcttttagggctttatatttccgagctgccaggagtctatgatccttttaatgcattgtgtgtgttcatgcatgtgtgcgtgcatgcatgtgcacgtgtgtgcatgtctgcacatgtgtgcacatgtgtgatcgtgcgtgcctgtgtgtgcgggtatatgtacgtgtgtgtgcatgtgtgttgcctctgtgtgcacatctgaacaagcccacaaggttctaggcaggatggcttctcacgtagccctatctatagcaatgataactgtgcagatacttgatatttagctttactggcacctgtttgcagggtgttagagctcctaacagcacagttaaggatctgtccaagtttccattgtcctttgaacaactggactccagagtgtgggtgtgaaaattagactgtgatgttagcctgccaagctgcacatccgagttataattctacaacatttaaggtgaagccaccattttaaaaatcaggagttggcaactgcacacaggaaaagttgcctaatttccacctctatagtcattttcaagaacaaattaaactttgtattttcaaaatttaaaaaattctaaatttaaaacctatgtgtatacctcttgctttctctagcccaacacctgatatggtcaggatactcagtaaatatttgagaaataaatgaatgaatattttggctttcttacatggaatcttagtttgctaggaaccttagatcagatgtggcataatggcagtttatgggctgagtctgccttgcagatatgttttatttggcctgaacattgttattaaaatatttggactacgtgtcaatattttaaaatcaagaggtttcacacaaaactgagcagatctaataacaacatccacattcctacatgtcaacagtccgctggagctgggtagtgtggaggcatgaacgctctagtatgccccagtccccaccactcccacgtaactcacagctattatataattttagcctaagatcagagataatctagaatttcctcctccttaaaacctgcgctaaatttcctatcaggtaatgataaaaagatcatccaggtattagtcactgacctcctcagatgagcaaatttccaattgttaaataaggacataaagatatcctcagattcctatatacaaatctcacaacctgtctttggggtaaggatgtttgtgtgacaagtgcatgtgactttcagtgcctctcatgaattgacggctgctttggtggagtcagattgatgcttccctttgaactaactacaaaaaaaaaagcacttgcccagcaaatttatcctgtgcacattttaagattgagatttaaattccttataggttaaatgagttcaatttcccacaggcaccatgaaagtgtacctttaaatgtaatgtataggcttgttatagattcttctttgctattcagtaaagtagaccttcccctccatttaggatcttgattaccatgtgtttagtgaataactatgtgtaattaagatttttctctaggccaggtgcggtggctcatgcctgtaatcccagcactttgggaggccaaggtgggtggatcacgaggtcaggagtttgacaccagcctggccaacacagtgaaaccccatctctactaaaaatacaaaaaaaaaaaaaaattagccgggcatggtggcatgcacctgtaatcccagctactcaggaggctgaggcaggagaatcacttgaacctgggaggtggaggttgcagtgagctgagatagcaccactgcactccagcctggccagcacagccagactccatctcaaaaacaaaacaaaacaaaacaaaacaaacaaacaaacaaaacagatcaacaaagaaaaacttttctctaattttactctactttctccattcacctctcatctccctggttactccaatttttttaatttctctttgtgggatcatagccctacatgttaacacactacctggacacatagcattcatttagcagatgtttattgaatgaataagaaataagagaatgagaggtgcttttctatgcatacatgatcaccaaatactctcctggccagagccaacaacagaatggttgtgggaactcttttcctcacctattgagtagcccgggtgtgagagtcagtattaggttctaataatcatgagagctctatggcgatattttcaggttcatttaacttctccacaagtaatttacataataaggtaaatcacattgtaaaacaggcaccatttgaaatttggccagctctagcctggccagtctcagcatcaccgtgaaccactggcacatgaagagccctcttgcctcagcattccatgaccatttggtgcagttactgcattagccacttttatcattctcccatagatgaacatatgccatttaaaaaaaacagcttttttgagataccattcacatagcatacaatcatccacttaaagtgcaccattcagcccgggtgaggtggctcacgcctgtaatcccagcactttgggaggccgaggcgggcggatcacgaggtcaggagatcgagaccatcctggctaacatggtgaaaccccgtctttactaaaaatacaaaaaattagccgagcatggtggcaggcgcctgtagtcccagctactcaggaggctgaggcaggagaatggcgtgaacctggaggtggggagcggagcttgcagtgaaccgagatcatgccactgcactccagcctgggcaacagagtgagactctgtctcaaaaaaaaaaaaaaaaaaagaaaagaaaaaaagaaaaagaaaacaaaaatgcgccattcattggtttgttcttttagcatattcacagagtcgtataaccatcatgatcaattttagaacattttcatcacctcaaaaagaaacctcatgcccattagctgtcactctccatctcccttcaaccttcccagctgtattaacctgtttaggctgctctaacaaaataccacagactaggtggcttaaacaacagagacttatttttgcacaattccggaggcttagaagtcccagatcagggtcttgaggggttagtttgctggtaaagactttcttgctggcttacagacaacagcttctctctgtgtgttctcacggtgactggttggggaaggaggtgttgcagcagctctctggtatactgcttcttatagggacaccaatcctatcagatcagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatccagaatcagaaggatttatgcctatgttttcttccaaatgttttatagtgtagttcttatatctaggtctttgattcactttgagtttttatatataatgggagatcacatgctgtttttgaaaacgagttaaagtggtaaacaatcaggagtttaaaaatatgcatctatctttggttttactgacaatcatgtgatattttgttaaacataccatttaatagaaagaaaacaaactttaacctctaatgaggctgatattctcaatatttactttaaaaatgtgataagcttagagttattagaaaaggcctttgacatttttgtttttacaaatcaactgctttcaataaagacttgaataaatgaagccatatttttatgttatgtaaataatatttttgaaatacattaaaaaatctgtattatataacatgttataattatatggctttttgtttaatgcagtggctctcaatcaggggcaattttgcccctcaaaggaaatttggtggctgggcatggaggctaatgcctataattccagcactttgggaggccgaggctggtggatcacctgaggtcaggagttcaagaccagcctgaccaacatggtgaaaccccgcctctactagaaatacaaaaattagccgggcatggtggtgggcatctgtagtcccagctactggggaggctgagacagaattgcttgaacccgggaggcagaagttgcagtgagccgagatcacgccactgcactccagcctgggcaacaaagtgagactccatctcaaaaaaaaaaaaaaaaaaggaagaaaataaaagaaatgtggcaatgtttggagacatttttggttgtcacaactgggggcagtgctactagcatctaggagatagagagcagaaaggctgctaaacaatctccagtgggtagagtggcctccacaacaaggaagtgtccagcccagaatgtcagttgtgctgaggttgagaaactctgctttaactaaatccgtggcctctaccagatagattcgaaaagagatgagagtttgcaaacccttctcccctcagttacaacccctgaatttcttctatcgcaatacttagcctttctggggccagaacatgccccagcatcttactgccattaaaaccctttatggtaatgaaaatctgtaggccttccctgtggggatccttaagaagcatgagcacttgctttcactgcttaattcattttataattgtgtgttttagttttttgaatttatatttggataatacattccctgttaaacatacatatttgggtaaccaatctcctattaacatatattctacctgattatataacaatagaagggatcataagtaataatttttgaccgtttactatgttaggcactgtgctgagcacattttctgcattatctagtttaattttctcaaccactctatgagagagcaactctcattattcacattttacagccatggaaactgaggcacaatgagatttaggggacttgcccaagattgtgtagttgtatcattattactccaagtcagggcttaagcctgatgtagggtcaactgtgaagtgcaggcatgtcacaaagactttggattattcattatgggtagtcacacattgatgtttgcagggcagtgaggtattgtctcactctcttgcatcaccataagctccctgctgtggaagagaaggcgtgggcacacacagctagctacaggaagtcccatcaaacctgggacatgcccacagaagcatggctcacctgggagcatcacctgtcctgcctatcatggtggacaatatctgagaactgctgcttaaggaaaagtgggatgtgtggagcatcacttatgttcctgatgccccccaccccaaagtcagtcaggccttgattttctacctactgtcctctcataaaaagctccaactcccagtgtctcttttgatctgtggcctaaatctctctgcaagtacaccagcaccacctgccaagcccattatctgtctgtccgggctctgtgctgggtgggccctgctcacttacagccctcccagaggcaggatcacaccccggtctcctgatcttacagccactactcttactgaaacagcactgtggtgttatgcatagtacaccttttaaaaaatgatgcattagttaggccagatgtggtggttcatgcctgtaatcccagggcttaggaaggccgaggtgggtggatcatgaggtcaggagttcaagaccagcctagccaatatggtgaaaccctgtctttactaaaaatacaaaaattagccaggtgtggtggcatgcgcctgtagtcccagctactcgggaggctgaggcagaagaattgcttgaacccgggaggcggaggttgcattgagccgagatcacaccactgcactccagccttggtgacagagaaagactctgtctcaaaaaaaaaaagtaaaaaaaattaaaaagattccttaaacagtagtattccctcccaagctgtatccctctatgtgccaggcatacagtgatcttcatatccctgataacagtcccctcacagaggcagctttcagaaaaggatatggagtttgtgacagtgactgaagatatgcattttaatggtacaaagattgaaagtggggctgggaacggtaatcccagcactttgggaggccaaggcaggcagatcacttgagtttgggagttcgagatcagcctggccaatatggtgaaacactgtctctattaaaaatacaaaaaattagccgggcgtggtgtcaggcacctgtaatcccagccactcaggaggctgaggcaggagaatcgcttgaacctgggaggcagaggttgcagtgagccgagattgcgccactgcattccagcctgggtgcaacagagcgagagtccatctcaaaaaaaaaaaaaaaaaggttggaggtggaatgactcttcagtttagtcagtttgagggtgcatatcttttgggtgatgttctgcccataccagccacccatgtattcccctagctctgcaaatgcagggaacagggagcacacaacgattagaaatggtcatcctcctctcgtaaatctgaagaagaacgctggtttttgttctagatctgtcctgaaattccttgggcaaatctttccttgctctgtgcctcagttcccctaatgggagagtgtgtgcactgatgatctctaagcatccttgcagctataaacttctttgactccctaaggtactgggggctgagttaaagtgaagcccatgaggataactccaatccccccaataggaatctgctttagcagtaagcccacacctagaagcctgcttatgtttgaagaagagaagggaacaattggttgatgttatgtttcttgagatacccatctccaggggcgacgttcaaaatatttaaccaccagtgtgttgtgagcacagacccgtcaggaggttagaaggcagcgggtagggccagcagggactgtggccagagagcatgccccgtcctcctcttagctctgcagggcactgctcacctcgctgctttcctgggcctttctccagctttttttttggtctgcctcttcctgcctgattctccatccagggccccagcttaacccccttttggcttcttctctctccggagccacctgatactcaactcaactcctgtgaatatctttatgcatccaaacaacaactcaatcatattcatcactcagcagatgctctttcagtgccctctgtgctcagactggagtcggctgccttgacccctcacctcctctccttcaaaaatgttagaggcagggatgggctggaggattgagacctgagtcctagcctctctctgccccttgtctgcctttgaccttggacaagtccctccctgtcctggggtttcagattccttacttgtaaaacgaggaacaccatggattccatgagctctgaggtcccttctgttcgatgatgagtttctggagaagtgcaagtcttcagcagctgaccactctctctttctctctctctctttctctctctcctgcccccccacaacctccaatgtagaatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggtactgaacaatgttactgttataatatgccactccccatgcaccattgagtgccgactgtatgccaggccctgccaggccctgtgttgggccaaatgtgactgggcctccttgtcctcatccctgcctggccaaaacacccaaacccaacttcaaaagcatctatggatgatgtagatttcatgaagttttgggggtagactgaggaaagactcctatccactcaaatcagcaaaacttttccctaaaccctctttcactaggatgtcctgattatttttttacgcaaacctaaacagttttgagagtaaaagaagaaactgttaataacgacatcaggactttgggagaccgaggcaggcagaccacctgaggtcaggagttcaagaccagcctggccaacatggcaaaaccttgtttctactaaaaatacaaaaattagccgagcatggtggcacgagcctgtagtcccagctactcaggaggctgaggcaggaaaatcgcgtgaacccaggaggtggaggttgcagtgagccaagatcgcaccactgcactccagcctgggcaacagagtaagactccgtctccaaaaaaaaaaaaaaaaaaaaaaagacatcaggacatgaagcctaagcagggaccatcctatgcaaaccagggactagagatgcactaaccatctccacccagattctctctgctctttctccaaagttcctctctctggcagctgcagcttcccttccttcgtctgtcccattatactctctgctccagcctgaggcaagccatcttgaaggccccaggaaacagagagggcctccctgaccatccattctaagacttcccgttgctctccaaaccctctgcccccctccaatatccccctcatcccattgttccacaggcctccttctgctgttctcaaactttccacctcaggacctttgcacatactccctatgcctggagtgctggtcctgctgcccagctccatgctgtcttcttcatggctggctcctcctgcccggtaagatataatagtcagaaacagcctggagctacatctatttgagttgcaatcctggcactaccacttactagctgtgtgaacatatgtaaatgttttaacctactgtgcctccatttccttctctgtaaaacagggatgatgaaaataccagcctcatgaggttgtaatgaaggttaagtgagttcagatctctgtcaagcgcttagaacagcatctggcaggaaatgaatgctacttaagtattagttgttattgtcctttgggtctcaactgtacagtcttctctttcagggaagccatccctgtctactctgttcaggacaggcagtccctctccaacttcctggcttggttattttccaacacaggagcctgtgtgtgtccttcagagcaactcacatcttatcagcatctctttatttttcatctgtctctctcactagcctgtaaactccctgagggcaaccacttgggctgtttttgctcaagtggtactcccagcatgcagccagtgcgaggcctgccatatagtaggggtgagtagagagttgttggatgaatggatgagctaaaattaaataaatgtttaatggatttgtgcactacttcattagaataccagctacaggaatgtaaagaccatatctgtcttgttcatcattttgttcctggcacctaataaatccgtagcacatagaaggcacctaataaatatttgttgaatgaaagcactaattctaattaattaattgtgtaattaattgtttcttttcagtctcttccattccctccacccctaagaatgcaagcattgtgagccccaggtccacatctgtggctggctcccctgtatcgcagttgtatttgcacaatgcccggcactaagtagctgcttcataaaatgagtacgcacatgggggtagacattgtgcagaggacttcaaaccattccaaatcctggacttggagctcagtccaggtttcactgaaaactggaagtccagggaggcctaaggggcatctagattatagaacttctgaattttgaaaggatcgcgtggtcagagggatcctggagggggtggcaggagagaaggtgaggacgagggcagggagtggggatgggcagcagacctgggtggacacctagcgaggtgagtcattgctggtgtccacttcctcatgtacccacacccctcccaggggaggacctggaggatggtgtgagggatggggaagggagtctgaacggtacagaaatcagtcctgccactcctccagctctggactgggcagagctggggaaagctctctagcctcccagagctggactgtcttcatgaaaaaccaggctgaccaaggagaatagttagcattcattctacttccatacagcaacaagcccaaaaggttcatcatcatcgtcatcatcatcatcatcttggagtatttgaatgctagttgttggagttcttatgacttgaataagtggaggtctcagagccagtggggcaggagaccctccagctctgactggcaggctcagggccattcactccagcctctaccaagcacttcccccacaccaggcctacagtcagcttgggctgctgggaaacagcaccccacaccgcaagacctgatagtatgtgggaagagccataaactggcacaaagccctgaggaatttggaaagggaggccttctcattcaagtgggagagaccagaatatagctccaggcaggatgttttcattagaattagatttggctgcatgtgctggggggataaataaaagtaacagagacttaatcgaggaatttaattttcttaggcattccagggctagtaaggcatattccttagcatcgtggatcacaaccctttccagcttttcattctgccacccctacaacctgtctttgtcctcatggtctatctggctgctgaagctccagccatcacattcacatgccactagtaagatgaagggaagaagtctaggtacctcttacagtggctcagagtcaccatcctcactggaggaacctgttatggggtataataaaccacaggtcttaaatatttattgaatattcatctcagccattgcattagtcattttaatacttgagttcctttttaggggttttattttccttgtgtgttttcctcttttctggatccctggaatctgatattaacagaggttatgatacatttttttccccaaatgattctgttgtgtgttttgctgatagaggtaattgatatttgctgtaaacagtttacacaataaagctaattgattcacaatcatttcctcactgaaaataagcactgatcccattttagggaatatctttctggacatttctctatgcgcttcccactccctctcaaccttcaccactatgaccctggtattgcacccacaccaacctcctaatcatctccgtacctccacccgccctcccttcagcttatcctccatcaacagctactgtgagctgtgtaggtttttgtaaattgaggtaaaacttatataacataaaattaaccatttaaaaatgaacaatccacaacattgtgcaaccaccacctctatcaaggcccaaaacactttcattgctccaaaataaaaccctgtacctattacagttagttactctcccactccctctgccccagcccctagtaccaccaatctgtatctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcattcattttatagaagagagaaccagtggctggggagccacgactaaaaaccagttctctgacttatttttcaagtaacttatttagtgattactgcatgctaaacaatgtcataaacattttacaaaagctaattcattttttcctatcaatctaaggaatttttcctgtcaatctaaggaaaactactatcgttattttcattttattttattttatgttattttttgagatggagtcttgttctgtcgcccagactggagtgcagcgcacgatcttggcttgctgcaacctccacctcccgggttcaagcgatgctcctgcctcagcctcctgagtagctgggactacaggcacgcaccatcacgcccggctaatttttgtatttttagtagagatggggttttgccatgttggctaggctggtctcgaactcctgacctcaggggatctgcccatctcacccttccaaagtgctgggattacaggcatgagccactgcgcccagcctgaattttatagtcttaacttatatttaagtcattccattttgagttcaactttacatatggtgtgaaataggggtccaacttcattctcttgcatgtggatattcagttgtctcaataccatttgttgaagcgattactctttccccattgaatgcaccttgcaccctagttgaaaatcaatttgccatagatgtttgagtttctttctggactctgaattctatttcattgtctatctatctatccttacgccagcactacactgtttagctttttagtaagttttgaaatcaataagtatgagtgctctaactttgctctttttcaagattgttttggcatttgtcgcccgtaattccatatgaatttaaggatcaccttttctgtttctgggaaaaggactgttggaactttgataaggattatattggatctgtagattgcttttggtagcattgccatcttaataatgttaagtgttccaatccaagaacttaaaatattttttcatttatttaggtctttaatttccttcagtaatgttttataattttcattgtacaagtctttcacccctttggttgaatttattcccaagttttattctttggatgtattataaatgaaattgttttcttaatttccttttcaaatttttcattgctgatgtacagaaacactgctaatttttgtatgttgatcttgtaccctgcaatattgctgactttgttagttctaataggtttttttgtgtggaaattcagggttttctatacataagattatgtcttctacaaatagaaacaattttacttcttcctttccagtttggattccactgacttctttttcctgtctatttattctgactgaaacttccagtgcaatgttgaatagcagcagtaaaagtgggcacccttgtcttgttcctgatcttaggggatcatttcctcacttctatcaggtcccaggtcacaagctgtcatctcagtgaggcgtcctctgacttcccaaaacagcggtgcacaccccacccacaacccatcctgtcatcttctaggcccttgtcctgctttgtcttcctccataatgcttaataccattccatatctttatacgtttattatcgctctcctttcactacatcagaagcttttgaggattttactcactgctgtcccctagcccccagaaaggtgcctggcacataggaagcactcaataaatgttgttgagtaaataaatatacatatgcaatttctcataaatggaattaaattgttaatgctactttgtaagcttgcctttttcacacaacatttgtcctaggcattctccttcttagtaagtagcaattgccatcatcctttatactaactgctggaagtccattgtatggatgcaccataatttcttcaccagttcctatgggtgggcatgacagtgactgtcctcatacgtacctctttactccccttattccgttatgaatctgacactttaaaaatatgataatgaggcaaggatgcattatttttctcccttttcatattttatttgtttgtttagaaatgtttatacatttttctctcatttcccaaggtctcagaacctttggttaaggtatcccataccctggcattctattatatttttctttcatatttttttcctacttacagattgtttggtcatgaccaatgcttttgatagagggtagtcagcttggaccaagttataaaatcattcttttcaagtgtgaggggtgctgtgttggagatccctgattcctattctttggagaagttggtccccagagggagaaacctgaagggactctcagcatggagggacccacagggctctacaatggtccacgcagggctgtgggtccaccagaggctgttccattgcagccactcccgtaacaggtcccctgtgtgtttgcaggaaaggtctgggttcctaagcagaagccactggatcctgtgctggaaagtgtgacgctggaaccggagctggaggaagccttggcaaatgcttcagatgcagaactctgtgacattgcaggtaagaggcgttccaggagctttccacatcctccagaaggatttgacccacatctgcagggagccttgtagggctcatttcagcatgaacaccttctctatttctaacaagaactagaggagaccgagagtgttcaaacaacaatccattctcaaaaaccaaaacaaggaaaatagagagaaaaccacgcaaacccaccacaccagggagccatctgctgttgccatgagaccccatgccagagggacgtgggtgtatctcagggagagcccacagacgccctttcccagccattagcgttgaatcctgcccaaaccatttgggaagagaggatagagggaaaacagacagagggcctctggtttctttggcttgggaggctcactaagggcttgatttttacaactttgcactttgcctgcagttggctcagtgagccggctttgaggggtcacccttgtatatcgcatatttgccccatgccctccatcttcatatgtgtttccatatgatcttcaaaaactacccccaaaactccagaaggtggtctgatattcagagccctttgccccactccctgcctcccccgacttctctgctgctcctgtctagtttctgtcccactgctgtggtgttccatccccacaggaaggtcaggctctggccacatccggcaccttgtgcactccctccccacctactgtgctctctgatccagggagtgggtgggtttttattctgcaggcttggagactgctaatcatagcccaggtgatggcaggagggtgggcggggtggggaaaggctcgaggcaggtgggcaggggagagggtagaaggggatgcctgtgactgattggctgtgagagtgaggtagaagagtgaagcagggtaacctcagacactaagtggtgtcggtgccattagtgatggatggcaagggaggagcaggaagaggggagatacagagttcagtttacaacctgtggcacttgaggcacctgtgggccacccaagtagggtcagttgtataggaagttctggagtgctacaggaggttcccattcaagatagagatttgggcatcattagtgttgtcaagctccagaaagaatacatggcccttgtagaagcctttggtggtgggggttgggggcgggggtgcaaatcgtgggaatggggcaaagctggaatgtggatcagttagccacaaataggctgagaaccaaaggccaaatcaagatgggcagaattggatgcaggagccacagagacagagtgagggttcagggctggccaggagactcagaggcatgtaagcccagaggccacggcggaggtgggagggcaccagcaccagcaccagggacttgacaggccacagctgccttctgcgacttgtgagtagtgttgtgcatgactttggtgacattcgttcaggggtgggggagccactgggggatgtgcaggggcagtgagaagactcaactatacacaaggggcactctgggtggtgacaggtgaagccaggtctgggggacctgaggagtgaatgcggaaagccagtgtgtagatcccaagtccagacagccctttcctcaggagacagggaatttgaaggacaaagggcaatggcttgaagggtattgggactgagagagaatggttttccctttcactatgaagtacagaagcagtgagtgcttcacccagctgggaaggtagcacttaactccggaacctagtttgctagggcagggatttattctgtcagaagccacacgagtcacagtagatcctccattgagcccgtatattatacatcacacttcaaccaaaccatctccccgaagtcccttgaggtcgggttaatctgtgaggcagggaggtggctgatgccttggtgcggcatctccacatggactggggctgtttttaccctggactttctcctccaatcacgcttcatgacgtcactcccctcattaggcagctcaaagggattatcaaatgactgccggcgcctgcggttcctgtgccaggtcagagctgcaactctgtgctacgtttctgtgtggctttcttgaaactacttctctttatttttgttggcgtggctatttattgttatctgtaacgacgcaatatgctgccgaagtctgggaaggagaggggagctgtaagtctacaccagtgttaactggctaaccttggatgcctgtcatttgatgttggacatttgaaagatggcagcatctctggggaaggagggactgaacacttttgaccacctaccatgtcccaggttctatgtgagttgctctcaagaccttattgcatttattgaccaaaacaatcctatgaaggaaattttattactgtccccattttatggatggagaaagtaggcaaggtgtggttaaatgccttgcccaaagggtttaaacccaggcaacttcattctagggcctatgtgcagcatcatcacccagtgtcacctgagtgaagccctccagggtaggggaggacacagagcacagagggtaggcaacagagggtgatgggcaaggctggagaagttggctggggacccagggagggggtcacattagaaaaggctctggatgccacaccaaggagatgaaacttgggactaggggcatgaaggagagctagatggaagcaggagtttgagtggagaggagggggtgttctggaggatgggggaatggaggaggcaggccttcgatgaggccgaggcctgggcagagctgtgggattgcatctgagatgcagcttcaccaagagcccagctgttcctagtgccggctcagaggccgagcagctgagatggtaccagtctttctagcctgaggcagcagaaaacaggctgggtggctgatgaggagtgctctgccgagagctgacttcagaaactccgcatgagatgaaggctggacttcgaacatggtgttggaggtgctgggcggagcaggcccaccagagagtggtgggtggttggagcctttttcacagagcgggtgactgggaccaagaatgtgggtaactcactggaggaagaagagtagggagaggaggacatggggcgtccaggtcacctgtagttggtatggcctgtctcccaagtggaacatttccatcagctcagctctggcttgctcactcacacacacagtcagtgctgtccatttagtctctggactaggctctggcaaaagaatggtaagaaaacagcccagtttccaccctcacagagtctacgttaaacaaacaccaggtaagtatgaaatgacaaatgagagtgagcgtctgaacagaatcagtacagcgtgtgagggaggcacttggggtagggctgggggagaccagggaagagctatggagaagagcctaggagcagaagagtagcagtgagaaagtgcggagaaggtccagggcttgggagcggcaggaggagcggttccgggctggggagggcaggcccctctgaacggagtggcctggcaggcttgctatctgctgatgggaggagcctggagggcaagctcaggtgtgccctcctaactcaggtgtgacacgggtgagatgcatcactcatgtattcacctaactgctcactaagccagtgcacattattgaactcctactgtatactaggatgaacaggagccagtccttgcctttgggaggcccaggaggtgatgaggaggacagacgagaaacatgtattttttttttaaccttaaaatcttttatcacttcaacatgtagatttcaacattaaaagcgtccctgctgggcaacaagcagagtgcacaggttcctggcagggctaagttcttggcgcatagcctacagggttgtaggtcagaggctgctgggagtcagcaagcacttgtaattcgcagtgcctcccctgcccactcagggaggtgatgctggctggctttagggacccttcaggtggggcagaacccaggaaggaagtggggtagggagactcatcgtttagatgggacagcctcgggccactcacccccaagggcagttggcaacctgggggtcttgcagctatcagagacaggcttagccaggccaccccctggcttctggctacttccgtgtgcttaggcacctgtcctgctaccctgccaatggcagggtgtatcttatccaggagcagctcaactgcatccaagtcctgggctggagccagtttctcccacctgtccctgggatgcaggagaacatcttccagccatctgcccagagccagcccgagcagctggcagcaggaggagccggggatgtgtgctgttatctctctgcgtcctgagtggaattaccaaatgagtgaactctgccaaggcagggagaggaaacagaactcaatgttctttttcagagttcaaaaatagtcctttttgagttttgaggaagatctagacttaaaaaaaaaaaaaaatcaagttccccagtgctaaattcagccttgccaatatctacaaagaatgaagcaacaggcaatgttgatgtgccgttttctcccgtcactcacttctgttgacgtggagtgtggcacaaaaccaagtgagagggaaagttgcgattttgtgcctagggctggcagaaggtaatactagccccaggcattctgcccatcagtggaaatctagctgggcccttcccttccttcctctttccctcctttcttcttttcgtccttcctttttgtaattctaatttcctctgagctgcaaaatggttttatttcttcttagccctgctgttaacatatgtaacctcctagaataaatatatgttatctgtccttaggatgccaaagtcaaagggaagttttagaactttagaactgctagtgacctagtgaatgagaatactaacttaaaagccacaagagtctttgctgtatggttttggcgaaccatttccctcttgagcttgctggaaaagttgggggtggggggtctaccacagctaccctggatgctgtttgtttgtttgtttgtttgtttgtttttagacagagtctcactctgttgcccaggctggagtgcagtggcgtgatctcggctcactgtaacctccacctcccaggttcaagcaattctcctgcctcagcctcccaagtagctgggatcacgggcgtgtgccaccatgccctgctaatttttgtatttttagtagagacgtggtttcaccatgttggccaggctggtcttgaactcctggcctcaagagatccacccacctcggcctcccaaagtgctgggattacaggcatgagccactgtgcccagcccctggatacttactgtaaaagtcaaacaggataaaaacatgagaaattgttgtgtcactaagtcctatgggtaggtaagagatcagtttaaacactccattttacaggtgagaaaactgagcgtccccccagcccccaaaaaggaagtgacctatacagggttacccagaaaattcataccaaggctcagcctgaaatgcaggtctgcttcctcttggtctcccagcagtctcgtgtaacttcaccgcctccatcccttttctagaccatcacaggaagctggcatctgtgtgccaaatgcactttctattttccacctctctccactctaagccacaccagtcagccatatgaggctacatcttttatatgatccccgcaaaacctgtacgaaaccccagcacatcccagaacccccgtgagctgctccgtgggagctggagagcctgccccagaatgggactccttcttggtgatctgattcacctgctgctgactcaggcctcagcttctgttgcccacgtagatgcagcctaaattaaaacccacgagagcttgaaaaaatgcagatgcctctctccccaccagttctcttagtgatgaacaagcaagtctaattttagcagagaagaatcttagaatgtgagaaacagaaaggactttgagatcatctcatcttgtggttttcgactctcactcagcaacagaatcacctgaggaggtttaaaaaaaaaaaaatcggccgggcgtggtggctcaagcctgtatcccagcactttggaagtccaagacaggcgggttacttgagggcaggagttcaagaccagcccgggcaacatggtgaaaccccgtctctactaaaaatacaaaaattagctggacgtggtggcacgtgtctgtaatcccagctacttgggaggctgaggcaggagaatcgcttgagcccgggaggtggaggttgcagcgagccaagatcatgccattgcactccagcctgtgccacagagcgagactccgcctcaaaaatttaaaaaaaaaaaaaaaggacaaaatatatatatatatatatatatatatatatgtctatctatctatctatctatctatctacagagattctgattggttggtccaggatggagagaggcactgatatggtcttaaagctccctgggtgatccatgtgtgcagccttgaccgagagccactggtcttgtctcaagccctcattggaaagagaggttgaagcctagacaggggaggagaactgcccaaggtcacactgacatcaggggcatggtcagggctggaacttgggtttcctgactcttcattaagggctcccatattgtctctctaacaggaaaccatatctaatcaagtgacttggatattttttaaaaaatcaccaccaaatatttgctaaataccgtattcagggagaggtggaagagaaaatatccttctctgacctccagaagcctacagtctagtagcagaagcagacgtgtatctagatatgtctaacaccacatagattctgaggcatacaccaggtgctgtgggagaattagaaagggagaggaggaatccaggaagactccctggaggaggaagagttactcctagtcttgaaggatagggccatagagttgttagataaaatacagtatgttcaattgaattcaaatttcagagaacaacaaatatgtcccaatattgaatggggcgtacttagctaaaaaaaaatttggtgttggccgggcgaggtggctcatgcctgcaatcccagcactttgggaggtcaaggtggtggatcaagaagtcaggagttcaagaccaacctggccaagttggtgaaaccccgtctttactaaaaatacaaaaattagccggacgacaaaaaatacaatattttttgtattgtatatatatatatatataaagtatttatatattgtatatataaaaaatacaaaaattacaggatgacactcctgtaatcccagctactcgggaggctgaggcagagaattccttaaatctgggaggtggagtttactgtgagccgagatctcgccactgcactccagcctgggcaacagagcgagactccatctcaaaaaaaaaaatttgttgtttatctaaaattccaagtcaagtgggtgcagagaatcaccagcagaagggagagtactagcaaaagcaggagcagctatgagcaggggctgtttgtgtagctggagcagagaagctgttgggagggggagtgcaacaacactggtgaggtggggccagcccagggaaggcctgtgaagccaggctctgggtttggatttggctgtacaagccactgtcctcccatctggacagctgcaacagcctcacagctctgcagccacatccatctctcccctctgtagtgagttctcaacacaatagtcagaactcaggtcagaccatctcacttcctgctcaagcctctaatggcttcccaggctgttcctaggaaaagacacccgaactccttactcagcctagaagaccctgtagaatctgaccttgcctaggtgaataaaatctactccagagggttattgggcagatcaaggaggggagtgtcaggcaatggttctcaaccttggctgctcattgaaaccatccagggagctttaaaaatgcaggtgcctgagctccacccccagatattttgggttaattggtctagggtgggactgggcatcaggaatttcaacagatccccaggtgattccagtgtgcagccaaattgggaatgatggatacaaagtgtcttccctggcccagagcatgtgctcagtgagaggggtggtgttgccatgcgtctgattattaccgccacacatccagcttctatcctgtttcccccagcagtgattgtcacagctgtgtcatcactggtgtcctggccttggcctcttcctactctccacctcccaacatgcagcacagagcagctggaaaggtctttcctgaaatgccaacctgaccttcctccctcactggcctgccactctatgaacctcgaggctttcccacctgcattcctctgcctgtaatgttctatagcccttctcttaacttgaccaacacttactcctcctttgcatcccaagttcctcttttatgctgtcttaggactgaactttttcctctaccacactcagcataccctgtgctggtttttcattgtgtgggaacttgcttggctcctctctcccccagcacactttcagctccatgagcggagacccagtctttcttattctccactgtccccaccagagcctagcacacagtgctggggtgggcctcattacatgttgaacaaatgaatggatgaaagaatggctgagcacgggagcaataagatcaggttggcatttccagaaagagctttccagctgctttgtgctgcatgctgggaggtagagggaaggaagaggccaagaccaagacacccgtgatgacacagctgtgacaatacagccaaagaatgatcaggcctccattaggatggagatgatgggatgggagggggacagatctcagagacactgggatggtcaaatgggcttatggggagaaggtaccacattccctgatgttttaccctgagggacaggcaggatgacaagatggaaagagagccttccaaagaaagaggctgtcactggaaagagccattctggtttggccacgttgagctggatgtgccagcaggacatcagggaatcagaggccaggggcagagcagcctgggctggggctggggatttcagagtcacatcaatagaggtgagagtaaaagtaaaataaaattttgaagttttcatgcaagtgtttcttgccatttctgtgagccagagttcccggggtttggagtgtgggtccctaggaggctcttctgtctgcagaggcacatcatgagcccttcccttgtccctgcagcgatcctgggcatgcacacgctcatgagtaaccagcagtactaccaggccctgagcagcagctccatcatgaacaaggaggggctcaacagtgagtatgcgcccgcccccaggagggacctcatgcttcttgcttcctccactcactgatgttctctggctcattgcagaagttttaacatgttatatagccaaatctgttcatcctttcctttgagtctcctgggatttgtgtcttgtttacaaaggccttctctatcccagtattatagaaatgttctcctatattttcttctaaaagttttagagatttactttttatattcaactttttctttttttagacagggtcttgctctgtcagccaggctggagtgcattggcacaatcttgacacactgcagcctggacctcctgggcttaagcgatcctcccacctctgcctcctgagtagctgaggctacaggtgtatgccagcatgcctggctaattttgtttattttgtatggagatgaggtcacaccattgcccagactggtctcgaactcctggactcaagcaatcctcctgcctcagcctcccaaagtgctgggattacaggcatgagccaccacacctggccttatattcaacttcttaatctacctggagttcatgtttgtgtgtgctgtgggatgagaccaaactttcattttttcgaattaatatccagtggtcccaacaccattccttgcaagatttatcctttccccactagtttggggcctgcctttatcatccacatggatctgtttctaggtgcctcctctgtttcatgagcccttttgtcctttcctgtgccaatattgcattgccttaattactccactgcattgttccaaagctggcattttggccccaaacagaaatgaggctgccaaaaaaaataattattcctccctctggaagattgatgcatttctttcccatccgggcttcatcttagcctcccaagagtccactgaggtcatgagccccgggaaaatgactagccctgccttacagatgtagacccaaggttcagagagtttaagtaattcacccagttcttgcaggacgtcaaaggcagagtccaagtagaaccccagcctcctggctcccttgcggggcttcttctgagtggtgccccctacccccacccagcccctgtgatgtgcagccctcacgtgccccaaccctgcacatgctcccttccacagtatctttgtgttggcagaaagtgagccccttgtttctgtgagccacctccctttcatcggtcactctaggcgtgattaaacccacacaatacaagcctgtgcccgacgaagaaccaaattcaacagacgtagaggaaacgctggaacggataaagaacaacgacccaaaacttgaagaagttaacctcaataatatccgggtaaggtccatttatttcactttacctgtgtgtggctgggggagggggaaccatgtcacccaaatgcaaacggtccagggttggttgtgcagagtaaacagggtcctgtttggattctgggtgtttctgcattgggaatagggacaaaacctttgcaaatgggagcctttaagaggggtgggcagtgtaaacaagtgcatctggcagtcctggtttctttctgaggatgatatcaggcccagatgtttagcacgggccaacccagctttgatctggaaacctgccacgttattcaaaacactgagagattctccgagataaaatcatgagtcagacacacgctgctgcatgggatctcaaggctggaaaagtctagtgcccactaggctcgggggtaacacaggccctgggcaggcccctcccctgtgccatcgctgctgctatatcacgttcatattcagccttgttttacagccacagaagggagctgttggccaaaatgtccaaagcgatatcccaagctgtctgcccttttctctgtgcacatttccttatgtgatcccggggcaggggagggacaggtggacaggcagtctcaccctgaacaggccgccgcaggaagaattcagagacaaatgcagctttctacccacctgctgagcccagagaccagtggattagttctgggaggggggtgggggtaagactagaagccagccccccatgcccctgctccactttctttccttctccactttattttaagcagctgccagccccacggcaccatcagattggaaacctgcaccctagtgttcacccccacctggcctccccatgctctgctcccatgggagctaaagtgacgctctgagagattggtaaaaacacagccatgttttctttcatgtgcccagtaggagacattggcacaattcagaatgctgcccactggcagtgaatgctgcctcagggccacatgagggatggaatctccctgtgaggccccagcctcctctgggcctcagtttctcctctgcactgtgagcctgttggaccagatcagtggttttcacctgagaagattaaaaaatatataccaacgcccaggcctgaccctagagattctgattctattgttctgggccggcccaagcatcaccattttgtaaaagttccccaggagtctctgatgtgccgctggagcagagaccccctggggtagatgtctcttaaagagtatcatatgcaacccccttacctgttttccagaaacagggccagagagggcaggaggcttccacagagacacctagcaagtcaggaacattgccgatcattgggaccaaggccaggttccagcccctctcacacccctagtcctagctctttgcacaatactacacgccttaatttttgcctcttctctggcccccaagtgcacaaagaaagaggttacaggtcttatctgaaattttcagggaggattttctaaatctgtttaccagaaagttctccccagatttcagtcgtccgggacaaagcctaaaccttttgcccattcagctttttggccagagacttgccaggaatcagagagtagccaggctaatccacctgcctcagcctgtcccagaggaggcttctggtcactctctctgttgcctttctttgtgcagaatatccccatccccaccctcaaggcatatgcagaagccctgaaagaaaactcatatgtgaagaagttcagcatcgtggggacacggagtaatgaccccgtggcgtatgtatgtacctttctgttctgttgcattgtggctgggggccttgaaacagaagggttgaaatatgtggcctcaggactggttgtatcccactaacaaagagctctatgtggtacagtggaaggcattggaccaggagccatgaggggtgtagagggaacagccatcacctggcaccacctacacgtcatcctggccaatcctcacacccacttctggtctcagatgtgcagttctccccactttgcacttaaaaaatctagggttcggagaggtcaggcaacttgttttgtccagtcacacagcaagtgagaggtggacctgcaagtccagtgcagtcacgtgacccctaaatcttcactcggcacatcatattagaacaagagcctgcccttccctgttcctcagtttttccatctctaaaatcaatggttttggttgggcgcagtggctcacacctgcaattccagcactttgggaggtcaagacgggtggatcacttgaggtcagaagttcgagaccagcctggccaacatggtgaaaccccgtctctactaaaagtataaaaattacctgggcttggtggtgcatgcctgtaatcccagctactcgggaggctgaagcaggagaagcacttgagcccaggaggcggaggttgtagtgagccgagattgcaccactatactccagcttgggcgacagagcgaggctccatcacaaaataaataaataaataaataaaaatttaaaaaaataaaaatgatggtttcatcagcaggtcccaatgaccaattttattttataagtctcaaaagatatttctgatcaaattaaattgtacttactctgaagtagccatcaactcttctttttaaacatccagcacatatgtattgagagtctctctgtgcccaacgctgaattaggttctgggaatacaattgtgaccagtctcagcttccactttcataaagattctggtccatttggccaagcagacaactaaagggtaacagtacagtgcaattactgcaaagctagattcctgcaagaagggcagaagctagtttatcagggctagtaattaaccatttagtagcaatcgatttttttctgattcttaaaataggtaagacagtgttctttcatatttttgaaataatagaaatagctcacagtctctcattgctgtcagtggggaacctctggattgatgacctctgacctcagatctccatggttccttgcccataggaacacagctggcaaagccacatgccctgtatgctactatgtcatgggtcagaaaccaagcacatccattctggccctcagctcaggtccacaaatgttttttgggcatggactctgccagaccaacagctgatatcagcctatgcacaccagtatgcccgtgtcaaacactgagatgcttctgggccagttggtaaatcaggctgccagagctctgtcagggcccccaccgcctgccctagcttttctcctggccccggttcctccactgggacccagcatacaaggagttaacacctggcaagacagggcctccaggacctgctcagccaccagcatgtccagttggatcagcctagcaggttgcctactggttgttattttgattttttttattagatttgattaagccaggccaggcctttcctgggagcaggaaggttctggtggaagacacagagaggactctggctgggtcctttccctcaggagggccagccaagtcagagacagacgccatcatagagaaagctgacatgccatcccgggggcacactgaagtgaagggcactgaggagggggcgatgatttcaaaacagagggcttcctgggagctagcctctcagcaggtctcagcaaggcaggggcgacggggtaggtattcctggctcggagcatcattttaggcagcagggcccaccgatcagtatgtcctatcagctgctggtgtctttttccctccatgacgcatcgtttccaccaactgctaattatctcatttccttcagaggctctgattgtcatctacaccccctggctgagttcctctgaaacgtgctaggggccacctaagctcctcttctccagtttgccctggtcacttgcccagtgggtggtttcccaggcttccctcttctgctctgtagtgctcagatgaagaaaaccatgtctccatggaatttccacagggcaataaagagacaagtggggagtatgtacaggaggttgaggctccactggtcactcagtgaacaatgcctgagggcctattatatgctgggtactgtggccaacatgggatagataggatgcattttcagcccaccaggagtatatagtctaatagcagagacaacaccagtatgaaaacaactctgaacagaggaatccaaggtccacaatgagggaagtatggctccattctatgaggatttgagagggtaggctacagctagctggggaatgtcagcaagagttcttggagaaagagacattgagaatgccctcgaaagatgggtagagcttggacagggaagcagaaagggaagggaattccaggtgggagggaaagaaagggcagagacaaagtgggaaagcaccgagcaggcatggggagctgcgagtagccccactgaagaggagcagtgagagttgattctggacaggggagtagacccaggtcatagaagctttgcatgtaggctaagcagcatagaattctcctgtgggggatcaggagccatggcgggttgcaggagaggagagacacagtcagagttgtgcttggtgaaggacatggtggagatcatcctcctgttcccctaggtgtcttaggatctacccagaggggcctccagccttgctcggggtgactcatgggtatccttgctttctcttgtgcttcaaggcccttgctgagatgctcaaggagaacaaggtgttgaagacactgaatgtggaatccaacttcatttctggagctgggattctgcgcctggtagaagccctcccatacaacacttctctggtggaaatgaaaattgacaaccaggtgagatgggcaacggtctcctcaggtctgttactacatgcagctcgctggcctgcagtgtttcccatgctgctggatggagctgagaatgctgatgatagaagctcagagcccagctttgagggacctccaaggtccctaaagttcacaccctctaccacgctcaccttccttcttcatcgcttccactacgtgctcttccagttctgattgagtccctctcatgatgggggacacactccttaccaacatcatcacttccattcttaggcaatgagaacattcttccttatatccggtagaagtcagctccccgtaagtcctgtttgttgggcttagctctgttctctgcttcactcaggacatctgttgcacagatctcatggaccactaagctctccttctccaggttaaaatttccagttttcttcattcacccccattcaatgcggcttttgaatttcctcaccattcacattactctctaggcaattctagtttgtctttattcttatggagttactgtttctctgtaacttctgtgggtcaatcattttatctgcggggcaactctttcagctctgactttctaagaggatgctaataacaacatcttacatgttacatgtgttgagagtgtactgtggaccaggctctgagatacacatcttacatccatcatctttgatcttcacaacaaccctacagaatgtgggtatcatcagtctcagttttcagaaaatagtccagacaggccaaagataagcccctttttcagggccatagggtcagcatttaggaagcaggatttgaatccaggtctctttgactctaaaactcacacttattccactgcagcatgttgcttttgatgttaaaatgctttcttttttatgaatggggactcagtttttttttttccactacatgaaaatttttgctgaatggttgtataaatgtatgcatgggaaaaagattggaatgaaatattacaaaattctaaacagtggttatacctgagtgagactatcacaagtttttaacttttttattgtaaaacatggcaaacatacagaaaagtgcataaaacttaaatgcacagcttaaggaatcataacaggcatgtaacccctgtccaggtcaagaaacgaaaacattaccaacctccagaagactttgtcccttcccaaccataaccctttcaaaaccattcacaacttgctccccactctcatgcctccatgcctttccctcctcatggaatgtcctcccctgcctctaccctcttctctgccttctgggtttagttgaagtttcactttatcttagtggtgttctagagacagcttgaaccagcttgcaagatctgattgtggatatctcttcctgagaccagcgatggcacattggtgccttgaattgctcatggtaggtgggagtatttacactatggaaattggcaaattggcacaccatgcatcagggctttttttttttctttgagagccaggttactactgtcttctcccactagtctgccatagctcctccaaacctctgcccaaagagagttagatacctcttcctctgggctcccctagcaccttggcttcccttgagcttcccagaagctggtgctatgtctgaggcatctccttatctcagtgcccagctcaggacctggcccttcaggagtgcctggtaagtaagtttgccctggatggtcgtgcatattgttcacagcacaatgaggtagcagagagcaaaattcaacccagaatccactctccaagctgtgtgcctcagtatggggctttgttcacccagagagggcacttttttctaatttatataaagcagtcacatgagctggcagcagccgtgtcacgtgcatttcctgcattggactccttgcatctctcgcatgccggtggtcttgctgctgcctcgctcattctcaggccctccccacccctaccccttctgcgccctcccttagccattgctgactgtgctccactggaggcaagaggggcagagcagatggaacaaaggcatgcagcaggcttggcagtggccctgggccaggccctgggattggctactcatgtgaatcccagcctggcctggcaggaagtcagggtctacccagagtcagctgaaacttaactcccagggcagaatgtcagcaaaagaggactgggagcaggtcactgtggtggcagctgccagggagttgccccttccctccacacactatccccccagagtccaagatggagcccatgctaaccattgcccttaccttagctgaataccctggttcaaaaacatttacttccctgagcctccgtttcctggcttgtaaaatgaggattataagaatctctgctcctaaggagataacagatgtaaactctgaagttgttaacttttagaatcactgggaaggtgaactaggggattcacatgctattctaagagttaatttcctgagcaggtatcatgtgccaaaaccatactgggtactttgtgtctattatctaatttaatgttcacaaagactctgtaagtggcattacaacccatccctgtatcacagatgaggaaacggagtgccaggcaggctatgcaacctgcccaaggccacacaagaagcaagaggggcaagattcaaacccaggtctgtgtgactccagagtccatgtataatgctatgcctgtctgggttcttgaagcagctgtggtttcatgtgatgtcagcctggcttttctcatctgtcctctggcctggggcctgagcactggtcagcaccacccgccatccagtgagcctcttttttggttcatcttgacattttgatgaatgctggctgcttgccaggactgtgctgggctgtgtgcaggactgaggctccaggtccaccctccagaagtttcctcactggatgggaggaaagatggttgcagaaatgaccatcataccaggtgctccagcatccagacagtgggctgtgaggtccatcagagggagcagtcttagtcaggaatagcaatcagggagggttgcttggaggaggcagattttgagataaacccgtagatgctgggtagaccctgacttcccacccacagggtgaaaagtatctcaggtgacatggaggccatggcatcccaggtgcagagaggagtggggaaagccatggagcccatccacacaggctcacggtacccccagaggaaagccagaaagggggttaggagtcagagagctttgaatgggtaggtttagggaaagtgggctgtgctgtgctctgggaagatggttctggctggatgggaggggactgggggcaaggagagggtatcagggcccaggagatcagccaggagctatggcctccaggaccagggggctgtggggaggcgctcctgcctaactggagttgggtccggcaggggaagggctgaaggcaggtctcagggagggggctctgctgactcaggctcaggaggaggccacctgtgcctccccttcaggtgccccggccccaggctggggggaggcagggcagtgtgacacagaggaggtggcgagtggcatttgatttattcctttattcctcattcctggttagtcaccgaggtccttggagacgggagctttttcctcagtcctgtgcttataacctgtggcagcaagtctctgtccttctttctccttatacggccagggaaagggacttggggagttctgcccagggtgacacggagctggctcaggacacagtttgggaaccaggactttgaagctgtttgttgactcaaatagtctctctatctccaagcaatgttctgttgccacctgtggttgcgccaagaccatggtgaattgggaaagggcagagcagaccccagagccagaaggcactgagacaacatctagcccagtcctcctttcacaagcggggaaactgaggatgagagaagggatgggactagcctgaggccacaggccaggttagtggcagagctcggttggagctgcagtatcctggctgcactgatggatggatgggagaaaccctgtgggccccgagggagcctgcaggcccggcccaggccaagcaggccatctccacacacggcttctgtgctgctctcaccaaactctccaaactccccacagagctgctcttccccaggacccccagggcaccagggaccctgctccccaggccagacaaggcctggggtgagtcccacaaatgagaatatgtataatgtctggggtagtggccagattccccactttttattccaatatttgacagtgaggatgtgcttaatattttgaagagaagttaaagtagatggattgtgctgtcttgttttcccagattggatgatttgtgtctggctttttttactcaacgttgcgattgtatcagttttttgtagctgtgtaacaaattatccccaaatatagcaacttaaacagcctcagaatcctggcataaaacaataaacatgtattaactcaccatttctgagggccaggaatccaggagcagtgtggctggctgacttcgcccagagtgcatgatctgaggtggagaaactgcttccaccatggctccctcacagcgtgggcaggagacctcagcaccttaccgtgtgcacccggcctagggctgttggagtgtcctcacaatatggcagctaacttctcccagagtgagtgagccaagtcagagaaaaaagaaagcctcagatgccttttatgacccagcctcggaagttacacaaagtcatttccaccatattctgtttattaaaagtgagtcacaaagcacaacccacactcaaggggagagaaatcagacaccactttttggaggggggaggatcaaagaattttgcagatattaagtcatcacagtaagaattatctatattattttgtgtcacaggagttgaccagaaagacctctgtaactgagaggtgacagcatgctggcagccctcacagccctccctcgctctcggcgcctcctcagccttggcgcccactctggccgcgcttgtggagcccttcagcccgccgctgcactgtgggagcccctttctgggctgggcaaggccagagccggctccctcagcttgcggggaggtgtggagggagaggcgccggcgggaaccagggctgtgcgcggcgcttgcgggccagcgcgtgttccgggtgggcgtgctctcggcgggccccgcactcggagcggccggccgaccccgccggctccgggcagtgaggggcttagcacctgggccagcagctgctgtgctcgacttctcgccgggccttagctgcctccccacggggcagggctcgggacctgcagcccgccatgcctgagcttcccccacgccgtggtctcctgagcggcccgaacctccccgacaagcgccgccccctgctccacggcgcccagtcccatcaaccacccaagggctgaggagtgcgggcgcacggcgcgggactggcaggcagctccacctgcggccccggtgcaggatccactgggtgaagccagctgggctcctgagtctggtggggacttggagaatctttatgtctggctaagggatggcaaatccaccaatcagcactctgtatctagctcaaggtttgtaaacacaccaatcagcaccctgtgtctagctcagggtttgcaaatgcaccaattgacacctgtatctagctactctggtggggacatggagaacttttgtgtccacactctgtatctagctaatctagtggggaggtggagaacttttgtgtctagctcagggattgtaaacgcaccagtcagcaccctgtcaaaacagaccaaccagctctctataaaatggaccagtcggctctctgtaaaatggaccaatcagcaggatatgggtggggccagataagagaataaaagcaggctgccgaataacgcagtggcaacccgctcgggtccacttccgcactgtggaaactttgttctttctctgtttgccataaatcttgccactgctcactctttgggtccacactgcctttatgagttgtaacactcaccgcgaaggtctgcagcttcactcctgaagccatcgagaccacgaacccactgggaggaacaaacaactccagaggctccgccttaagagctgtaacactcaccgcgaaggcctgcagcttcactcctgatccaggagaccacaaacccaccggaaggaagaaactcctaacacatccgaacatcagaaggaacaaactccggacacaccgcctttaagaactataacactcacctcgagggtccgcggcttcattcttgcagtcagtgagaccaagaacccaccaattccggacacataactagcaaagctacctcaggatggagcaggtatctcaaagggggaggagttcccatcctgggggtgtgtaaacagctgggagatggagggaattttaatgtcagttagggtctgggactctggagttggataacctaattcccaggcctcctttctgttgtgttttgaagtattcccagttgtccatatcatctgggaatggccagaattggccccgtcaaatgtccaaagtgagattcttgatgttcctgttgcgtctggccagaaagggagcctcagagccaccggctccaggatacaccttgtaacacctaaggtgttggttggtaattttgttcaagagcaaatctgatctctttctcatctgatgggtaatgctctgacatggtaaaggtgtgaggacacacagctgtcacacactgctgaagggcatgccgacttttacatccttttgtcagagcagtctcaattttaatttgaaagcgcctatctttcaacctagcagttttgatttccgtaggaagcctgaggaataccccctccctcccctgccactgccacgttgttcgtaacacgaaaaaacagaagtaacctaaatatccatctacaccagggcgtcccgtgaagccaatagaaggaataaggtcattctctacatactgactctgaaagagctctgcaaaatattaaataaaaaaggtgggctaggcatgacagctcatgcctgtaatcccagcactttgggaggccaaggagggagctcactagagaccaggagttcaagaccagcctggtcaacatagcaagaccccatctctgtaaaaaaaagtaaaggaaattagccagacatggtggcacgtgcctgtagtcctagctacttgggaggctgagcaggaggatcacttgagcccaggagtcagaagctgtagtgagctatgattgcactgctttgtgctgctgcactctagcctgggcaacagagtgagacacagtctccaaaaaaataaataaataaatattaaaataaaatgaaaaaggcaagttgcagaacagtaagtatagtatgaattcatttaaacaagaaacaagtaccacaaaacaaaacaaatccctgtacatttctgtcatatacttcatgcatagaaacacaactcattggccatgatggttactttttttttttttctttttttgagacggagtcttgctctgttgcccaggctggagtgcagtggcacgatctcggctcactgcaagctccgcctcccaggttcacgccattctcctacctcagcctcccgagtagctgggactacaggtgcccgccaccacgtccagctaatttttttttttgtattttttagtagagaccgggtttcaccatgttagccaggatggtctcgatctcctgaccttgtgatccgcccaccttggcctcccaaattgctgggattacaggcgtgagccatcgcgcctggcccatggtggttacttctacggaagggggtgggactgggaataaatcgggtgagggagactctttccttttactcaatctgtgttaatatcatatgaattgttaataatgtggttatatttattcacaagtggttttttacttctcaagcaaatctgaaggagtatgagagttctttcccaaccatcctgtccctggctctgctgcccagagactgttgccagtccgggcatgaccaaccccttggtctctccccctttacacactttcaggcacaggcagctcactaccttaccaggcagttcctcagcgtgtggacacttctaatggtcagaggcattcctccatgctgagccaaacaccatctgcgtgtagttcctctcgtcagtcctacttctgccttctggtcattctcagaggcacttaagtgaggtggaaaccagcacagactctagagctcgctgcctgtattcaaatcctggtcctgcaactgacccatgctaggatttgggaaaaatttcttaatacttctgtgcttcaattttttttgcctataaaatgaaaataatgaggatgggcatagtggctcatgcctgtaacccagcactttgggaggctgaggtgggtggatcacttgaggtcaggagttcaagaccagcctggccaacatggtaaaaccccatctctactaaaaatacaaaaattagctgggcgtggtggtgctactcaggaggctgaggcaggagcatcgcttgaacccagaaggcagaggttgcagcaagccaagatcgtgctatgcactccagtctgggcgacagaacaagactccatctcaaaaaataacataaaataaaataaaatgaaaataacgatagtagttttccttagattgacaggaaaaattccttagattgataggaaaaaatgaattagcttttgtaaaatgtttatgacattgtttagcatgcagtaatcactaaataagttacttgaaaaataagtcagagaactggtttttagtcgtggctccccagccactggttctctcttctataaaatgaatgagtccttttagtctcagggtccccggagtcagagaaagatgcaggtatgaagcttctttgacatctctttttttggagacagagtctcactctgtcaccaggctggagtacagtggcatgatctcagctcactgcaaactccgcctccctggttcaagcaattctcctgcctcagcttcccaagtaactgggactacaggtgcgctccaccatgcccagataatttttgtatttttagtagagatggggtttaccatgttggccaggatggtctcgatctcctgacctcgtgatccgcccgcctcggcctcccaaagtgctgggattacaggcgtgagccaccgtgcccggccgaagcttctttgacatcttaaggcttactgtaaggtgtatgcacgtgttctattttactccttaatgtaaaaagaatgggtttgctctgagatgaacactcctggaagatcatgattatctaatggaatcctgtaccttgtcgcacatgcccagacacatctgtgtgtatctagggtactggacactaatgtgagaactgggcctagaggaacctggggcagtcctttcagccccaggtcaaggtcaagccttggctctgtcatgaataagccgagggagcatggtccaacttccatctacacatggattcagtatactcatctctaagatgcagatgctggctcctgcctgccctgctcacctcccagggatgtagacaggtcgaatgggggcaatgcatgttaaggggctttgtactctgcacgaagcatcagctttgcagaggcagtcctcgaagtccctggtagccccttcactcaggggagaccagtactttctgagactagcccatcctgagttttagcagggcatttgcagcaagagacctcaaggagaggccagggttcctgctaattggggagggtgggtggaggagctgccagttccttcttggggcctcagatggttgctgtgccatctccaggccaaaacggccagattccagggctgtgctgagtcctccaaggaccgacctgacctcttcccagcattctcaggagccttgccagaggggccggtggaatttcaccagtgtccctctgcctgccgtggccagctttctgagcccagtctgaacccagatgagctctggtgaactcagaatacctggggggagttctcaatcaagagtctcagctgcaattcgtgcttgtccatttggatgctgggctgacgtcgcctctatccctcccaagcatgttcctgtttcctccattcaattcaattctgcacacctcgaccgagagaaactgggtactatgtcctacccgagagctcatggtctacagcagcactgttcaatagaacttcctgtgatgatggaactgttccatatctgcattaaccaacatggtagtctccagccagtggctatttgtttgctggtttttgtagtgacgagttttctctatgttgcctgcccaggttggtctcaaactcctggtctcaagtgatcctcctgcctcagcttcccagagtgctgggattataggtgtgagccactgtgcccggctaccagtggctatcaagcactagaaatgtggctaataggactgaggaaatgaactatacatcgttttcattttaattatttagatgtatagagcaacatgtggctagtagctactgtagctactgtattggacaataccgttctaattggtgagacagctatagaggcaggtgacccaagtaaggcagatggactctgccaggtgtagggagggacatccaatgtgcacttgagtgtggaatggggagagatcatttcctggggtcaggatcaggaaaagcctcttggggagggggaatttgcagtgcatattaaggcaatagggatatacttacagggaggctaaaagcattccacatggaggcacatgagctttttggagtagatctctgtctgcaccaggtaccattatcagactgccagagataaacaggccgagtaaggaaggagagagagaaggaaagcaaagagtcatttgtgagccttgagtaccaggctgaggagatggggctgtgtcctgttggcttagtgagggaatgagctgagatcatgcaagtggggcacgaggcagggcctgggacacagtaaattgcagcagttcttggcagtggggagccattagaggtggttgtgtatttctgtttggtttctatttctggtttttaaattattattattaaacttttaaaatttggggataattgcagactagtatgcagttgtaagaaataatacagaggagccgagtgcagtggctcacacctgtaatcccagcactttgggaggccaagacgggtggatcacttgaggccgagttcgagaccagcctggccaacatagtgaaatcccatctctactaaaaacacaaaaaattagctgagtgtggtggcacatgcttgtagtcccagctacttgggaggctgagtcaggagaatcacttgaacctgggaggcagaggctgcagtgagccgagattgcaccactacactccagcctgggcaacagagtgagactctgtctcagaaaagaaagaaagagaggaaggaaggagggaaggaagggagggagggagggaacagagagatcccttgtactctatgcagtttaggtgggaactgtagttttgtatcacagcaaggatagtaacatttataaggtcaagatacgaaatatttccatcacagggatctctcatattgcccttttgtagccaagttcacttgtctcttccttctgcctccttaaccccaggcaaccactaacctgttttccattttaatattttgtcatttaaagaatgttatatatataatgttatctaaatgaaaatcatatattatgtaaccattttggactggctttttttttttcacttggcataattcttttttattttattttattttattttatttcttttttctttttttttattatactttaagttttagggtacatgtgcacattgtgcaggttagttacatatgtatacatgtgccatgctggtgcgctgcacccactaactcgtcatctagcattaggtatatctcccgatgctatcccgcccccctccccccaccccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtcttggctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgatcgccagtctaactggtgtgagatggtatctcattgtggttttgatttgcatttctctgatggccagtgatgatgagcattttttcatgtgttttttggctacataaatgtcttcttttgagaagtgtctgttcatgtccttcgcccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgatgtccttgcccatgcctatgtcctgaatggtaatttagcctaggttttcttctagggtttttatggttttaggtctaacgtttaagtctttaatccatcttgaattgatttttgtagaaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttatagtatagtttgaagtcaggtagtgtgatgcctccagctttgttcttttggcttaggattgacttggcgatgcaggctcttttttggttccatatgaactttaaagtagttttttccaattctgtgaagaaagtcattggtagcttgttggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagaaatacaatcatgtcgtctgcaaacagggacaatttgacttcttcttttcctaattgaataccctttatttccttctcctgtctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgcatcaatgttcatcaaggatattggtcgaaaattctctttttttgttgtgtctctgcctggctttggtatcagaatgatgctggcctcataaaatgagttagggaggattccgtctttttctgttgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgcatgtgtccaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatccttttaaaaaaccagctcctggattcattaattttttgaagggttttttttgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatcttgtgtctttgttctcgttgtttcaaagaacaactttatttctgccttcatttcgttatgtacccagtagtcattcaggagcaggttgttcagtttccatgcagttgagcagttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtccgcctggtgcagagctgagttcaattcctgggtatccttgttgactttctgtctcgttgatctgtctaatgttgacagtggggtgttaaagtctcctattattaatgtgtgggagtctaagtctctctgtaggtcactcaggacttgctttatgaatctgggtgctcctgtattgggtgcatatatatttaggatagttagctcttcttgttgaattgatccctttaccattatgtaatggccttctttgtctcttttgagctttgttggtttaaagtctgttttatcagagactaggattgcaacaacccctgcctttttttgttttccatttgcttggtagatcttcctccatccttttattttgagcctatgtgtgtctctgcaagtgagatgggtttcctgaatacagcacactgataggtcttgactctttatccaatttgccagtctgtgtcttttaattagagcatttagtccatttacatttaaagttaatattgttatgtgtgaatttgatcctgtcatgatgatgttagctggttatgttgctcgttagttgatgcagtttcttcctagtcttgatggtctttacattttggcatgattttgcagcggctggtaccagttgttcctttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgtgggtaacctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggagaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtctgaatgtcctcccgtagctcagagtaatttgatcgtctgaagccttcttctctcagctcgtgaaagtcattctccatccagctttgttccgttgctggtgaggaactgcgttcctttggaggaggagaggtgctctgctttttagagtttccagtttttctgttctgttttttccccatctttgtggttttatctacttttggtctttgatgacggtgatgtacagatgggtttttggtgtggatgtcctttctgtttgttagttttccttctaacagagaggaccctcagctgcaggtctgttggaaaaccctgctgtgtgacgtgtcagtgtgcccctgctgaggggtgcctcccagttaggctgcccgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaatcaagcctgggcaatggcgggcgcccctcccccagcctcgctgccgccttgcagtttgatctcagactgctgtgctagcaatcagcgagactctgtgggcgtaggaccctccgagccaggtgcgggatataatctcgtggtgcgccattttttaagcccgtcggaaaagcgcagtattcgggtgggagtgacccgattttccaggtgccgtccgtcacccctttctttgactcagaaagggaactccctgaccccttgcgcttcccaggtgaggcaatgcctcgccctgcttcggctcgcgcacggtgcacgcacccactgacccgcgcccactgtctggcactccctagtaagatgaacctggtacctcagatggaaatgcagaaatcacccgtcttctgcgttgctcacgctgggagctgtagaccggagctgttcctattcggccatcttggctcctccccaccacttggcataattctatggagattcatccaagttgttgcatgtaccaatcgtttgctctttttcactggtgagtagtattccatggtgtggatgtaccagggtttgtttgaccactcacctgttgaagggcgtctgggttgtttccaggtttgtctattacatataaagctgctataaacattcatgtacagattttatgtaaacatatgttttaatttctctgggataaatacctgggagtccaattgcatttttaaaaaactcaactcttgtgcacagtgtgccattttctagacccaccagtagtttatgagtgagccagtttctctacattctcaccaacgtttggtgttgttgctaatttttattttagagattttgataggtatgtagtgatatctcattgtgattttgatttgcatttctgtgataggtcatgatgttgaacatcttgtcatgtgattatctgcaatatgtacatcctcttcagtgaatgtctcttcatatcctttccccgttttctaattgtttgttttttttttactgtggagtttttttctaattgacacgtacttcacacaccacacaattcatccttttaaaattcagtgggttttgatgtattcataaggctctgcaaccatcaccactatctaattctagaaaatttttatcactcaaaaaagaaactctgtacccattagctctcattctgcttttatcccctcccccagcccctggcaaccactaacctcctttccatcgctatggatttgcctcatctagacatttcatatcaatggaatcatacaatatatggcctttgtgtctggcttctttcatttagcataatgttttccagggtcattcgtgttgtataatagcacatatcagaactttattccctttctgactgaataatactccactgtaaggatctaccacgttgtgtgtatccattcatcagatgatggacatttgggttgtttcttcttttggctattctgaataatgctgttatgagcattcatgaacaagttttttgtgtggacttatgtttttatttattttccacccaagagtggaattgctgggtcatatggtagctctatgtttaactttttcaggaactgacaaactgtctttcaaaggagctgcaccattttatattcccaccagcaatgtatgagggtgccactttctccacattcttgtcaacacttgttactgtctgtcttttctattatagtcatcttggtatgtgtgaagtggaatctcattgtggtttgatttgcattttctgaattattaatgatgagcactttttcatatatttatttgccatttttatctttacagaagtgtctattcaaatcctttgctcatttataaattgtgtttttactgttgagttctaatagttctttatatattcatatttaaatcctatatctaccaaatatttttacaaatatcaatacaaaatatttttcccattctttgtgttgtcttttcactttcttgtgtctgttgaagcacaaaagttttaaattttgatgaagtgtaacatctattgatctatggcattgattcttttaatcaatttggtaatattgcaatattaacaatattaagtcttctgatccatgaagacttaagatccatgggatgttttttatatttatttaggtcttatttaatgtatttcagtgttgttttgtagttttcaatatataagtctttacttcttttgttagaaataaatctaacaaaagaagttagaattagtattttattctttttggccaagcgcagtggctcacgcctatgatcccagaactttggccaaggcaggtggatcacctgagttcaggagtttgaaagcagcctggccaacatggcaaaaccctgtctctactaaaaatacaaaaattagccacgtatggtggcatgcgcctgtaatcccagctactcaggaggctgaggcaggagaattgcttgaacccaggaggcagaggttgtggtgagccaagattgcaccactgcactccagcctgaacaacaagagtgagactctgtctcaaaaaaaaaaaaaaaaaagaagaagaattaatattttttatattattataaatttaattattctctcaggttcattttcagattgcttattgctagtgtatagaagtacaactgatttttgtgtattgatcttatattctgtaattttgccaaactcactaatttttttttttttttttttgagacagagtctcattctgttgccaggctggagtgcagtggcgcgatctctgctcactgcaacctctgcctcccgggttctcctgcctcagcctcccgagtatctgggactacaggtgtgcgccaccacgcccagctactttttgtattttttttttttttagtagagacagtgtttcaccacgttggccaggatagtctggatttcttgacctcgtgatccacccgcctcggcctcccaaagtgctgggattacaggcgtgagccactgtgcccggccggaactcactaattttgtgtaggggtgtgtgtgtattcttagaattttctatatacaacattatatcatctgcaaatacagatagttttactttgtcctttgcagtctggaagcattttatttatttttcttgcttaattatcctgtctagacccccccagtaaaatgttggtgagagcaaacatccttatcttgttcctaatcttggagggaaagctttcagtctttaactattaagtatgatgttagctttctgtcttttacctcctgtttaagattatatttatgttttattattttattatatatggtaatagaaaatccaaacaatacaataagatataaagaaggaaacaaaaactttctccccaaatcccaccattatcaatatacttaaaagttttttttctgcattatgtatatatatggaaaatatagacaactttacatacaaatcgtctattttgtgaccagggttttttttctttttttttctttccattcaatattggttcatggccatctttacatgctatggccaaggatttgcaccatcattttagagctgcccacattctatttagtatggttgaactatcatttatctgagcaactctctatgaattctttttttttcaatttttatttattttttgttttttggagacagagtctcgctctgtcgcctgggctggagggcagtggcacaatttcggctcgctgcaaactctgcctcccgggttcaagccattctcctgcctcagcctcccaagtagctgggactacaggtgcccgccatcacacctggctattttttttgtatttttagtagagacagggtttcaccatgttgcccagggtggtctcgaactccttagctcaggcagactgcccacctccgcctcccaaagtgctaggataacaggcatgagccaccacgcctggcctcttaagaaattgtttcccttttcctggcactattataactgagactgtgatgaacatcctcatcatattcttcccaacattgttgggtctttctgtttttttttttctgattttttttctttatatctttgtcagatgatcactatagatttgggggcagggaaccattaataatatgatcagaattgggctttagaaagctaactttggcattgtcaacttaccatgtgatcttgggaaaaccttttttccttctctgggcctcaattttttcatttataatttgaagagactaaattactggttatcagacttgggtgcatattgaaatctcctgagaagtttttaaaaacacagccatcggagtcccactccccagagattctgattcaggtagtttggggtatagcccggacagcagggttttaaaagtctccttaggactagatgattgaatgtcctccttcaaatactcttctgtcgtggagctcttacttgggcacctgctcagagagaggctgttgtaaagcagtgaaaagatctgttcttggcatccagcagacctgaatttgaatcccagctcatttgctcctggccgtgtgacctttcaacttctctaaacttccatttccctactcttggagaggaggctaaaatcccctcccactactcaagagtttctgcaggtagaggtggtttaggcactgtacacatggaatgagtggtgattttattttttattttttattttttcttgactaaagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttggtgagtagaaatatgcttcctgccctgcccgcagtcctgttattccctccacctgtgctggggatgtcagggaaaattctgtagatgcctctccgagtcttcttgagccttgattttcacattgatcgcgtcttccttgttttctgtgtttgtacctcatctccaccctggactacgagctccttgacttcaggagctaaggctgagtcctctcctcctcaaagcacagctcagcacaggctgggcccagagcacacttaagtgtgtttgcagaaggaactgaaatttgggagggcacaagtctcgccgggagtattttcctcttctgaatacccttttctgaactcatagcgtcctctccaggtcacacagtctagatttagccccaaatcccaaaactaccttccaataggactaccaaaatctgagcctaggagacttcacattgattttaaggtaaaagttgaaaatgtcaacttcatagtaaagtaaaagtagggtatattaatgtaatctcaattaaaggcatagtttgtttttttctaaaaggaaaaattattatgaaggagacattatcaggtaattttaaaaaataaaaaaattaagaaaatgaaaatatcacaatattttttgataaataaacacttatatacctatatgaacaaataggtatataagtcaactgaatgaagtttgagcaatcatgatcttacttgcagatgccggttgttcacaagctctgtgtagttattgcttatgtatattcctgctggctgccaaaaaagaatttgatatagcattcaacaaagggagcatgactgacaaggctataggaaaacaagagggggaaaaaaaacaagaaaagcagtaggtctatatcattaacatgaatgatgattatattgagccctgagtttcctagaaccaagacagcaggaagccaagccaagttacattattcttatcacagaagggaaggaagcataatgagtttgaaaaaaaaaaagaaaagcctctttctgggactacattgtgaaatgaacttgtgttttaaaggacagcatcttcagtgagtttctcatcagattcaaacctgctctacacaatggtttccaaccctcgataaaatgcaaagagcctaatatgaatgctccactcaaagtatgtcacttcctggtgatttatctgaggccaggtcactacctggaagccctcgaagaacagagatgagtgtgtaggagtgaatgctcaaggcaggtgtgcacagaccccacatgcacagataaccacaggattacacacacacacacactttagatcgagttattaaattccacaaacatataccaaaattctataggttcctgcttgtaaggatgtcacagcccaggagctattcattcattgctcactgcaaatgccactattttctagagcctcgggtttagaaaagcccattttttaaaatgtgtgcagagtcttggtttatcagaagtatccttacttgaaataaaataagaacaaacacaaataagaatcataattattacatcatctcacagatgtcatagctaaactgaatggttggagaaggccagcagctgtgatctggctgcagtaccagcacggagaagccttgcgtttctattctatatgcaataatctcatatttgtttccccctcagttaagtttcttctgtgccccttggctcctatctctgggctaacccagtttttgtcctccaatggcatgatggtatggaggtcttgtttctggggatagaggctctagatgagcagaggtcacaggtgctgcagggggataccagcatcatctaggagttggacaaaatggcctttgaaaactctcccagtcctgtgaatctgagagtccaaaattcaggcctgactcccatcaccaagaactttcagaggccattgtaagaatgtaggatggtagaaccagaaggacttagagcttatccctccagttcccttagaaagaaactggagcctggggtgggggtagggggtctaggcagcagctcagtcaggtcacaccagctgttagtgacagcaagcattttctgggcaacttttgtgtgcctaggactgtgctaggtgatatcagaggtagcagaaaggctacctctgactgaagaagctttataaccttttaggggaaaaaaaagactcaaaggcatgcctaaaaattcaagaatgcctacaaattctatctaaacaaagtgaggaaatgatttattgagacagaggccagttaggcaaagcatgctggttggggatggggctttagccagccttgaaaggaagagataggttgatggaggaggtctagaggcatccctctgggggttctaggagtattaggaagtagtgctgggggtacaaaggagagacagaaggatctaaaaggattggaggaactgttaaaaggagttagacctaggaggaaaaatgagttcacaaagtaggaagggaagggcattccaagcagagggaacagcatgagcaaaggcaggacagttgaaagtatatgggatgttcacaaggaatggggctgggtaggtgtttgggtggctgcagcccaaggcctttaatgtcaagctcaggggcctggcgatggaagcaggtgggaagcagagaccgtggcagtttcctggacggtgatgccaggtgataaaattgggcctctgggttaccccagggaactgtgggcagctgctcccttggggtttcctacagaaggaattagagatgaatcatctcagtgattacagggaacagagtgctacttggtgatgtaggatctctagctttaaaatgaaatttgcgcccatctgctaatttttgtaagagaaatgtttgttatggcagtgcctcagcttcctcctgactttacaacagattatttgcatcctacattaatgccgcagtgaagcagacagacttcatgttttccaactgaatatttgtatcgtaaaagcctcctgccagctcctcctcgggactgaggctgttagcaggcctggcagcagggagcgcagattgggaagggagcaggcctctcaggcctcctgctcattctcacctgcctctgctggctctttgcccatggctggggcctctgcagtacttgggctcctccttgggggacattgagtccccaaggctatgaggacagcgactggctctgcagacaggcggtatgcccaggatgcatcctgaccagtgcgtcttcggtcctccccaccctgggcaccaagctctaaacagagcgttctgtgagtgcagggtgccagggaggagccgagctgtggatcccatctgcgttttcccacagcaatacctcagatgactgtcatctccacactatttatagcaaagagccaggccaagcatggcactcaggtcctctaaatctgccactgcagctctctccacttagcaaaatctgaattgcagcctgtgagttaagacagttgtgtgggttggggtatcgtgtggagggagagtaacatgtttaaaagcagaaaacatcccttcctgggagtcaccattttacagtattctcagggaagacctttgcagcaagcagcccagacatagcacactgcaaagcaatttctaaaaaaaatgtattttattgtcaattgacaatttgtaattgtatatatttatgtgatacaaagtgctgttatgatttatgaatacaatgtggaaaaattaaattaagtgaattagcatatcatcacctcaaatactttttgtggtgagaacgtttattttttagcaattttgaaatgtataatacactattattagctatattcaccatgctgtgtaacagagctttataaaacaccttattcctcttgtccaactgagatttttgtatcctgtggccattatctccccattccccacccacagcttctgtaatgacagttttactccctgcttctatgaggtcaattgttttagattccacatataatttgtctttttgtggctggcttatttcacttagtataatgttctccaattccactcatgtggttgcaaatgaacaaatttccttttttttttttttttttttaaagaaaaggctgaatcgtactccattgtgcatatatcccccagtttctttatccattcttgttgatagacacttaggttgattccttattttgggtattgtgaatgatgctgcaatgaacatggagtgaaacatcttttcaactgattttaatattttgggtaaatatccagaagtgggactgctggatcccaaatcagtttcatcatagtcccccaaacctatctcagaaaaggcagccaggtacggtggctcacacctgtaatcccagcactttgggaggccgaggcaggcggatcacctgaggtcaggagtttgagaccagcctggccaacatggtgaaaccctgtctctactaaaaatacaaaaaattagccgggcatggtggcaggcacctgtaatcccagctccttgggaggctgaggcaggaggatcgcttgaacccgggaggcagaaattgcagtgagccaagaccacaccattgcacttcagtgtgggcaacaagaaaactccatcaaaaaaaaaagaagaagaaaaaaagaaaaggctactcctttcctcacagccacccaagccagaaatctgggcctgttcctagatgctgcctccaccccagccagccagtcacctccttgccaatcccagtgtcctgccgtgtatgttgagccctcgtcacagttatctcctccaacatcctcaggcccccagctcctccagggcaggcacccctggcactcatcccaagtctccttccgaagcttgccttgtcacccctccacttagaaccctcacttgcctcccattgctctcagtcaggccccttgaaatgactcccaagtctcttaataatagctgactcttacatggcacttactgtgtgttagagactgttctgaatacttcccatctcactagctcatgtagtcctccccacaaccaggtgagacaggtgctattgttatccacactttacaagaaggaaacagaagtctagggaagtaggtaattaacattacccacaatccgtgggcaggaccgggatttgaattggcaatgtggctccagtgcctgggtgctccacattgggagatggtcccatcaggaggtcgtctcttgacatctccaacaagccatccctttgccatgttactaccattccaggtagcctgagtgcccccaagtgaccaaggaaaagcttacccttagagggtctttactcccaatgccccccaccttctcatcctctacctttttgttgtttaaaattcagctgacctgttagttgccacctgggaaggtctgaccacttcattctttatgcctctcatacctcagagagctgccagggcatctctaatacttcatatttctcaaacagtagttctcaaacattgtatatcttggttcctgttatactgtgtctttacttctgattcttgtgcttggcacacagcactcagtacatgctgccgaatatttaaatgaatagaaagtgctttccaaaaacatgatggaaatgttcaaatttggcaagaagtggcagaggagttcaagcagcagatggaggttggtccggacgactggagagcccttctggcattcacaataaaaggagtctctggctcttgcaataagcagtgaagagttttttaaagaaagtaaagaccagacagaattgaaggaggatattgggagacccagcttttactcccagttttgtgacttattcgtaacttggaataagttacttccctctcctggtctcaacttccttcatcattaaaaagggaaaaaaataatacctgaataaatggatgcctttcccttctctccatccagtccctgaaaaagccagtgccagggggccgggtggggtggctcacgcctgtaatcccagcactttgggaagccgaggcaggcagatcatgaggtcaggagatcaagaccatcctggccaacatggtgaaacactgtctctactaaaaatacaaaaaattagctgggcatggcagtgcatgcctgtagtcccagctacttgggaggctgaggcaggacaattgcttgaactcgggaggcggagactgcagtgagccaagatcgggccactgcactccagcctggcaacagagcaagactccgtctcaaaaaaaaaaaaaaaaaaaaaaaaataggcaagccagtgccaggggaaccatgcacacacacacacagatccggcccagtggacacaatgagggcaagtaatggaaaataacccccccaccaagccatagggtcctttctgttccctcaaccatgggccagggacttggatttcagtcctggctctgctgccagctctcagggactggggctcttttcttctgcagggagaaggagctaatcctccctgtgagaatcagatgcgatatggatatggaaaccctacccacacaaggctcaagtctactgagggaggcactggactgaggctcaagatgagtcaaaagtcttggttctagctgggtgcggtggctcatgcctgtaatcccagcactttgagaggctgaggcgtgggggatcacttgaggtcaggaattcgagaccagcctagccaacatggtgaacccccatctctactaaaaacacaaaaattagccgggtgtggcagcgggcacctgtaatgctagctactcaggaggctgaagcaggagaattgcttgaacctgggaggcgaggttgcagtgggccaagattgcgccactgcactccagtctgtgtgacagagcgaaactccatctcaaaaaaaaaaaaaaaaaaaaaggcttggtcctgtctggtactagctttattgctttaagcaagaaatataccctctctgccatactttcctcatccataaaatgggaatggtaactaacattccagcagcgttggaggggctccgatgaggcaatgaggatggccctggtgggcatgcctgcacagctactatggagatgcttaaaagtctggttcatgtaaactctttggtcacgttgagcaaacctcttgtgctctttgggttttggtttttgtcccctcacatctacccccaagaagttggacattctgatcatctaaggaactgggctggccccacctcccttgtgggtctgctttgtatggccagtgtcatgcacaagctgatttggtttttgttgcagctcgtattcatcgatctggtggctgcaggtctaccgcctcagcttgggaacctgaagacatctaagtatagacggactttttttccctccaccatagcttcctgtctctgccaacaccagcaggcctctcgactgccacctactggctctacagacttctttgacctttctcttgtggctcatagagcttgctgcttggtcttatctgcagacactacaattaatttcaaaacactctcccttgttacaacaaacagagcccctcctgcccctccctgcatcctcatcatcctttaagctaacgtctccagcctgcaacctcctggctagtgctttcctcttcatggcatttaactactttgtcacttgaacagtgttgagcataactgtcttgcccccggggaaaatggcaaggttaaacataaggggatacagatactgcagggtaatctttcgggtggaaactctcgtttatataggcaggaggtaggccaggagctcccagacatagctgggggaaatgtttccacctggttaagaccctaatctcattaagaagactgactaaacttttaactcttatctgaacaccggagtaaagatcttcaactggagcttctgtaagcaaagaaaatagccgacttataacgtgggactgtgtggtcagccacttagcagatatctatgaatgaatctccactaccacagaccctcatcaatgaacactgacagactggagggctgttgtacaactcacacatactgtcctttcaaaacaacagacttcagactctgttaacaaaccaattagtgcgaggtttcacagtgctttctcagcaacagtgctggtccctggtctacagggaaaagtgccttatatcttatctccattcctttccagtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttattaaccctccttggaattttgaaaacctcgattaaagttgccaaattgattactggatccagaacacaattttcccctcagaacagatagacagactgaagccactgaactctgccaggagtcaacatgagattccttttgctggatatgcagaaatgataggaaaaaaaccaatggtgaaatttcaagtttcaaaaaccaacctttcattaccaatcccaggcaacaaacatgtccctgagtgttctttaagaacatttgggatttatgtacaatttaatactggagttagaactttttccttattgaatgccaaccttatgatggatgtgaaaatctacggccaaatacttttgaaaacacctttctatattgcacagtgggcaaatggcttatgtgaggtaagacactagagggataaatttccagatcaacatggctatggtatttagtaatggcccagcttagagacttcagctactgatctcatcacttattagacaaattgctgctgaccttacgcctgtatattaagcctccgcaggatgccggacaatggtgaagaaactccagatatcaaggaattgggaaatcctggccaaaccaccccaagatgattacactgaaatgtagtattagtactgctgccagatctctttttaacatcatgtgcgtctcttgggatccagcaaaagtgttaagccacaatgcccttgtgccttttaatataccacagtgccagttaaactaatatttttgtttgttgcttttgggagttattttcattagtgatttcagcaaatctcatgataaaggacaaggtcaagaactccagagcactgagcagagaggctggtgatgaaaaggtgaaggcctgcgcactgaactgtaaggcagtgggcagtacagggtaactggaggcggggccagggcctcagcgctatggaagagtgtccactgaggctgcacatggcccaggagtggcaccatgttgcagggacaaccatccccatttggcttctccttaaaacacaattgcagctgcattctgcatcgctgaaaactgcaatataatattaaatctgttggtctatgcatggctgcgtatgtgtttcttggaacctgtgtgacagggacatgtgcctggcacactggccagaagactgggcagccaccatggcagtgctggatgacctcagtaagaatgtgtcatgtattccaggtgctgatctaaaaactgtggctcaaatgtcaccgagcttatatgaagctcccagagagaacatttaaaagctcagagagtaagtgctggggaaagcagagctatcagaggaaatctctcatagaaacgaaaccaaaccaacagaaaatgaagaaggccacatctttaaggccacctctgcctctatcagatgagctgctggtctagatcaggggctggcaaacttttctgtaaaaggccagacagtaaaaatttccgattttgcaggccacatagtgtctgttgcaactattcaactctgccatagatcatgtgtaaaggaatgggtgtggctgttcaataaactatacagttgacccttgaacaatatgggtttgaactgcatggctgcacttatatatggatttttttcaaccatacaggttgaaaatacagtattggcagggggcgaaacctgcgtacatggagggctgatttatcacatacgtgggttctgtagggcccactgtgggacttgagtatgcattgggtttttgtatactcaggcgttctggaactatcctccatgtataccaaaggatggttatttctacaaaagcaggaggtaagcccaatgcacagcttgcagattcccctcaggcgagagacagaggttaagggtagatggcagatgacctaagtggcttgttttaggaggccactcccagggccacagctttcatgtgtttgccaccagggtagaaggtctgctgacaagggcaatgactactaacagccccagctgcatggaacagaaagggcatatgctgtggccaccaggctcaggctctatccctcagcagctttgggatcccatgcagctcacctattttctgtgctctagcatcatccaaatcagaatgtctcaggtaagtggtagacaacgtgactcctcccctcccgctgtgaagtgtagacggctgccacggtggcagcggccagaactgaagttcccgatttctctgtttctgcagtcttgccatgctttctctgtatagtcaccccaaacctacttttaccgagggcctgggaaaatgccaaaggtgctgctcacataagcactggcccatcctcatcagcatcaggccctggctctgggctcacaggctgtcgcacatgctgcaagagttccctaggtatgcgtggccgtcgggctgtgcactcgcattcctctttaaagctgtcttgcatagggcctgaaactttcctgctccccttgtcttgacatgtgacacaacaggctgtgaatccttgtccttgacaggcagggcaggtcaaaacgagctggcggcactggggagtagagcagagtttatactggtcccagcgggctccacagtatgaacactctggggaggaaggaaaagccatcattataaacacatacattcacacacacgtggacaggcattgctccctttgctgactagaatctcgtagatcctgtggaacccggggaaggtttccaaatagtaagtcttctgtcttctagcaacaacaactaaccaccacccccaccacccagcttatttttttgtgggggtgacttctggtaactgtctgcttccagtatttactgactttttttttctttttcccatctagagaacaggtggtaactagatggtaatgaaagtttctctctctcaccagctattccaaagctggccaactacctcccaacccccttgttaagtggtcttttcctctttgattgttcccttttccaggggggacaacacacctaaatacaggcgataacccacctacagtgaacatgcgcagtccacacccctctccccgaggcctgtgtctctcctgctgttgcta

SEQ ID NO: 15348 - DNA, 134987 bp, Human
cccagcactttgggaggctgaggagcttgggtcacctgaggtcaggagatcgagaccagcctggccaacatggtgaaatcccgtcctactaaaaatacaaaaattagccgggagtggtggcatatgcctgtaatcccagtagctgggaggctgagacaggaaaatcgcttgaacccgggaaacaggttgcagtgagccgagatcgtgccactgcactccagcctgggcaacagagcgagactccatctcaaaaaaacaaaacaaacacacacaaaaaaccaaaaataaataaataaaatgatcacttctgaatactgatctaactaggggttgcagggtgggctgatatagggagaaactggagagcaaggagatcactaaggtccctacatgtccagaaccaagatagaggtcttgaactaggatggtggcagttagaacaacaacaacaaaaagtcaattccaggctgagtgcagtggctcatgcctgtaatcccaacgctttgggaggctgaggtgggagttagaaagcagcctgggcaacactgcaagacctcctctctaaaaaaaaaaaaaaaaaaaagttagccaggtgtggtggtgcccacctgtagtcccagcaactcagaaggctgaggtgggaagattgcttgagccccaggagttcaagcttgccgtgagctacgattgtgccactgcactccagcctgagcaagaccttgtctccaaaaaaaggtcaattccactgacttttctaaggtgtacaccatcaaggggcagctccatctccaggccattggctcatgagacattctgtagtcagaaggctagggcagattgctttgagcaagcccccatggtggttctcactcctacttctttgggtatatgcccctctgtttaaaaataaagttaatatgcatttaaaaaaaaaaaggagaaaaaggtcagttccagaaactgtgtgaataaagcattttacttgctttttctattaatctataacatatgttgattttttaaaaagaatataagagctatgcaaattggagcttcaagacaacttcccatctccctaggaggagatggctgccctaaacccccctacatagaaatcatcccactgcttgggcttaaacttgatgttggggaaatgaaaaatccaagctaaggccgaagcctggggcctgggcgaccagcagaatgaggaccactggtcagtttcaggctgaggtgcgtcttccaggggacaatctctagctggcccttaaacattcagacttcaagctctatttacagcataaaggtgtttcaaaagacgtgatacaaataactgcaaatgctctgcgatgtgttaagcactgtttgaaattcgtctaatttaagatttttttttctgacgtaacggttagattcacgtttctttttttttaagtacagttctactgtattgtaactgagttagcttgctttaagccgatttgttaaggaaaggattcaccttggtcagtaacaaaaaaggtgggaaaaaagcaaggagaaaggaagcagcctgggggaaagagaccttagccaggggggcggtttcgggactacgaagggtcggggcggacggactcgagggccggccacgtggaaggccgctcaggacttctgtaggagaggacaccgccccaggctgactgaaagtaaagggcagcggacccagcggcggagccactggccttgccccgaccccgcatggcccgaaggaggacacccacccccgcaacgacacaaagactccaactacaggaggtggagaaagcgcgtgcgccacggaacgcgcgtgcgcgctgcggtcagcgccgcggcctgaggcgtagcgggagggggaccgcgaaagggcagcgccgagaggaacgagccgggagacgccggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtaagcgccgcggctccgaaatctgcctcgccgtccgcctctgtgcacccctgcgccgccgcccctcgccctccctctccgcagactggggcttcgtgcgccgggcatcggtcggggccaccgcagggcccctccctgcctcccctgctcgggggctggggccagggcggcctggaaagggacctgagcaagggatgcacgcacgcgtgagtgcgcgcgtgtgtgtgtgctggagggtcttcaccaccagattcgcgcagaccccaggtggaggctgtgccggcagggtggggcgcggcggcggtgacttgggggagggggctgcccttcactctcgactgcagccttttgccgcaatgggcgtgtgtgtgtgtgtgtgtgtgtgtgtgtgtgtgtgtgtgtgtggaggggtccgataacgacccccgaaaccgaatctgaaatccgctgtccctgccgctgttcgccatcagctctaagaaagacgtggatcgggttctagaaaagatgactccctgcacgcccctccctgcacctcccgagcagtgattccgacagggccttcactgcccctgattttaggcgggggccggccccctccccttttcctccttcagaaacccgtaggggacatttgggggctgggagaaatcgaggagatggggaggggtccacgcgctgtcactttagttgcccttccccctgcgcacgcctggcacagagacgcgagcagcgccgtgcctgagaacagtgcgcggatcccactgtgcacgctcgcaaaggcagggttcacctggcctggcgatgtggacggactcggcggccgctggtccccgttcgcgggcacgcacagccgcagccacgcacggatgggcgcggggctgcaggtgcatctcggggcggatttctttctcagcgctcggagcgcagggcgcccggcgtgtgcgctccctgccggaggcgcggggctggcgcgcagggctcgcccctcactgcggcagtgggtgtggaccctggtgggcgaggaagggggaggataggctgtgcctcctcccactcccgcccccagcccccctttttttccccctcggaacgcgaggtgccatcttttttcggcgtgtcacgtctttacggtgccatgccaaaccgggtggccgggcttcataggacagggcggggcctggcattaaagggagggggacaatcagcgctgaaatcttggcgttttgctgctgcgggcgtgagcactgggggcgttcgcccagcaccttcttcgggggctctttgctttgtctgtagaggttacgtgatctgcgctcccagccctggtttctggcttttattctgagggtgttcagtcaacctcccccctacgcccatgcgcctctctttcctttttcgctcctcatttccgagcccattgttggatctcgaggcttgctgggttcgatgaactcgagtcaaccccccgacccccggcacgcatggaacgggcgtgaccgcgcgcagcctcgtctcggagtctgccggcgccgggaagcttctgaagggatgggattcgagtctccgtgcgcgctgcgggcggcggcagagggatctcgcccctccctacaccccaagtgtcctgagggccacgccacaccaggttgcccagcgagggacgctggctacccatccggggatgggtggggagccctggcggggcctctccggctttacgccctgttgcttcgcctggccggagaatgtgaggaaggggcataaggttactggtgcttcggccacacccatctttctgagcccactggactgggcgcagaggggggattgccatggaaaccacaggtgtccggagaggggatcttggggctggcctcaccccttccctgcggagattggggaccctggggtagggggagccgcgcccagtcggcctcctggaggacacgggaggaagccccgaacccccgcgcctgaggctgtttctgattggcccctggaggccgcagacacgcagataggcggccctgggtgtatttttattaatattatgtccgtactgattaatattatttatcttaaataaatttcacccgtgtccaagttcaccgcgcccccaaaaccgagtctggggcggcagggggaactcctggccaacgaatccatgcctcgccctcctgtgatgaacctggtacgcacggttttctggttaattctatcgctgaaaactggtgcggggggcgcacttctgagacggaagagcatctaggagctgaatcctccacgcgggtcgcccaggttgatctgaatttctggggaatggcttggctgcccgcccgggaccaggccgaccctccttgacggtggcgtagagggctggagcctgggtactgcgaggctcctcgcatggctgggcccgccgcgaggggttgcagagcggctcagggatcgattcaagcatcgtctctcctccctcgcccccagacagagctgggcgcggggttccccttccagatggagcgagggtctcggggtggccccggaaaaggggagcccgcggccacggctacgtattgccatctcgcgagcagagatgtcacctcctgcctttggaggaaagggagcccggtggggatgagcgcatttagcccaatgctgggaacaaagcgcactccgcgcttctgcgatttcgctccattttgaaatgtgttggcgctttggtggggccgctgcggtgggcaaggccgggggcgctgttaatggaggaacctcagggggacggtccttcgtaggaaactctatcctggctctgcgcgcgctttaaggaaatggcttccctccaggacctcgagggatgcagcttttgcgcggatgacggtggggtgctgaaccagccggtgcgcctctggaaatgtctgggcacggatcctggggccatcgacgactcctccccattcccagcaggcgggagctcttacattccgagcgagtgacccctctcaccctctggcgctcacacacctgtaactccaaacctccgtctcagaatggtccaggctggaagggatgatgggggctccgacagcgactgcctagctcacccctctgcgtgctcaggctccaggctcagcaggaccaatttgagttctatctgatccccctcggccccttaactgacccatcctacaggagacagggaaatgtctttcctaccgcggttgattctggggtgtcattttgtgttttgtgatggctgcttatatttactgtataagcattgtatttactgtataagcattgtattataattactgtataagctgcttatatttactgtataagcatctccaaatcctccctctacgtaaacaaattaatggataaacagataagtgtatcccctgcccccacccctgctacgcaggtccggagtgactcttgaagctcatacattccttggccaagtttgcttctctaacagatgtttatatagcaataacctggcttggctcttgggttcacctttggacgatttggggaaggggcttgttggctttgctgggttttggatgagtgacagtccatgactgttcctgctggaagggcgtgacttttaagtggtttctaatatcaggcattgctcctccgacaggaacaaaagaaatggatactgcccataaattgttagaaaacttagaatcgctttgattgaggaaaggttagatttattccggttggaaaaagtggcctttctattaaacgtgccctttgaccctcatgcccttggaggtcggtgccagcctggagatgggataagattgtggttttccttctgcctttttaacatctgttgttacagtccatttgttgaaaatttaaagaaactgttttattccactttccctcagcatttatgtgtgtggtttcagtagctctgtggctatatgtacgaacacgtgttatttttccaattggacatgtgataattttccaactggaccttgccttctattgatgtatttatttagcatcttccttactccctccttgaaaaagaatcactcaaaaacaaataaaaacagccgtaggggcctaatacagtgctagacatacaagaggtattcggtccataccaaatggattttatccatgaaggataaatggggaaatacagtgggaagcgggtgggaaactgcgtttgactctgctctttcctccaccaccactttcctcatcaccgtgttcagagacccccaaagccccctcacactcccagaaacacccccctggccactcctaacttgccatgcccaggagttaggtgcttccactagtgacatggagctggcgtttggggggcacctcagcaggtgacgggaagagaagaccccagcctcaccagctgggctgcagcagggagaggagtcctcatgttccagcagggactctcagctgttttcctgtaaaaccatggttctcaactgggggccactgagatgtctagagagatgtttttgttttcacaactcggggagggtgctactgacatcttgtgggtagaggccaggaatgctgttaaacatcctacaaggaaggcacaggacagtctcctacatcaaaatatgacccagtcccaatgtcaccactgctggggttgacactggcactgctatcttaattacattcattgagtgtcttttaggaggccctattctaagtgcttgctaagattatctcatttaatcctcacaacacttccgctatgtagcaggtgctgttattatctccgtgatggggaaactgaagcacagagagggttagtaacttgctaaaggtcacagagccagtgggtggtggagctggttgcctgacactagttccctcccctctcagccacatgtgggtttacttggccattgtggactagtctgggaacccagatatgatctataacattgacccagtagaatattgattccaaaaccactgtctcacaaatgaatttttacaagagtctgtaatcggagcatgacccagaataaggttagggagatgtggagttaaagctctcaatttcttatctggccccgacacagagagcaaggcatttcactctacattggtgctctgtttataaaacaaagagcaaatatctcttcctaaggtccttaaacctcttcccccaatccagggtttctggactgctctgccatatgacggggcagctggtttgattgacccagggaaggctggaaatcaagactgggggatcaagacgtagattcagtgtggccaaggtcaagtctctgaggtttagggacatcagatccccagcttaggttctgtacctcggcaaggtgaaagcgttggcgcccactgatgaggcctgctctgagattgtgggtgtgggttgagttgggtgggcataggcaagtcctcttgtaagaatcttttggcaaagatgggcctgggaggcttttctcacttcctggggcccaggctttgcaataagtattccattatactgtggtaccttggggctacctgagaatcctctgtctcgcccctgttgccttgccaaagagtttgctgtccaagaattcctttcctgtctccaggtgccatgctcctgccacctctgccaggttccctgcctgcccagatggctcccaactgagtgtgaggaggaatttgagacaggttttgagctttctgggttctccagttaggaaactttctgtaagcatgcagatagaatgggcttcagcaaaatacaaactcgaacaacttccatgtatagtcccttaattttctttgcttttttcatatttcatcaggctccatgctgagcccaatcagggacccgatagaaatccaaacaccatgtcagcgagtccccaagaaatgcattttgtgccaaggctattcaaggaaggtttgggagcagctcaagggcagacactgttaccctcccccaggtccccagtgcagggcagtgttctgcatgtggaggcagtttggcctaatggttaaggaggtaggctctgatcgggcctcctgggcacaaatcccagctccctgctcactgtgagacctaagccatattgtttagctgcttggagagttttttgtcatccacaacttggagtatgatggtacctgtctcacgggttgccatggggttcacacaagctaacccggtactcactagggccaagcacatagtaactgctcagtaaatggcatcatcggcggtgtcctgtggatgagtgcttgtgattggctgaatgaccagaggggtctaaagatcctggtgatggaatcagttgtacagataaattgttacactgagtagggatcaagataggaaaagtcggcaactacccagctcccctgcaccaaactgggcagaagtggatcctctgaaaattgcacacacccatgtttaaatgtacacacagaactcttgccacaggcaagcggagatttgtcatctgctgtccctgcctcatcttcttcctgaaatccactccatgccaggaataaactgcatgctctccaccagcccaaactgacctgccttcccgccagccatcccgggcagggtgacctggcttagtacatcgggttcagagatctttccagtttactcgttgaataaaaagtgagggctgatcgagaaagtaatggcagtcagggaaggcgaaggaggtaaagaagagattttacaaatgaagtaattcaacagagtgctgacattggtaaactggcaaacagatttcagggtggttggttgagagtagagtagaaaaggattaaataaagcaaacttgtggtgtactgaatcttaggaattccatgtatccaataagtatagtcatttatgaattaataaattcggcctaagaagccttcttatcgcttaaatcaagactaagtaacaatatatcagttttaaaaagtcattatatcagaaaatcatttaaatgatacacatagatttccaagattttactttaaccgaaactatataaatgtgaatttgttcacccatcttttgacacagggctcaggtcttctcttggtgtctggatcagccagttgaaatttcttgtctgttttgcctatgccacattaataatgcactgtctgggtcctccgatttcagtttggattttgggtttacattgtggagtcatctgaatgcagaatccttcagggattttacttttttttttttttttcatggtctttaccatcccatttgatagtaaatattactcacctttatgaagtctttccaaaacattcaactaaattttcttaaaatcattgaatgatttgaagagcttattcctcagcacttttactccatcagcttgcaccttattttttaatctttttttgagacggagtctcgctctatcgcccaggcttaagtgcaatggcgcgatcttggctcactgcgacctccacctcctgggttcaagcaattccgcctcagcctccgccgtagccgggactacaggtacacaccataatgctcggctgatttttgtatttttgtagggatggggtatcgccatgttggccaggctggtcccgaacttctgacccaagtgatccacccacctcggcctcccaaagtgctgggattacaggtgtgagccaccgcgcccggccagcttgcaccttatttaggatatgtgattattatagcaagtctggtgtacatacaagattttgaatgggcacagatgacctttagtaagtgcttggctgtgataagaggcagtcctgactgcagatcaggctgtgtggaccccagccttgcatgtttacagaccttcatgtcttattcttacagggtatcagaagaacacctactggggaaacttataaattagtaaaaggtgggcattctccccgcccatcttctgtctgtctgccaggactagcacagcactttgaagtcattcacatagaatcccaacttaagagggtaaaatcctcctcaacagactgaaaataagtttaaattccctttgctatattaactcccctgaggaaagagtcttagatcaatgtccaacactaaaaacagttttaaatcagcaagtgagaattaaatctgaagcaattgataataatgtttcattcattcctctcctttggccccgtccaccctactgctaaatccaggcatcaaagagaagagggacataattatctctagtcccagctgctggttttccttccagcctatggcccagttttctgttttactgagaaggctggtgatgttatcttgggatctaagtctgcagtttcaccacaaaaagtccagggatgcactttcatgcttgtgtcctcctccctgggatagcaaggatattagaagacccctggctctgtaattgcttgtcatgtgctctacagacgccacagaatgccaagaacgaagtgctgggaaggacaaattcatggaaccgtgggacggtgctcctcccccagcgtaaaggacagctcctcctcctgaattggagccagcgttctaaatcatgtgtcaacagagttgtcctggatcggatccagttctgccattgatttgcaggtcatttcagtggtacctgtttccagttgttcttaattgaacagtggcaccaaactattgtcttgcctcatccccctcccatggcctgtcccccaaaaagagacttcttgggtaattaatcagggcaacatcaggcagtctgggcgcggtggctcacgcctgtaatcccagcactttgggaggccgaggcgggcagatcatgaggttaggagattgagaccatcctggctttgtgaaaccccgtctctactaaaaatacaaaaaattagccgggcgtggtggcgggcgcctgtagtcccagctactcgagaggctgaggcaggggaatggcgtgaacccgggaggtggaggttgcagtgagccgagatcgcaccactgcactctagcctgggcgacagagctagacttcttctcaaaaaaaaaaaaaaaaaggaatctctttggttttatatatattttttttatatatataatatatattaaaatataatatatatatttatataatataatatataaatatattatatattatatatttttatatattatatattatatatattatatattatatatttatatatttatatattatatatatttatatattatatatttatatatattatatatttatatataatatatattatatattatatattatatattatatattatatatttatatatattatatattatatatattatatattatatatttatatattatatatttatatatattatatattatatattatatatttatatattatatatttatatattatatatatttatatatattatatattatatattatatatgtatatattatatatgttatatattatatatatttatatatataatatattgtatatattatatatctaatatattatatatattatatatattatatattataatatatattatatattatatatatttttatatatataatatgtataatatataatatatataaaaacatatataatatatattatatattatatatatattatatatattatatatattaaatatattttatatatattatatatattatatatattaaatatattttatatatattatatatatatacacatatatatatataaatgaggccaggctcggtggctcacacttgtaatcccagcactgtgggaggatcacttgaagccaggagtctgagactagcctgggcaacaaaacaagatcctgtctctacaaaaggaaactgtaaaaattagctgggcatgatggcatgtgtctgtagccctagctacttgggaggccgaagcaggaggatcgcttgagcccaggagttcaaggctacagtgagctatgattgtcccatagcactccagcctgggtaacacagcaaggccctgtctctaaactttttttttttaattctatttatatttacatgtatttaaatgtgaatattcactacctatttgttgcatgcctgcattttttatactgggcttgccaaaaacccgaacagctttctactttgacaatgtatcagaatttaaatcagcaatatgttaataagccaagcaaaggttatatatgcaaataaaactgttgtctataacctcctgttacactggggcacagcaaaagtcatggtgtagtcgcatgtgaacctgtccctttcatagctgctcattgccaggaaacatcaggaatagccatttggaagagtcatcagccctcccaccatccgttttctgtcttgtcttttccctatgagcaggggaaattccacgctggccccaatccccagtgcagcggctcagcctctgcctctgctgctggtccccatgaggccagcttagaaacggaggattttgcagaacatccctaaatccgcttgaataatgaagtgatcattcataaactcacctgaaccttattaaaacctatttaatatttttcctggataatcctatagggataacttgcctcctgggcttctctccaccgggttcagttcttcctttagtggtgaagttcctcccttcttagcatctcaactgtgcctgagaaaaggccagtggcggctgcactctgttccctgtggagtgttaataaagactgaataaattgaaataaatccctttcaatgtcattaagtgctataaataatcatgaaccaatgttcgatggctgatgagaaatgcaagaaaaaatttttaatcagtaggattcataagttgacaatctgggccaagttaaaaaaaataaaaataaaaagacttttaaaaagatcttatcgtttgttaccagtaagactgaattccagaagcaagctactccctcatttgtgggcccctgttatcactggctgcttagggttgccaagccctgaattcatttgtcaactaagagatttttggccaagattaagatttcccatgcctccatatttccatctgagaaatggagattatactgtcttccccctcagaatggatgataatgtggtctctcttctgttcgcatagtcatagaactgaaataaaacaacttaagagaattcctttgagcttctcagaagtgctgcagggctgggggatgcctcccaggagccgcagtcaggtgctgatctgaagtctttggtgggctgactttagcctgacctgaaatagtatagctgctgccacctggctcccttagcgtcagtcagacggtgcagctggttcctaggggtgagggctgagccagcagggtccgtgcccaggagggatgcatgggtggccacagcccagcctgcactgatcttgtctgtccccttctttggaaggaaggagccccaaaccagggtgcaagacagtgggtgggggtgccttgagcatgacctcaagtgatttccagcccctgccagtgctgacttctctggggaagggctgggacttccttctgggctcaagtcacgacccttggatggaatttcctgggagcttttctgttttttctggagttttcagttttttcctaaccagacagggacttggtacagaatctcatattctaattatgcctaggagcagcctctccccaccactcacagtgtttagcatgtgacaggaatcgattaaggcatgagtgattaaattaaagccaggcattgacttggatggtgtaatattctgacatctgtttggtgtcaaaggcacggggcaggcgcgttaattgaactgcttgcacctggcatttgaattgagccagagcggggctaaagtcagtttgccttcaccctgtaaatggagggtttctccggagcgtggatggtgggaggtatttcagggtgtatgcataacccccaccctgacaatggcccatctcttctccagcgtggccaggtttgagtgccagtcctgggtgtccagtggccccatagccttgcgttttagtaaaatgctgcccccattaccacctggtctgtgcacttcggtcactggaatttgccatcttccagtcccgaatgtggcaagccatggagccttaagctcttctccctccacatcctggaacagacccgccagtttcttccaggcattgcctcagtttgcccctctgtttccagtcacactctcaccagcgataaaatgattttagaccttatcatctcaccctcggatccttatggaaacaataatgagttgttccctgtttcaattccaaaattcatatccaatccgttttgcatgccattgccaaattcctcccagagcaaccccgtcacctgccctggccctctccaagtgtggtcctgccatgggcatcgcctgctaagccaagctggcctcgagctgcctgcccgggtccccacaccttggctcacctccctgcccagtcccgcctcctgccagcctgccctgtggctccttcatagatgccgtgctctttctgccccttgctcacccatggcagccttgcccctctctccctgccccaccccctatttaaattgacctgaccttcctcagtgtccatcttccccgaagctttccccagccttggcactcaaggtccagaggctacgcgtttcctctcacctgtggcagcgccgtgctccccagtgcctcacagtttccttcttgcccccgcttcctgtgtaggactcatctgcccacaggttgcacgtcctgtgagggcaaggactgtgtcttatgtgactttccttctccagtcacagagctgggcacatagatagctcaaaaccctctttattaacacagttggatgttgagaaatcaaacaggccaatgtcaaatgagctctccttatttaaatcaagtcagttctccacctcctagcactcagttccagtactctatatacatggaaataataaaaaacacatttcctttgaaacattctataatcgttcctttgccctacttcagaccaacttaacgcactccccattggtccaaatgagttttgctatacgaagatgctgataataatagcagcagtggattattctgctaaaaccattgcctcgttaatcctcagtcccgaggtggggattattatcctcattttgcagagaagcaaactgagactcagagatttcacagctggggagggagccagctcatccctctgtccaggcccaagctctctcccgcttgccttcctgcctctgcaacctcagagcatcccccatctggttctactgcctgtgctagtcgtgcaggagccaaaagacacgtctttagtgctaaggactggagaagccatgccctccagcctctgtgaatgggtcatatgtaacatgagcctggagaaattatttgaaaccaaaggcaagcctctaaaccaggctgctgcttcatggcgccggtgacggcagaaccaaatttagtgctgtgggcaggtccacacttatcaaatagagaagctcatttttcttccggctcacatcaagcatgaaaaatgttcacacataccccacacacacacatgctttccggaggggtccatgtggctagaggctggaagatgtggatgagaggagcctggcaggtaagcccagggaagatgacattcagcttcccagacagcatctacagggagaaatttaattaaaagtggggcggtttccctgagcaaggcagacaaagtcagccctctactgttaagaaaaagggtcacagtgagaggggaggtgaggagactgagtctgtattttctagtctgttgggctacactacctgatcccccttcctcaaaaatccactttactttccccatgtctacaccaatgtggttcacactctgggaccaggaaaagggggagtgatggggaacagagaagggaggagctcacacagctgaggctggggttatgcatatcgaattacttagaatttgcaacctcacagggtactttcatggcgttgaaatacacttcccacagccaccctccctctaactaaaagcaagagtcatttctcagttctggtcttgcctcccacgttctcctccacatttaaaaaaatccaccagctacaaagtgaagataccatatgtgatatcccaccctagtttctgttttatcagggtttggagcaggtggagcaggcagagggatcatttcagcctataaattgtattaagggtgagtactgagtcattcttcaagaaaagttttagaagcatccaaaactgaagggtggagccacctggagacagtatcatcagtcctggccccgagcatggcctgcataggcccccatggatcccagcgggagctgcagagtgcgggcaccttggcacacagccctgagtgcaaaattaggagctgggcagagggcatctctctgtcgccattgggcagcccagggcacactggtcatagccttagaccacgaacaccctgtgcccgggggacagatgcaaccagtgtgccctgggctgcccaatggcaacagagagatcgacacctggaccccatgtcacggggactccactactaaggctcctaagactgccaccttccagtgggataagccctgcctcctactgggcccacaatgtgcagagaacacttgggactacctggctttctggatacacaaatattgatccaatctggactaattagaaggtcagtcccaataacaaatcgaagtcagctgggcgtgatggctcactcctataatcccagcactttgggaggctgaggtgggcagatcatttgaagccagaagttcaagaccagcctgggcaacatagcaaaaccctgtctctactaaaaatacaaataattaggctgggtgtggtggctcatgcctgtaatcccaacagtttgggaggctgaggcaggtggtcacctgaggtcaggagtttgagaccagcctggccaacagggtgaaaccccgtgtctactaaaaacataaaaattagccaagcatgatggcatgtgcctataatcctggctactagggaggctgagacaggagagaatcgcttgaatccaggaggtggttgcagtgagctgagatggtgccactgcactccagcctggttgacagagcaagactctgtctcaaaaaaaaaaaaaaaaaaaaaaagccatgcctggtggagcactacgtgtaatctcagctatttgggaggctgaggcacgagaatcacttgaacctgggaggcagtggttgcagtgagctgagatcgcgccactgcactccagcctgggcgacagagtgagtgagactccatttcaaaaaaataataaatctgagtcactttaatattgttatttggatgtcaacctctaggtgtttgagacaggagagtgatatgggggcactggaaacacacaggcacggggtgtcctcacacttgggtagcccacacgatgtgatttcagggtgctgggaggtccccccactccccaaattactaacaagtggatagtactttacagtttatatgatctcatttgattcttaacatgagcctgtgagtgaaaaattccttcccctcttctacagattaggacgttgagattcagggaggttcagagggattcagggaagtcaagtggcacctggagtcccgtggctaatttgaggccggtaggggattcgaacccaggatttgtgcttcttatgcctgggcttctgctccctggggcatggtcttccccctagctttcccattcactgctttagcctaggggtcctaccctttattaaactgccagtgcctcactgcttttctcccccaaagacaaaaaaaaagtgtttttgcttttgttttgtttttcatgggcagagacctggaatttcagcttgagaatttgtgccatatgataaataaatcaacagatggctttttccttaaaaaaaaaaaaaaaaaaaactaagatgtatttgcagtgaggcataatttgtaccaaaaagtgctcaccacactgtagtcatgggggcaggaggcagccgcgggtgaagggagaaatcttggagtccaggcagcccccttctgggctgaactggggagctgggggtgctgccagccctgccaggttctcctaggaggcggcagctcatatggctgtgggaggaggcagagggagcctcatatgcacccacatttccagggatctagaagacagaaggaggaaaaccaccatcatgttaaagcagacagttaggtaacacatcctgtaatacaagttattttttccacatctaaaggctaaaaatagttgttagaatttaaagataattggtaaatgagtttctatccttctagtttcacatcaaatggaatcatgctgccttcacatcactagtgcccgttatttgtgtttaatttccacaatgttgtctaattccactctttgggcttccccagggatccagcctccctcactcgcccatcgcagggagatgctttattcatctttgtgtcttctgtgccgggcatagcgcatggcacagaataagcactcagtaattgattcacgagtgaataaatggatgagtgggtgagttcaatattgactacaaaaaccctaaggccacactggtgagtggctgcgcctgtagtcccagctgctggggaatctgaggcaggaggatctcttgagcccaggagtttgaaactagcctgggcgatatagcgagaacctgtctcaaatgacaaaaacagggccaggtgcagtggctcacgcctggaatcccagcactttaggaggccaagatgggaggatcacttgaggccaggagtccgagaccagcctgggcaacatagggagaccctgtctctacaaaaaattttttaaaaattagctgggcatggcggtgtgcgcttgtagtcccagctactcaggaggctgaggcaggaggatcacttgagcccaggaaattgaggctgcagcgagccatgatggcaccactgcactgcagcctgggcgtcagaacgagacctgctctcaaaaaaacaaacaaacaacaaaaaaaaaggctttcttaaagagacttgagaacagaaaggggaacagatacataacttatatatttatttgttcatctttccaccttcctggagggtggaggggaacaggtctgtatttggagttttgaatgctaaaagtgggaatacatgtactgtttgccatgatctgttcaaaagttaagccaaatgccttagattctcctgaaaactggaatgccactgtaaactataagccccacttcaaagataaaagatcttgatgaacagggctgggtctgtggactgggcctctccccaccacacaaggaagggtggtgccagttgaaggaaaatcacttaaatccttgctgtctcctaataaggtgtggtcccaggtagggctgtcagaattagcaaattaaaacacagggcatctgtgaaaattagaatttcagataacaacaaataattggcataggctgcataatgtccctcaaagatatcaggtcctaatctccagaacctgtaaatgtgatcttatttggaaaaggggtctttgtagatgtggttaaattaaggattttgagatggggggattatcctgtattatctaggtaggtcctaaatgcagtcacactcatccttgtaagaggaaggaagagagagatggaaaacacagaagagaagacaatgtggtgatggaggcagagattggagtgaggtggccacaagccaaggactgctggcagctaccagcagccagaaaagtccaggaaccaattctctcttggagctccagagggagtgtggccctgctgacaccttagcttcaacctagtgatcctgattttggactttggccttcagaagtgtgagggaatgaatatctgttgttttaagccaccaagtttatggtcatttcctacagcagccacaggaatcaaaaacagtaagtatgtcccatgcaatgtttgtgacacacaccaaaaatattacttgttgttcacctgaaattcaaatttaactgggtctcctgtattttatttggccaacctagttcccaggcccaaagaaagaggcttttgaaatttgcaagaaagctggttggagctgtcagaaagtggactttgtaaacacagtaccaccgaaccaatttgaactgtactacctctagacaaaagagagggcagtcagacagttgttcgtgatttcttctttcaacagtcatttgagcacttactacaaaacagaagctatgtgtaagggtggaggcgttagctgttaatcaggacctccaggctaagtttctgtattagtccgttttcacgctgctgataaagacatacccgagactggggaatttacaaaagaaagaggtttaattggacttacagttccaagtggctggggaagcctcacaatcatggcagaaggcaaggaggagcaagccacatcttacatggatggcagcagacagacagggagagagagcttgtgcaggggaactcctctttttaaaaccatcagatctcgttagacttattcactatcaagagaacagcacagaaaagacctgcccccatgattcagttacttcccaccagatccctcccacaacatgtgggaattcaagatgagatttgttaccatatcagttaccaacccttccagataaatcacgtgaaatatcgccattaacagagtgagctcaggtggttcttcagtgcatttctgatacctgaaccttccctgggaatttcacagaccatcaggctctccaccctttgatagcaggatagcagggcccaggttctgcaggaggagatgttaccacaggcctgaaagggagggaggggcagatgctacaggaagatgctggctctggattcgctggaggagctttcaagggaagtagatacacactgtctccatcatttcatgtccatcacactctaaaatgctttggacaagaagcaaatgttaaagacaaatgtggcccattttcctgtacaaagagggctgctcccatgccaggctattggcactggtgggcatgaggcttctctgctgccctggccggggggttctctcactcaccattggctctctgacacctggagagaccaccacccttgggctttcatgatgctcacagaatccacactgttggagctttaaggagcctggatcaactggaacaggcagggagtactaggacagcccagcattgccccaaaatatccaggcctgataaaagagaaaaacaggtagctcacaggaaaaggataaaaaaaggaggagggatttaacatgaaaaggtgcttgatctccctcataataaaaagactgctgattccatccaggcaagtgacagaaaaaaaaaatttaatttaaaaagactgctgataaaaccacagcgagacactgctgctcagggatctgagggtgtgggcagccaggctgccacgcatcatgggtcggagaggaagaccacacccctggagcagagggcggctgatctgtcagatgccctttgacagcacctcagcttccaagaattaaccctttctatgtgagcagaggcatccatggggggacacactggtgaatcatctgttatgtagaagtctggaaaacatcaggatggaactggtgaaataagtgtggcctctgacggaatggagcggtccgtctgcactgctgcgggtgcccctcagatcctgtgggtcagtgagaaaagcagtgaggaacaaggcaggtactgtgtactgtcctctgcgtgcaaggaaggccagcgcatgcaacagagtccacacagacatagcctaactctggaaggaagaatgagaatgcagtttcagtggtggcctctggtggggagaaactgggtgaagggagatgtcatttccatttctctactattaattttgtattaccatgcttaaatgttactttttacctttttttttttttttgagacagggtctctctctgttgcccaggcaggagtgcagtggtacaatcatggttcactgcagcctgaacctcccaggctcaagcaatcctcccacctcagcctcctgagtagctgggactataggcacgcataccaccgtgcccagctattttttttaatcaagatggagtttttctatgttgcccaggctggtctcaagctcctggactcaagcaatcctcctgcctcagcctcccaaagggctgagattaaaacgtgagtcaccctgcccagccaattgctttttaaaaaagattaaatgcatgtatacgctcaggcatcagcacacttggaaaggatgaaaatatccggaagaagggttcttttaaaaggctcctcaagtgatgctggcaggcatgacgaatgtccctggtcacaaaagctctgatctggcctaaccctgtcatgttagagactggagtgcgtgtgtgtgcgcgcaaagtgtggggggatgggggtgagtgtgtgtggtgtgtaagcatgagtgtgtatgtgtgtggtgtgggggtgtgtgctgtgtgagcgtgtgtgagtctgtgtgtgtagtgtgtgtgtgaagtatgtggtgtgtatgtgtgacgtgaggtgtgtgtggtgtgtgagttgtgtatggtgtgtgcatgagcatgtgtgtgggcatgtgatgtgtgtgtggtgtgtaagcatgtgtgagtgtgtatgtttgagcatgtgtggtgtgttgtgatatgtgtgtggtgtgtgagcatgtgtgtgtgatgtgtctgtgtgtggtgtgtgtgagcatgtgtgttgtgtgtgtggtgcatgtgtgtggcgtgtgagcgtgtgtgtgcattgtgtctgtgagcatgtgtgagtgtgtgtgtgttcagcatatataaggcatgtaactgaacacagcactttagagggctctcctggagtcagagggggtgggtaggaggagaagggaggtgggctagtgtgctgaagtatctactccttgtcatagtctgtgacaacccagactagcccatgagccaccctgttccctgcatttccaatgagacctcggtggacatgttccctgaggtgaggctgactgatgtcatttgacgatcttgatgccaaatccttttatatcaaaaacaaccagaacactctcttttctcttagtgctttcacccagatgaccacatttcatcctcccagccactctgggccaggtggcactgctggtttgaaagggaggtctcccctggagtaacttccgtgggcggattcacaccctgcccacagtcctgtcccagtcagcccaccatggtggtctccggttcctccagaattcccgcttttcagctcatccccacattcccggagggactgagagcgcagccccagggccctgctctttgggggccgtctctacacccagagaagcagcaaggcattcctaggtttctctttcagatgcagaacttcagtgttcagagatgttcccactggtcctgagagggctcagttcagctttaatgactgcgctgttgcgtgtgctctgcagagggcgggtggcccagcgtggctgactgcagttttcctgacgtggagcccgagcctgccccgctgtttattaattaaggatcactctgcttgcagaaccctgaactccccagaactgtgaggtgggagaaccccgagaggccacctggccccacttcccacctgctgcccaaaccccctctctgccttcctgacagtcaccccaactcccagtgatccccatcaaccatctgacaaggggactgagagggaagagaaaggaggggcccaaagaggaaggtaaaactgtcgggaacagcccccaaatgtgtgacagccttcagtggagttgcccactttcccttttctcctccctgcaggacctcccttctccccagtcctccccaacttctgaggttacattgagaaaagtctgcagagaggtgccagcatcacaaggtgttaaggaccacgagtttggcattttaacagatgccagagccacttgagaaatgtggtaactaagcccagagaggtacagttaacctccccagagtcacacagcaggttcatggcaaagctggactagcacaggtgtccttcccctgcagatccccttctgtgccccacatcacctccctccagtgtctgggccacctggagatgggccctcagactcacccggccagaggtgccatctcatgggagaggtctggccaggaagcatcgatatttgagatcccaagaaatgaagacttggcctgtcagatgacagacttcggtcatgggaacacgtgatctgttttacacatgcgtcccctcagcagcagctttccagaacattcccactttcttctgtagtgagaagaactctttccctgcagcctcctgcccaactcctccttcagtgtctttgcttcagtgtctttgataaaccattctgctttgcagagtgcgagctctgccttgcagggttcgcatctgcctgtgctgagtaaccaacgctaaggtcgagtggtcggtcacctctcataagagctagggttgtctcatgctgatgactaggacttgccctcaaggagaaaaataaatcaaaacaaaagcaaaaacagcaaacatgcatctcttaaagaaggctctgagtccaggtaaatttccttccactgaagcagccaggctgaattcgaattatctttgcccctgcttaaaaactaatgcaaattttcctagagaatatccactaattcctggagggggcatgggcattcctgatgcccatgagaggaccatttgctcttccctcagtatgctaaataacagaagcgacatttgttgctggaaagtatcagtgaagttaataaggtttttcttgcccagggtgagggaacagttcccaatgacaaatgctgtatgggaaggggctgtagaactgccagcccctttggtccatccgtaaagtgaactctgtggatcctggaggattccagcgtctttttttttttttctttttttttaagacagagccttgctgtcacccaggctggagtgcagtggcacgatctcagttcactgcaacctccgcctcccgggttcaagcgattctcatgtctcggcctcccgagcagcaagactacaggtgcgcaccaccatgcccgactaatttttgtattattagtagagacgggggtttcactctgttggccaggctggtctcaaactcctgacctcaggtgatccacccgcctcagcctcccaaagtgctgggattacaggcatgagccaccatgcccagccagcatctttcatttttctgtctgctttggccctttcctctctcactgtcttccttttccatttccaaagtcagtccatctcactattagcacaaaaactgctagagcgcttgtcattggtcatctctccctgcacctggctggtctgttcttggccactgaagcgtttcccccagctgttgctttaatcattttattgttattatgccttacttaagaaatggatatgagatgcatttacctgtctcttcctgccactctgcagagccagtaagatgtggtggaaagggcccaggctttggaggagggctggctggggttggatcttggctgccccctactagctgtgtgaccttgggtaagtagctggacctctctgagcctggttcggaatcatagcacctctctttcagggctgctgtaaggaatagcagtggtgtgtataaagcagagcgcacagccagcaactggcccctagccacactgctgagcacctactgtgataagctgccattgtggtgtgtgaagcaaaggggaaacatgcctgctgtagtgagcttcctgtagggcaggttgtagaaccagaggtgggttccaaggttacaaagggactcttagtgtattagtctgttctcacattactataaagacctacctgagactggatcatttataaagaaaagaggtttaattggctcacattggctgggtgcggtggctcacgcctgtaatcccagcattttgggaggccaaggccggcggatcacttgaggtcaggaatttgagaccagcctggccaacatggtgaaaccctgtctcttctaaaataaaatacaaaaattagctggccatggtggtgtgcgcctggaatcccagctactcaggaggctgaggtggaagaattgcttgagcccgggaggtggaggttgcagtgagccaagatcgccccactgcactctagcctgggcagcagactgagactctgtctcaataaaaaaaaaaaaaaagaaaagaaaaagaattgcaagaaataaattattgtttatgagctatatggtctgtggtaccttgttgtgggactgggagtcttggcgtctccctgaccctgcctgttgctgcagcaccgctcagccctgcctgctccctacctgcctcccctcggcctctcctgcctccaccgggcccctggtgcctcctctagagacagtcctcctgggaccgattgtgttctcacttacacgaggcatccaggactacagataaccagaggaaggggcgccccccccgcctgccctcctccctggcatcctcacgctgcagaggtcagagcctcatcccagccccttacctgcccctactctgtggagaaccgtggtcagttcgccaggccggatccacgaacggccttgtggaagatggtgagctcacacccagagctggctccgatgaccctgtctcctttacatgtttctaccttcccctccctaccttcccccactgctgggcgcagagtggaggcagatgaggtttaaagctcagaagggcttaaacgggttggggcgcagtggctcatgcctgtaatcccggcactttgggaggccaaggcagaggatcacttgagcccaggagttcgagaccaacctgagcaacatagtgagaccgcgtctctacaaaaaataaaataaataaaattagctttgcagggtggcatgcacctgcagtccctgctactcagaaggctgaggtgggaggatcgcttgtgcccaggagtttgaggctgcagtgagctatgctggcaccacagcactccagcctgagtaacagaatgagatcctgtctcaaaacaaacaaacaaacaaacaaaagaaggcttaaagggggctccaggtgggcttggcagcacaaagctatgaagttctatcttagacacaagttctgttactgggcctttgcaggctggcctgggtacctggctgccatagacagggaaccttccagatgagctgcaggcgtggagcacaggagccagggtgctcttcctgggctctgtccacaggcagaacgtacacagtctttgtacacgtccggcggctctggtgcctatttttgtttgtgtttttcttttgtttggggggatggatttggtttcccccgagccctctgtcctcctgtcacctggctggtgctcggcaatgttgaccagctgcctggctggagttggcagtggctaaggctgtgacagctaacatgttcctgagtcctctcatttcttcaccataatgccctgttgagtttgcagatactgtctctgtttttatctcccggggaaactgaggctcagagtggctaggccaccttcccatggtccctcagctcatgagggccacacagggcattgcggtggccttctcctcagccttgaccctccggccccagcattgctgcctcaaggggtctcctctgctgagccgtgcaccttctgcctggcagctccaactctgtggctgtgttcagtggctcagcactgccccttgaccctccctggccttctgcggatgccagactggagcactctgacaaggtctggggtggttgtatgggtcctgtgacctctatacacctcccagtgcctgggaatcctgcagatacaccctccttagccgtccctaaccatagaggacatttctgaggtccccgagagagtggggcacccctgcaggatccaactgctgggcccaggaaggatagcagcagcatgaggggttccattagccacaaactcacggcatggaaccttcacccacctcgcccctcatctgctgtttagcacctggcacgccgtgtatacttactgattattacattttaatggcaaattatagtggcaaacgtatgcatctttgcacaattgttgtacagcatgatgaacaagtcattaatagtaaagaataaatgtgaaagtgagaaaaatctgactgccaaagtttttactccttccttccctccccagacttttaaatgaaagtttagggataatcccttagttgtcctgctagtaggacttgcaattaaaagaattgggccaagaacacttctacgcttctccttttaggtttgggtgtaaattcggggtatttctcactgatgaaagcctggtgcagggcagaccgtgggaagctttcatttccggaatggaccatcaacatcccttggagaagaattctcttctccagacccagacctggtgtcctggcacccattgggcaagtgggtcctagaagacaaacctggtcagagcctggaggctgcttagcattccccacgcacattagcagctcggagagctcaggaagccgcagcccctccttgcctcaccagcctggatcaggacagcatcccctggaagacacacagggcctggcctctgattacccagcctggagggaaagctcaatcgagcatcatgtcacccggtgcccccatgcagggtggcactggtgagacccccaagccaatgataccacctcacaggagtgcaggcccattgtggccagatcatcttgacttttcaagataaatcagaaatcgtatttccatgagatatccctatttgcaagtgatggtgactaaattagaagtttttgaatattgtaacatgttcgtaggctgtttgtctggtttaaactctatctggaggaattcaagctagacttcaggaataacttcttgaggcaaggattttgagaccttagggaaagaaggacgtcttgggggtattctgactgttgtcctcctggaagggaagaacagagaactagaagactgcccttagcgaagttcaaagcacctaagcccgggaccctcagcaagtgttcttgagtcacagattctccctgaggcgcctctttctggctccatagaatggctgattctgtaactcggtgagtttgctttttttttttcctccatcacccaggctggagtgcagtgaagctggagtgccgtggagcgatcactgcaacctctgtctcccaggttcaagcaattctccttcctcagcctcccaagtagctgggattacaagcatgcagcaccacacctggctaatttttgtgtttttaatagagacggcccgaagtgctaggattacaggcatgagccaccgcggccagccataactctgtgactcttgttacaaaggccttatattttgctctttgagggtggttttggtttgatgcctgttggttgccatcttttaactagggatgttttatcaaaatgcccagccaaagtgtccaaacaaattataccttaaagtttgaaaatgtctggcacttctaattcaatgcctgttgtgccaggcactgggctgctgaggaactgagtcccgtccctgcaggctagctagagaacacacacacacacacacacacacacacacacagagtggtcttacaagtcagttttatattctacctatatgcaataaaggtattattatgttgaggtgccttgatataaaaatttttcttaaaggagaggatgcctaaaacaggcattacctgaaacctcctctctccagcattggttgtcttctgtcatgactcagggttttcactgagaatgggatggaaatgtggtctaaagatagggccaatgttgggactggatcccctctgggaagtcagaccaggctagggcaggtccttgaagccatcaggaaaagcctctggagccagaaacaaaacaaaaaaaaaatggtgttaactaaactcagtctcaaatcctgaataggactcaagtcaagcaaaataattaaaggagttagcaaagggcaagtcagagagaccgagcaacaccaatgtcttccgggagccctgtggcgagtgacagagcctggactctggagtagaactcatcttgtgtcttcttctgccactcgttagctgggtgaccttgagccaagccccttaacctcttggaccctatgttcttatctctaagtaggggctggtaatatcttcccctttgaggaatgccctctaaggggtgttgtgaagattcggtaaggtggcaggggtaggactcctggccagaaacaggcacataataaatgctaagtctctccttctctccacctgctggatgctgtagatactaaggatttcgatgtgaatgagacaaaacccctgccttccaggagcctttgagaatcagagaactagacccatttccagaacaaggggatgcagggtctggataaagttttggggatcaatagagcagagggctcccagaggatcccatagggttgactcctaactcaagggcatgagacaacccccaggaagggcaccctggaaggggtccggctgtccctgatttacttgtgggcactgggggaatgcccggagccatccagccctcagggctctgtgtgattctgggttcctcccataaaagataatcagattctttcacgttaatgtctttctccacctcattgcacatcatgcagctattcattgactcagcaagtatcagctttgcatgcgaccttggcctacccactttagcttttagtaatagctcccttcttgaataatacaaccagtggggaaacagaacctaactcttacctctgggaggcttatttgctttgagaacatatgtcctgcagttttgttcatatggcagtgaagtttcgtgcacacactctagagccaggcagcctgggttcaaagcgcagctctgccaggtcctaactgcatgaatttgggcaagtcgctcaacctctccatgcctgagtttcctcatctgtaagattggagcaatggtaatacctgctttttagggttgagaagagaattaaatgaattaagatgggtaaagtgcttagagtggagctttgcaagtagtaagtgctatgtaagtgttcgatttaaaatgaaagacccttaaatacattctttgttcatttcacaagcccttcatttcacaaccttacatttcacaaccaagctctgtctcccctggaatccagccataactctgctcacaagtgtgagacaggccccagcagagctgcacgaagaggagagaaggcagccccccagactcccaaccccctgtccaagatggcaaaaccagaacacagcctctgtaccaccccagcaggtattcagaatctgcaatctccaaagcccacttcaattgtaaatgtagagccacgtgcgctttaagtcacctgtcactctggaggctcttttgctcagttcctcaccattagcagggatgacagggagtgcaggagtgcggtcgactcccagatattggagagcgctgggctagctgcccattctcccggcctccactcctctttgctgtccagccatcacttgctctttgaaggcaaacaaaacagaaaacagtgccaaaagtatgggaagaaagccagcttctcccctggggtgcctgtgatgccatgcccaccctccctgaccacgcagcccctgtggaccctcagggccccaagcccccatttccatcacatgcgtacacccatgtgtgtccatagccgcccatctcagtcaataaggctgctcctgcccacttggaatagtggtgacaaccaggagtggcttatgggaactatcccaatggcctgacagcatgtccgctgcaaaccgctgaggtaggacactgccctcatgtctagctgatcagcaagaggcgcagttgctttcttaggtaacattgctgctgtgtcctggccattgctggggggtggcacttaatctacaccagatttttccctcctgtatcttccaagctgcttggatcttggtgctgaattaggttggactttgtcttgtggggaagggaggactatagaccctcaacgtaagcaatggtcagactattctaagaaaactcgccgaattaaagcatgaggtaaatttagttctgacttctgtccaccccactgccactgtccccttttatcccatgatcccttgcttttcttttcctcctctctccctatctcttgtgtttgacgcatgataggaattcagaaatatatgtttgtggatttgtttattcacgtagcaaaccatttcttgagtgcctaccatgggccaggtagaatgggcggccccgggctgcagtggtttcttcagcccctctcctgggtttacactgtgcaagacggtttgtgatgggtcctcccatcgaggaccacactcttctttctctgtgccccttggtcctcagtctctgaccccacttcaaaggcagcattcactcagggaagctcccatacaatgctagtcagagtaaaagtttggacaaattgccaggaagcagcttgtcagtatgcataaacagcctttaaaatattactactctttgacccagaatttcacttctaggaatctgtcctaaggaagtagtcacatgcaaaagatttatgtaccaagatgttcatcaaagtgttgttttataacaggaagtctcagaagctggataaatatccaacctctggaaatggttagatagaatagtatgtagccattagaaaattatgtctatggggtttaaaatgtcatgggaaaacacttctgacataaaagagcatgagaactgtatatttagcataatcttaactatgttttagaatgcacaggaaaaaaatgtacaaacatattcatagtgatgtctctggtggtaggattatgatcagtaagtacttctgtctcttcatattttcctgtatttgataatacatgcatatgttgtttttaaaataagaaaaattttaagtttaaaattggagctgaaaagtgtttttaggtcaggcgaggtggctcacacctgtaatagcaccactttgggaggctgaggcagtcagatcacttgagcccaggagttcgagaccagcctggccaacatggtgaaaccccatctctactaaaaataaaaaaattagccatgtgtggtggcacacatctgtaatcccagctacttgggaggctgaggcatgagaattgcttgaacccaggaggtggaggttgcagtgagccaagatcgtgccactgcactctagtctgggcaacagagtaagactctatgtcaaagaaaaaaaaaaaagaaaagcctttttaaacagtagcagacataactatataatccttactaagctgtcggtcaaatttttatttatatatttattttattcatttattatttttagacagggtctcactctgttgcccaggctggagtacagtggcgtgatcatggctctcttcaaacttgacctcccgggctcaagtgatcctcccatcttagcctcccaagtagatgggaccacaggtgcataccaccacacctggctaattttttttattttttatttttagagatggtgtttactatgttgcccaggctagtctcaaactcctgggctcaagctatcctcccacctcggcctcccgaagtgctggggttaccagcatgagccactgtacccagccctcaaatttttaaaaatctataagagacattattggacaattagagaaattcacatatggacttataatagtatcagagtgtgtggtgtgatggttctggagggaatggactttttctttggagacaggcttttctatgcccacccttttatcttgctaacttatcatcatccaggttccagcagaaacattacttcccccaggaaatttcttaagggtgcagtatcatgatgtctgcagcaaattctcaaatagctcaggaaaaaagtacgtgtgtggtatgagtgtgtgtatgtatgtgtgtatatatatacacatatatacacatatatatacatatatgtgtatatatatacatatatgtgtatatatatacacacacatacacatatatatacacacacacatacatacatgtatttttatataattatatatgcagagagtgcaaatgttgccaagttaaagattggtgagtctaggtgaagggaatatggtatttattgtattatttgtgcaacttttcttaagtttgaaaattttcaaaacaaaaaattggaggaagaaggcatgccagtctaccccaagccctccattggaatgctgaaaatctaaacaatgtgatttggcaatttcatttcttttctgttgtgggccagtagtccttagatgttggggaagggggtagtcgctgaggtgtggttgacttaggatggaagaagcagaagtcaagactcccagggtcaaagtggtttgctctgctgacccaagtgtgggaggcccagagtcagcgtttcaggtgtgctaattcagcatggttctattcacggccaaagtccaccctgggcacctctctggcagcaatcttgggtgactctactaaggccaggcctccatgaccctatgtctggatcccatatctccacctctcccactgtctcaggaacggtgcttagctttttcttttccctctcctgtcttctttgccagcatgtagaaagtttaaataattcccctctttacaacaaaacaaaacatacccccttcagtcaaccaccctagctctcttctccttttcccagccagatttttttaaaagcatcctaggccaggcgcggtgactcacgcctgtaattccagcactttgggaggccaaggtgggtggatcacaaggtcaggagatcgagaccatcctggctaacatggtgaaaccccatctctactaaaaatacaaaaaagtagccgggagtggtggcaggtgcctgtagtcccagctactcgggaggctgaggcaggagaatggcgtgaacctggtaggcggaggttgcagtgagccgagatggcgccactgcactccagcctgggtgacagagtgagactccgtctcaggaaaaaaaaaaaaaaaaaaaaaaaagcatcctcagcactttggcaactccatctcctcccaacatgtccctgttactggaatccagccaggactcagccccgatctttctactctaaccagttgtctcagttaacaaggacaggtttatgctgcagtgacaaacaagatcccaaattcttgtggcttcacacatctggcaccacctcatcttccagccttaggagtcatcttttagttccttgaaaactctttacagttttctgttggggccttgtcatatactattcccctggaatgttctttcctatcccctccctttcaccttgctaacttgtgcccatccttcaggtctcagcagaaacatcacttccttggggaagttttctccaacacccacactacacaggtgtcccatctacactcctatgactttgtggtacttgtctcacttcattttccactgccttccccacaaggcacctgcacaagggcaaggaccgtaccactgtacctatgtcactcattgctgtggtcacctgcactctggctgcctaccttaactacacattagaatcacctgaggagcttttaaagccacaatgcaagactccaccctaggccaattggatccaaatccctggggtagggccagacatcagtggagttatatatacatatatatattttgtttgtttgtttgtttgttttttgagacagagttttgctctgtcacccaggctggagtgcagtggcgcgatcttggctcactgcaagctccgcctctcgggttcacaccattctcctgcctcagcctcctgagtggctggaactacaagtgctcgccaccacgcccggctaatttttttgtgtttttagtagagatggggtttcaccgtgttagccaggatggtctcgatctcctgacctcatgatctgcctgcctcatcagcctcccagagtgctgggattacaggcatgagccactgcacccggccatcagtggatatatttttaaagcactgcagagaattctgttgcatcagcttgagaaccactgatctgccttgtgcttcacatttaaaacttttttttaatgaataaataaaccccaaaaaattaatctccctaagcctccctagaagataggatggtaaggatattttcctaggtaaaaatatgttaatttcatatttcatgaaatttcatgtttcatttcaatcaagctctgtcatacaccttacatggggcaagcccagtgcctgggcagggtgtaattatactcattacacaggcaaggaaaagtcacattaggtgatggagcacaaataggcagttaatggtttcagggctagttaggatatgtttgtctttcaattgcaagtaatagaagcccaaagaaattggttatttatataatataattgattggttcccaaatttgaaaaattcaggaatagacccagcttaggtacagctggatccagtcactcaaacaatgtcacaaagaaccctttgacaggaatgtatcctgtgttgactctactttgctctgagtagtctttccccaggtgatgataaaaatggtcatcatcgccaggcttgtgtcctgtttagtaggaatatacaagaagagctcagtaaatgctggccccaccactaagcaaaaacaaaacttttgttgttgttattgttgttttaaataacagcttagacctttcttctttccttgttattctctttcatctgtaatccagttttctacttctgaagtatagaatgttctgatgatttattcttcattacccacaacttgcacatgtttatttaaaaatgccaggattgcctggccgttgtgtgctgttaacctttgtttgctgttagtggatccctgaagttcaggctcccaggggagcagataatgggtatccagttcctgcaatatccaccctctggcaagccaagttccttcctgggtaaggttttgcctacctgcattcctagggaagtttctgggcctgaccaccaagccagctctgagaaggggtgcataagccccaccatgctttggctctgtccctatagaatattttatgttgttactgaaaactaaaggaagatgggtgcggtggctcatgcctgtaatcccagcactttgggaggccaagacagattgatcactcgatgccaggagttcaagaccagcctggccaacatggtgaaaccttgtctctacaaaaacaaaacaaaacaaaaattagccgggtatggtggcatgcacctgtggtaccagctactcaagaggctgaggcacaagaatctcttgaacctgggaggtagaggttgcagtgagccgagatcgcactactgcattccagcctgggtgacagagcaagattctgtctccaaaaaaaaaaaaaaaaagaaaaggaaagctaaaggagagagactaaaatgatatcaggttcctggagaacaaacagacatgattttgcttcatggcaggacagccggaagaagtgggattatatcctcacattacaaataagaaaactgagactcagaatggttaagtcacttgtcccaggccacacagccagtaaattacagaaacagaatttgaacccaaatcttccagctccaaagcttgtgttcttttcactacctcctgcttaattttttaatttctaagattagacccttcatctatccatgacacctgcctgtcatcccctgaaaaaaggtgaacgccgttcagaaatttttctagcctgagctcactcccagttcacttatttttgctttgtcatggctgcccagtccccacttgtagaccaggaataggtcatggctgcggggactacacgctgtcgctgctgcaagggccggcctctgtttccggggctgagtgggggccagacctgccaggagcaccatcttctgtgggtcctgcctggatgtcacatcccggccccaagaagtcactgcaaaccttcgtattattgagcttcacatcctagaatttgctgtcactgtggctgctgcatgaagttgtcctgagagaaacgggcattgtcattaacagggaaattgatggtctgggggaaaagtcatcctcattctcttgcagatctatgggtgattgagactggctgatgttgaaggggtttctcagccatcgtgtgccatgttatggaacagtggtgtagccagccatttgacacccagcgctgacctttgtttaacaacctcacctatatatgacaaaatgattgtcagaaataatcgtgtaatgaaatgactgtaataatggccagaaaagaaacgcagatagtaaaatgtttctcttgttgaactctgtacatataattgcaccaggatttttttcaaataaaaagtaaatattatactacaaaaaagggaaaaagcacaagcatttattaaatagctttctatatctttctgagttttgatcctttgattgcagactgatgtaatattttatgtaaatcattgcttggttactaagtgaactttaagaaaagtgagacgtctgcagaagttgcccataatttagcagctactgtattgtaccattgatgtacggctttattttcttgattaattatttaaacaatataattcacaattttaaaataataaatttccacttaaaatggtatttaaactcagcaaaatatatcatctatgagtaaaatttgtatttaccaagcaaaaatattacagtttgtggttcacatgctgtctcactgttttaaattttaaatacaaaaactccaagtaggctgggtgtggtggctcacacctgtaatcccagtactttgggaggctgaggcaggcatatcgcttgagttcaggagttcaagatttgcctgggcaacatagtgagatcctgtctctactgaaaacaattagctgggtgtggtggcacatgcctgcggtcccagctactcaggaggctgagataggaggatcacttgaaccctgggggacagaggttgcagtgaggcaagattgcaccactgcactccagcctgggtgacagattgagaccctgtctcaaaaaaagaaaaaaaaaaaagaaacacaaaaactccaggtggtcgcacagaatgacaggactgaagtaacttagctccaatttctgtcttcataatcactgtcctaccattgtctgtgcttagaatctacttgcttaatgcaggaacatgtgttctcacagagatggaaaatgcaaatggcgccagaagcaagctggaaattctgaaccattaagaatttactctctgccaggcacggtggctcacgcctgtaatcccaggactttgggaggctgaggcaggcagatcatctgaggtcaggagttcaagaccagcctggccaacatggtgaaacttcatctctacaaaaatacaaaaattagccaggcatgatggtgggtgcctgtaatcccagctactcgggaggctgaggcaggagaatcgcttgcacctgagaggtggaggttgcagtgagccgagatctatctgcaccattgcacttcagcctgggagacagagtaagactccatctcaaaaaaaaaaaaaaaaaaaaagaacttactctcaaaataaatacgtgtggctgactccacatatggtagggccaactgtataactagaagttctccaaataacttctgtggagaaaaaaaagtttattaaaggttaacttttttaaagtgctaactagaaccttactaacactgagatcgcaccaattgtttataacttagacagggccgggtgcagtggctcatgcctataatcccaacactttgggaggccgaggcaggtggatcacttgatgtcaggagttcgagaccagcctaaccaacatgatgaaaccccatctctactaaaaatacaaaaattagccaggcacggtggtacacgcctgtaatcccagctactggggagggtgaggcaggagaatctcttgaacccaggaggcggagattgcagtgggccaagatcgcaccattgcactctagccccagcaacaagagtgaaactctgtttcaaacaaacaaacaaaaaaaaaaacctcttagaccaggaaaatattttttaagggaggagtattttatcactggcattgtttaggattgcaggcacatgatgctaatgaaaagcagactaactattagttggttttattactgtttttgaactctctctctcccttttttttttttttttgagacagagtctctctctctgtcacccaggctggaatgcagtgactgcagtctcagctcactacatcctctgcctcctcagttcaagtgattctcgtgcctcagcctcccgagtagctgggattacagggcaccacaccaggctaagtttttgtatttttagtagaggcagggtttcaccatgttgcccaggctggtctcaaactcctggcctcaagcgatctgcccatcttgacctcccaaagtgttgggattacaggcgtgagccaccgtgcctagccctgtttttgaactctctagagacagtccagccccttattacttgtcctgaggcagctgctcccttcacctggccccccgcattgtgttccggacccttgtcctggtggtgctaaagaatatctctgtcgatcctttggggactggggaaactgaggcccagtgccacgcgatgccatttgttcagggaagattaggtcatctgctaggtccccagtcacttgaccttcttcccagacaggaagaagctgctctgggtctctcagtgctccacgtgtctttgcacattgaaatgttttctgatttttttttttttttttttgctgttacatttacttttaaaaaataacaagcaataaaatgttacatttgagaaggttgaaatgagaattgatttgagttaaattctagcagatttttcttagaagaatgatatcatcatctccagctacctgcaattgatctactctgaattaagaaagagacttccatttgttgtttatattttgcactcttgatgtgtttctttaaattatggtcatgggccaggtgtaggagctcacacctgtaatcccagcaccttgggactctgaggagggaggatcactggaggccaggagttcaagacctcgtctgtacagtaaattttaaaaattagccaggcatggtagcattcacctgtagtcttagctacttgggaggctgagatgggaggattgcttgagccagaactttgaggctacagtgagttattttcacgccactgccctctagcctggctgacagagcaagacctgcctcaaaaaaataagtaaaaaataaattaaatttcaatcattagcagtcattaggatatttaaatacagtatgttgaatcaaagttacgcatgtgtgtatttttttttccagagagttgtttatcatgtgggttttaatttaactttaaaaaaatgttggctggacagttgcccaaatggtatcatcagccatttggttgagaacgtatgtcctgcgggctcctctgtcactggagttttgctagctgacagccactggctagttagagactgcagtcagcacagatgcaggcgtggacttgcgcacgtaaccatgtcaatgcaaagccatcacttcttaaaaattctgaaccctgctgtctgagatggtggtgcagcggatagaactctgctctaagaggcagtagctaattccatgtcttctttgcccttgactagctgagtgactttgcacatggggcttgcctctctgttgccttgtctgcaaagtggaatcatcttttccttgctagacagaaggtggaccctggacctatggcctttttgagtttcccccccgcttcttagaaggacctctgatcctactgagtttaatacccacgggttaataattgggaaaagcaaaggaagcgcttctgtttaggtaattatatgcatgtttttgtctttttctggctggaaagatatccaagccactgggaaggtccgtggctacccagggtagccctctctggggagggctgctatatccaagagcccctcatgagaatttgaaaatcgaccatggtagggcctgctgacttttgacagctaatggtgtgctgagaattgtccctccaaagatgcctttccattccctcgggagagtctgggcagcccctactgggggctgggatgctggctcttccctcagcctccaccccaactgctctcttccctcctcccctccccagccccctaatttctctcacaaggctttgttctgcagcaacctttcctaatgcagtcctggcctcttcgcagcttcattacataaccttccgtggactcctggtccaaggatcaccccagaaagccagtcagaggtaggcacgcagctggggtccatttacttaccttccccaccccctcggaactcagaggtggtgcaggaatttggactccaagaattaacagctccaccaccatcaccagagccaaaactcaggatgcatgtgcttcatctgctgcttatttccagctgagagccagtggtgccatggttccttagggagccggtcccctgatgccggctcctggccccaaatctctctgatccgggctcttccagaatgtcttgtctccaccatcgcctttgaccaatggtgtccctttgcctggtaatgtcccctttgcctgatgatggccctgtcactcctctctttagcacagaggaggctgtttcatcccttcaagcctgccctcccttcaagtcttagctcaagttcaccttctccgcagagccttctccaatcttcttgactacgtctcctctcagctccagcaacctctgtctctggcactgattccttacttagctaagagaatcacagacacttggggctcaggacaatctgctttctctcttcttacccatggccttggactgtgtgtacctctttgtctccactcccaaacccaacccccagagggcagagagcatgttgtctgtccctttgctcagcatgaagccatgcgtgtggtagatcggcagagttccataacttgtgttgaccgaggggtcactttgctctgaaattacccctgtgtccttcagtatttgcacagatagcttcctggccagaccgaatatatccaagggcatggcccacctctgctcctgtttccaggtccctggtgggggttagttcatgccttcctcataatctgcccactggcctggtcctcaaggtcttcccaactgctcagccagagttgagaaaatgggtcgctccatcctgtttgtgtcgttctctccttcctggcccactctcctgcccacaggtatccaggggctgcctgtagcattagaggacatacatgcacatgcgtgggcatgggacactcacgtagcctccaagcacagcatcaataatgcattctgtgctttatagcatggaaagctgctctaaactttattacacagtggacatgtctgaagcagctcccaaatccacccctgagtgtgttggaattggcaagcctatcacttgggagtctagtttttttgttcgttaataatagatgcttcctgtggccccagcttggcaattttgatttaaagtgatcttaactgaagagactaatggacgggtctgaatttgtgccttttaagcacaaagtattgctcttaattaactggattctatcctttgagcaggcagaggccttcccccaagggcgtcattaacgatccacatctggacatcttccaaagccttcttctgtttcaggccaaccgcaggtgtgttcctgaacacccaggaggctatgagagccacatatgcctcccaaatacacacagtgtgcatgcccagggacatagagcagtgtgcaaagtcccattccatctctctccacctgggagaggatggctcttctgtctgattcatggctcaaagtggtaaaggagctccccactccccgtcccacgcctactcagagtctgcaaatatgtatgcgatatgagagctcgtcagttagctgtcttcagtgtggcgcacatttgaggagtctgactcccctccagcacaggccaatgtgcactgctctcctatctttgtacccccactgttgcactgtgcagaggttggagccatagaagtaccagagctgtgaaaggagaggccccctctcacctctgccctggtctccatccccactttctctaggaagctagtaggtgctgacaggggagagaagggaggggaggggtccagaaacagtggctcatgcctgcaatcctagcactttgggaggctgaggcaggaggatcatttgaggtcaggagtttgagaccagcctgggcaatgtagcaagaccctatctctacaaaaagaaaaaatgtaattagctgggtgtggtggtgggcacctgtagtcctagctacttgggaggatgaggtgggaggattgcttgagcccaagagtttgaggttacagtaagctgtgattgcaccactgcactccagcctgggcaacagagctgagaccctatctcaaaaaaagaaaaaaaaaaagaaaggagagagagagaaagaaaagaaaagaaaaaaaaaaaagaagggaagggaaagcccagaagagtgtggggagaggaggcggccgtcattctggggccctcagtgtgcacaaccagataacacatgctctgtgggcttttgtaccattttgcttgagcataaagaaaggaaggctgcccctaaatagaaagcactctggaggcaaacaaatctgactccaatcctggccctgccactttcccagctgaggacttagacaagcaccctagcctcttggacattctcagagccatctgctgcaagtgggtgctgccatacccaccttactgggcaggcttgggggaccaagggtggtaaatggctcagtctttcatgatgcggccacacagcaggtgcgccatccaggtccatttctttccttcctttcccccaaatcaagttgtcattaaagtactagtccacattaatgaaatcaactgtattaattttctatttgctgctataataaatcatcagaaatttagtggcttaaaccaacacaaatgtattaccttacagttctggaggccagaagccctccataggtgtcactgggctgaaatcaaggttttggcaaggttgcggtcctttctggagggtccaggggagaatccattttcttcctttttccagcttctaaaggtttcatgcattccttggctcatgatcttctatagctatagtcagaaaaattttccatcaatcatcttcaaagccagcaatggcaggatgagtcctcacatcaccttgctctgacaccagttctctgcctccctcttccacatgtcaggaccctcatgattactttgggctcactctgataatctgggatgatctctctattttagagtcagctgactgggaaccttaattccatctacaaccccaattcctctttgccatgtacagtgacatattcacaggttctggggattaggacgagcctgtctctgaaaggctactttacatgaaaattcatttttttaattaagatttttttttcctcttgagacaaggtctcactctatggttcaggctggagtgcagtggtatgatcacagctcactgcagcctcgacgtctctgggctcaggtgatcctcccacctcagcttccctagtagctggaactacaggggtgagcccccatgcccagctaatttttttttttttttttttttgagacagagtctcactcagtcacccaggctggtgtgcagtggtgcaatctcagctcacagcaacctccgcctcctgggttcaagtgattcttgtgcctcagcctcccaaggagctgggactacaggtgtgcaccaccacgcccgactaatttttgtatttttagtaaagatggggtttcaccatgttggccaggctggtctcaaactcctgatctcaagtgatccaccaacctcagcctctcaaagtgctgggattacaggtgtaagccaacatgcccggccccagctaatttttaaatattttttttgtagagatggggttttaccattttgtctaggctggtcttgaactcctgggctcaagcaaacctcccaccttggtctcccaaagtgctgggattacagcatgagccactgcactcggccttaagagaagatttaataattaatactttacaacaagatctggaagaggtgggatgagtaactaaatgaggatacaagtaacccgggtcatatttgctaatacccttggtcacattgaacttgatatcttatcagattttcctaatcagctcctttagcagcagtgttgcagcatcttatctcattttgttttttgtttttttgcctagcacatgcctgtaaatcactggattgaggtgtttagatgtttgttgtcctttggatgcttcttataaatccatatttcatggctccctggaaagtgctatgcaaatgataagctgcaaggatggaaaggaaattgcagtgctcctgaattgtaaatgggcttttacgaggaggtttctaattactcgctctttctcttgaactgaggagttgaagtgtaggtggcagatccataacagataatcatgtgtgtgatgtgacttcagcctgagcgtcgaggaccaagtcacagagcaggaacagccactctccagtgtccttggggctacgtctgaggagaacctgggatttcatatatgacctgcactggctggggggctctcttgacgtaacgtgttccctctgagcatgttacagattctgacattcttatgttccttctgtggagagacatgtacttagtgacctaactcactttagcatatttttgctcatcgtttgtgtagcttaaaggaatcagataattaccccctccccactactttcggaagcacaaatgcaatgccctagaattgtactggggactcaaaaagaaaagagagtagtaaaatctattaaaggggacaaagacagcctatatactacaagctttctatttttatggcagagaatgccattttctaagtaaacagagaactgcatttgacctgcaatatcaaatgcatggatttgatgctttggaaagcaactgttttctgcgttaatctgggtgtcttccgtgaaatgtcctcctgcctttggcttaaacactagctttgtctacagccattccatcctgaacctgcccaatcttgtctgaatcctggtttcaccactgacaagctgtgtgtccttgggcaagttacttcacctgtctgtgcttcagagtcctcatctgtgagttggggaatctggacagaatctaccccatagggcgtagtgaggatgtgttgaattatcccaagtggctacacagagtaagcactcaaatgatgtcatcgttgtcatgattgctgttaccagagcctagagttcattctgatactcgagtctgtggcccatccagcccaggtaaggaatagttggaggagttgggcatgttcagcttgaagaggagacgacaggggatatgggatagttgaatctgtgaagggccccctgggatgaagaactggcatgttctgtgtggctccagggcactgagcaggacccatttgccaaagtctcagggacacagtttctagctatagacagaaaaattttctgtcactcagaggatgaaaatagaatgagcccccttaagaggtaatgagctccctgtcattggaaggattccagaagagctaggtaaccactttaggtgctatcaaggggcttttttctttaaagtcctttccaaaagcttctgagattgcataaacaataggaagccatcttggtgctttaacacaaactctccccagtgatgagggttgagccaaagccagattggcaagcagagaggagacttgtgtacaaggagttcctcgagtcaattgctttttccttgttctagccagccagagggctcctgttggaaaacaggagaccggagaggctgaggcctgaccaaaccagcttctgcaggccagctgggaggccacaactcctacctacgggaaaactgaagggcatctctatttttagattagcaaaagaaaataaatttaagtttgagtctcctttgcaacttttaaaagacatctttattgagatgatcattcacattctataaaattcccccactttgagttacaattcagtggttttagtcttccttgatgattttgatggtcttttcttaaggctcttggaagacccagaagcctctcagacacaggtgggtgtggagggcgtagcacagaggcagacttctcatttcctgggtctcccctttaatgactctcagagacccctccttccccctgcccctggcttctaccccaggggtgtagagttttgccattttccaagcagaacttcatttcctcttctgtgtctacactctttgtgcttctttcttgccagctttttctcctttgcccgcccttccttccttccttccctccctccctccttccctccttccctctttccctccttccccccttccacccttccccccttccccccttccctccttccttccttccctccttccttccttccttcctgccttccttccttcctgccttccttccttcctgccttccttccttccttccttccttccttccttccttcctggtatgtgactaatttctgtttcaggacataaatgttgtccaggctgttctttggtctttctgttggataatggacatttggcattgagagaggctgctttttctgaaatcatgttcttggggcccagaacctaggtgtgtgcttctgactttgttttcttcctgatccaaattctgatatgtccatttaaattgatctagacccacagggcactgtgggacagatcctcagtggaacatgactctgtaacgagagcattttgttttgtcaaaatgagaacatattattgcctttcatctgattgtaaacataatacatgtttataaaacagtataatgagacaaaaatgtagacactaataagggaaaatctccctaattgtatttctcttcacagagaaagcccctgttgggcatatatactctagtttgtttatttgtttgactacacatatatgtattcttttcttatgtataaaaattctgaacatgcacatttctgcaactactgttttcacttgatgatgcatggacctctctagagtgtacgtttcttcttccttacaaagcagttggcttcgcccagggtacaccaggacacggttttggctctgtccccagggtgtcacgggaccaggggatgatctcacagggtctgccatctgccctgcctggccggaggctgcatcgagagggccaaggggcaccacgtgtcgtgggtactgtcaaacaagagccttcagagccttccacagtctttcttttgcttcccagcattgcttccccgctggtggactctgaatctagaactagctccaggcgcctctccaaattcagacgggagctggggcactattataatgcaaatctaggcaaagccctcccaataccaggatccagaatggggtggggccctttgccctgaaaagctgtttagtttgaaaatacaaacaggagacagaaaagtttggctaaattaatggataaagttttaacgatggtaaccatagtagggttcatcgacagccagcgatggttctgaacacttgacatgtattaactcacctaatccccacattttacagacaatgcaaaggaggctctgggaggttgagtgacttgccccaaagtcgcacagctcctaagtgaaggattcggagtggactccaggcagcctggtctgactccctgcactgcgctgtgcttatctctggccccaatgccgccatgcagaagtgtctgggggcactttgtctctgtcagacagaattcggagatgtgtatgcttgccctggtatggcacttctctttttttgagacagaatctcactctgtcaccctggctggagtgcagtggcatgatctcagctcactgcaacctccgcctcccaggttcaagcaattcttgtgcctcagcctcccaagtagctgggattatagatgtgcaccatcgtgcctagctaaatttttgtacttttagtaaagatgttgttttgctgtgttggccaagctgatctcgaacttttggcctcaagtgatctgcctacctcagcctcccaaagtgctgggattacaggcatgagccaccatgcctggcagtgtggcacttcttacgtgtgttcagcggacactgtttatcttctgtccctccaagacggtgctgagctcaggtcgttcattactggcagacaactgctgatttccaacagaattgccatcctcttctcccctgcgactttcagagtgtgacctcagactcaaaaattagaagtgaaaacatcttaaaaactatcaccttttcttcctaatcctcctctcccctccctgtcttccttgttgtccccatctaatgaactatcatggcaaaaagagcccatttctggtcattttctgtggcctttcaaactcccacctaccccactgctcctgggtgcattacccgaaagctgagacttcagtgcagaaagtgccaggccctctgtccccccagatcgccttccttgtcttccctgtgcttgcctgtcacattgtgtgggttccagcgctggaaggaatgaggaacagattctctggttctccttttgaagtttaccttcgctccaccacttctgagaccttcccggaagttgccccttgtttctctcctctccagggctgccccagagctgcctctcacctcttcctgctgtcaccccaccaccatcagggcagaagttgggacaaagcctctcctactggctcctgcttttctcccttaggtccagcctcctcttctccatcttcaggagtctccttctccactcacacgtcatgacttcagcacctcgcatcagtccagaatatgactgcttgttcaagtgccacctttctcatgcatttttttctagtgacaatcacagccaccctgtggggcaggagtgtcatcatccccatgtttcaaatgaagaattgcagttcagagagggcaagtgactggcccagcctcaacagctagccagtggaccccaccagggcttctgactccagtccgggttccctttccacccaaatccatggagggagctgagccgagaacaggtgtccttcaggaagacgtgaagccaaagcctccacctccaaactcaggggcccagggagtccaggcacccatccactcacaaggctggatatggtgcattccaggagaggggttgggggcgagtggcctctctgtgtacccgtggggatagatgcgcaagtggcatcgccacatcgtgagtcctggcttcatgggtgagctccaggtccaacgagaagccaagcagggggcccttcaagctcagctttgggcccgggtcggggtacagggtagagcgggcctccccagcccctgccatgaggccaaggcagtgcatcgttcgcagcgtacattcagaaaccaaagcctaggagctggttatcattccggtttacagctgatggaagagcaggtgcttccgagaacccacagtgctctttggccagtgacccaagggtgcctctgagaggcctcgcagcacccggaggtgctgctgaggcaacgccctgactgtaagaaggaccattcatcctcagagagtggccgtgatgctgctgcgacagtcccaccatccctcccgactctcactcccaacagacttcccactgtaaagctgaactctccagcaaatcacctctcgccagactctctcctcactctctctgggtccactagaggttcctcagcctctctttgccttggttttcccagctgtaaaatggagcaaagagggcctatgtacccacaaaggtgtggttggagcgactcctcctacattagggcctcgagtggggcttcatgattggttggtggaggtctccaaacccacccagtgccaccgaaggctgagactgcagatgcaatgccacaggtgtccttcctcagcctgggcagctgaacatcatgtgtaaaacggggataataagataataacagccccttgcacctatgtggctgtgaggattaaacaagataaatgtgtaacagtgcctggctatagaaatatttactcttgttattaagggaagaatatgtgtggctaaaaagggatcgaagatgtaaaagccaatccctccccctctagcatatttaagggtaatgttgagttggtttgtggaccatttgctgcctgttagagctggaaggtagggaccccctctcaacagcgatgctacaaattatacccattggaggtcaaccaaaagacaaagcttattggctggacatggtggctcacacctgtaatcctagcactttgggaggccaaggcaggcggatcacttgagatcaggagttcgagaccagcctggccaacatggtgaaaccccatccctactaaaaatacaaaaattagctgggcgtggtggtgcacacctgtaatcccagctactcaggaggctgaggcaggagaatcactagaacccaggaggtgaaggttgcagtgagccgagatcgcaccactgtactcaaaccgaggcaacagagggagacgcaatctcaaaaaaaagaaaaaaagacaaagcttgttaataccagcatattgttaagggaataaagtaggctgcagaacaactggtgtaatatggtgccatgtagggaaaattacatgtgtgcataggagaggggtctgcaaggttgtgccctaagatgttagagtggttcctttgcttttctcttttataattttgtatttgacttttaaataaggaccataaatcacttttataaaatacattctctccagcccctactactcctttaaagaataagagtggtttgcccaagaaagacagttttttttgctctggttttcttgattctgacatcagaggaaactccttctcatccacttggggctctgggttcaggggattcatttcaggcagattaaagtggtgaccaggggcattcgtggacacagggagggacaggagcaccatcagtttgtctcacacaaccactgtcatcctcactgaaggctgttgcctgatcaaaaacagtattgggccaggcacggtggctcacacctgtaataccaccactttgggaggctgaggtgagtggatcacttgaggtcaggagttcgagatcaacctggccaacatggtgaaaccttgtctctactaaaagttcaaaaattagccaggcgtggtgggtgcctgtagtcccagctacttgggaggctgaggcaggagaattgcttgaacccgagaggtagaggttgcagtgagccgagatggcaccaccacactccagcctgggcgaccgagggggactctgtcttaaaaaaaaaaaaaaaaaaaaaaaatatatatatatatatatgtcaaaaatggggtagtttttagatctatagtagttctaaaaacaaaggccatccaagcatgacagatttacaagcactattggctattccagtagttacaatggaggagagaagcttttagttaaaacaaacaaacaacacaacaaacccagaaaccttaggtcaaaaccaaaattgtcctctcagacacaatctgggaattttctcatgacagtgggcattagccaactgacatcagcagcaaccatccgtgtgcacacagtggcaccacctcctcccaaaaagcagccttcatctatgccctcatacaatcgttgattattctctttggattgaggcccggaattatttaagtttcttcttgccagcatgagtctttcctttctgtatgctccttatcttctctctttaatttggcagttctgcttgaaatctgggtctttcattagtagtagttcaatttggttccagaacattctgtggtgtgatgcaatgtgaccagagctcacacttcagagctcttcaagggccagtcttactgagcacctcccagtggctgcctgtgtgctgggcgccacttgtggtgggcaggagagaggaggggacacaaaaggagacacagctccttcttagaagctcaaagttggggaccagctgccacagaagagtatgtttagcatctgagacaccaagatccagcgtcacaagggtgtttattaagcctcctcatctctttctttttctttttttttttttttttcctcaggcagtcttactctgtcacccaggctggagtgcagtggcatgatctcggctcactgcatgcaaccaccacctcccgggtttaagcaattctcctgcctcagcctccccagtagctgggattacaggtgcccaccaccacacccagctaatttttgtgtttttagtagagacagggtttcaccatgttggtcaggctggtctcgaactcctgacctcagatgattcacccacctcggcctcccagtgtgctgggattacaggtgtgagccaccgcgcctggccttgctgttgattcatctatagtatgtttgacttgatgacctccagttaccttagacagaggttctcatctaagctccaactttccatttcctttgtcctcgtctttccccttaacccctccacatttctctcaaaatcaccccacttctaaaaaatactgtttatttttcttttaaatttcaaattatctatactcattgaaataaatcaaaatagcatggaataagcgaaaaaaatggatcccacccttccccactcccattccctagggctaaccatagttaaccatttaatgactaggtttttttgttgttgttattttttatttatttattttgagacagagtcttactctgtcacccaggctggagtgcagtggtgtgatctcggctcactgcaacctctgcctcccaggttcaagcattctcctgcctctgcctcctgagtagctgggattacaggtgcctgccaccacacctggctaatttttgtacttttggtagagacagggtttctcaatgttagccaggctggtctcgaactcctggcctcaagtgatctgcccaccttggccttccaaaatactgggattaaggtatgagccaccgcacccagccctcctgggctcttttcctttagttgcactcgctccccgctcctggagtagagggatttccgagagactgtgggctccagccttcacctaggcccaggactaggatgcctgccctaacatttatctttataccttaaagcaaaacagctggaccataagcattcaagaacaaactgtgaataaggagaaagttctcccaggaaacaagagctttagttatgttgggccagcccttatattccttagctgttaccagtcactgcttgatttaatctcggctatcacttggcctgacaggtctgctgctggtgccaggatgtctgggttttgaagcctggctccattacatacttcctgtgtgaccttgggcaacttactcaacctgtctgttcctcagtttccccagctgtattatgtcagcataatagtttgttgtgtgaattaaatgaggtaataactggaaatgcttcaaacatggttcctatcatgagaaatcctgctttccgcctaaatgtgctggaaaattcctggtggtgcagaacaggagaccagagcaaaggaaagacagggtgcagaagccaaaaattaccttggagaacaaagcgcatgttaaggttatttttggattctaggtttatctctgcttggtcttcagttacctgcaagagatccatttaggggatttttgtttgtttttaacgatagctttattgagatataattcatatgccataaaagtcactcttttaaaatgtttccggtatattcacaaggctgtgcagccttccctgtccttgattccagtctgagtttttaactgaagggataaggaggaccacgctttccccagaccagaaccgcgggccagggggcgattccgctgagtcaccgcgggcgcctggtgcgcggcggcggagcccgggaccttccttggctgccccctagcgagggccgcagcgcagcctgagacacccgccggggccgctccacggccgtcggatttagactggaagctcggtccaggtccccagcttgatgcgcccgcggtgtaggagaccagcccgactcgagcttcccctgagcccctggactcttgactccagcagggcctgggtaatgaacgtcagctcccctttcccaaaggggttgctctgttgggaaggcacccgtttgatacagtagcatagagatgggttttagcatcaaaatatcagaattcaagccttgctctctgcttactagctgtgtgaccctaaaaaggtttctgaacgtctctgagcttcagtttcctcatcattccttctcacggggtggttgtgagcattacagagatcctctctgtgaagcccctgtgagtggctcatcctgagggctgaaataaacatgttattaataatccaaaactggcaagggatgttgactggtccccctcccttgcccaaggagctttctagaacctgagttatcattaccaaactgtactgccttgagtaagaaagttagaaggaatgggaaggatggtggcaggtggaggaaggcggattggtcatcacctccttgcagcaagaaacagccccagatcgtgggaaacctacagacctgctagacagactaggagcaaaagctggggctttaagaatccccagggaggttctcctgagagagtagccagttggattttgtaagcagagatttgtttggggaggaggtgacaacgtagggagcagaggggcaaagctgtcgggaatcctgccttgagggcagggatgtgtgttggggggagttgggtcactggggctcggtggccttgggcaagtttctacctctcaggtcctttacccacctagggtcgccatcctgcccacctcacaggttacagtgagcctggatgcactgtcatgggcaggtgcccaggaaaatggcagacatgttccaaacagcacgcagcattccccagtgatgcccagggtcaccttggaggtgggcgagatgcctggggtttctcgtccaccccacaacacctcaggggacagccaaagctgtcccttcaggtaagctgcacagaagatgtgaactctgctgcaaagactctattctttgggagcaaaagggacccagggtctcacctgcacatccctgtccctgagggcctaggggttcttggaggccccagccttggcaaaatgaggaagaaggtgaaggttgtctgggcccctgccaggctccttcctcggccacgcactccccttcctgcacacacacccttctccctccaccccatctccattgttgtcagaaaagtcacaataaaaaggtccatattgtctagttcccatacttttaatttttaaaattttatttatttatttatttatgtattttttgagacagagtcttaacccaggctggagttcagtggcatgatctaggctcactgcaacctctccctcctgggttcaagtgattctcatgcctcagcctcccgagtagctgagattacagatatgtgccactatgcccagctaatttttgtatttttagtagagacggggtttcaccatgttggccaggctggtctcgaactcctggcctcaagtgatctgcctgcctgagcctccggaagtgctgggatttcaggtgtgagccaccgcactcggctccacacttttcacttattaaaagactgtggtgtccatcaatggatgaatgaataaaccaatgtggactatccctcccattacccaaggaatgaagcacggagccgtgccaagatctggattcacagtgaaagaagccagtcaccaaaagccacgtgctgtgtgacttcccttatacgaaatatccagaagagatacatccatggtgacagaaagtagatgagcagctggggactggcgaaggggagaagggggagcagctgtctatgaggtccagcctttcttctgggtttggtgagaatgttttggaactagatagaggtgatagttgtacaacattgtgaatgtactaaatgccactgaatcattcattttaaatcgttctttacgttgcatgaattttaagtcaatcaaaaacagttgtttgaaaagagaaaagcctatgggtagcggcagcagtgattggatttatgattcgattccatggctcatccctcccctgcctcaccccctcgccctccgacgtcttcttcttttactctgaactgttatctttgttctcatctctctctctctctctcaaccctgcagacacttttccctttctttgtctgcccccaccctccagatttccgtgtctccagtgtctccctacgaggcatgaattgagactgggagggtgtgattctgaagaaggcaccaacagtgactcagctagccccttcccccaccccgccccccgggcctcaatttagctaaaaaaccacagggacggactcaggaggcaatacctttccaagggtccctaaaaaatgtcccattttagtgtccaggtttcactcaactttagtgcctcccctaaaatgtgttccttacctcccaccccactgcatctaagtcactgcctgagaaaacaggattgaggaaaggagaaaggaagagagagagagaggaggagagagagagagagggaggaaggctgatggatttagaaaagaagaaaacaagtggtctgaggaaaacagccttggtgtgtttattttcctgtctgtgtatcgcttctcggccttttggctaagatcaagtgtattttcctgtctgtgtgtctcgcttagattacagggatctgtgggtgatgacacgtctggtccaggctgcgtagtcacctcaagggcatgcttattgatgtgtttttcaattcactatctttgcatgggagtcccaggccaagaggcacagctgcgccatttgtctgttggtttagatatcctttatccagttcttccagagaaatcatcctgcccttctggaggaggtgggcagcaggggtcagagatgggagggaaaggaaggagccaggtccttggctaggatgccagggtcccctgcctctcacctggcctgggctggaggcctcctgctgtcctgtcactgatcactaccccgccccagcctcctgagttagaagacacaggctaaagtagagtatttcttcattgaaaaacccatacaaaataaaggttcataaaaaataaaaatttagactgggtgctgtggctcacacctgtgatcccagcactttgggaggccaaggcaggtggatcgcttgagccctggggttcatgaccagcctgggcaacatagtgaaaccccatctctacaaaaaatacaaaaaattagccaggcatggtggtgcatacctgtggtcccagcttctcagcctatggacccacatagaatacaatgtcagcataagaagggagccctggggtcaccaaatggtttgggcggcaaagaacctgaaggttgagagaagtggcttggttacccagctgttggatgtgagacctggccactgcttcttccataccctagacctgcaccctgacatctcaagtaaaaagttgggggatgttttatggtccaggatgaaggaagggcagtgaggggcagcggagcatcactttgcatttctgtctgcctcttactggctgtgtgacctggggcaggtaacttcccagactcctgggaatcataacacctatgatgatgatgatgatgatgatgatgatgatgatgacacctacctcaaggattgccctgaagggtcacagagatgcctgcaaggcacctgcatggagcaagcgccccttctctggcaggtgctgggtgagcactacctgctgccaggccctggggctatggcactgcgtgaccctgcaagtcctacctggcgaagctgtcgttcttgtgctcagtcagtgttggttgtaagactgagaagagtcacttcattttgctctccagggacatctttctgggtcctattttctgcctatgtcaagtagcgcctcaaggatgctcctgaaaatgggcttgtctttcttaacatggcaggtaggtcccaaagcattagcatggggcagctgacctagcccagccaatgcagtgcagtgactcttgcaaccgagtctaatcagaaggtccatgaacctacgagcatttcctgtcccaggatcagggtggaggctgagcctccctgcttagagattcttcccatgcattccacttttttccccaaaagaaaatattgacccttgagaggcacacagtttatttattttgcatagtaaatagtagcctgtattttaaggatgagttgatttctgcatcagcccctgtaggtcatcagccttctattggtgcatctgactctctctagccctgcagggatggtggagggggaggggaaggagggatctttattggaaaccaggacagtgagactcattgccctgtcatctgctctgtggtgctgaatgaggcagcccaacagagaaataccctgagcgagcatccccagcctccaaaacagtggcgcattgccctgagtcctgggaatgacctttgattctcctgctcctgacttggaacccatggaaacctctagaagcagctgaggaaaacccaacatgaaaagcagaactccacactgagaatataggaggtgatcggaacatacaatgattcttgctaagaccgattcacagtttttcttttttttcgatcgaagaaatactggagaagcctaaagaaggagtctaaaaactctggcacgtgggccaaaactgtccttgagctaagaatgattttcacatttttaagtggttgaaaaatgaaataaaataagatgatgttttgtgacacatgaaagctatgggaaattcaaattctaatatctataaatagtgttttatcagaacacagtcatgctcatttatttatgctcgatggctgctttcccgctacaattacgttgagcagttacaacagagaccacgtggcccacaaagccttacaatatttactatctggccctttccagaaaaaaatgtgccgactcttgaccttaacctcagcaatttgggaggccgaggcaggcggatcgcttgagctctggagttcatgaccagcctgggcaacatagtaagactccatctctacaaaaaatacaaaacattagccaggcatggtggtgcacacctgtggtcctagccactcgggagactgaggtgggaggatcgcctgagcccaggaagtcgaggctgcagtgagctgtgatggcaccactgcacctcagcctgggcgacagagcaagaccttgtctccaaataaataaataatgcaaagtaaaataaataaaaccatataaaaaggaatcaatttaaaattataatgaaagctggccgggcatggtggctcacgcctgtaatcccagcactttgggaggctgaggtgggtggatcacgaggccaggagatcgagaccatcttggctaacacggtgaaaccccgtctctactaaaaatacaaaaaaaaaattagccgggcacagtggcgggcgcctgtagtcccagctactcgggaggctgaggcaggagaatgtcttgaacccgggaggtggagcttgcagtgagccgagatcgtgccacttgcagtccagcctgggcgaaagagcgagactccgtctcaaaaacaaaaacaaaaacaaaaacaaaaaaaaattataatgaaagccaaggggcatagtagaacaaattttctagagctcattaagtcaaatgagtcaccagttagtaaaacgcagtcacggggaagagagggcaggattctttgaagcagcggctctcctaaaaacaacccacccttgtccagctgccttccctcctgagggtgttccctttgactgtgtgacccccatcccctatttcccaaccgtccaagcccacctctagcataatacgagcttttaatccctctccctgaccccaacccgattttgaagcccagtctagtattttctcaaatacacttcttggctccattccttcctttccatcacctctgccttttcactgcatgcttggaccactgcagtcagctccctatgaacagttgctctctacccatccaatcggccccgcctgctgctgccaaattcaccgagggcacctctgtggtgctgcctgtggacaaagtccaagccagccacctcacccacctacaggtgagtggggagcagccagcgtgtccagtggtttaccccatcgccacagacttggtgatgtgtcgatgtgcagagaaggggtgttggcagccacaacacaagcaaccccgccccatgtgagatctaagatgggcgtgctgggagccacctctgagaatccaacagaaggcagaggggagaacggctcacacggcacaaacactccttccttttttttttttctttttcctttttgaaaggagtctcactctattgcccaggcaggagtgcagtggtgcaatctcagctcactgcaacctccgcctcctaggttcaagcgattctccagcctcagcttcccaagtagctgggattacaggtacactccaccatgcccggctaatttttgtgtttttagtagagacggggtttccctatgttggccaggctggtcttgagctcctgacctcaggtgatctgcctgccttggcctcccaaagtgctgggattacaggtgtgagccatggggcctagcctccttccatttaaatgtatgcctaatttgcccattgagaacggctgagacgcattttaagtggccagggtctacttagagttagtgctcatgaccaggcccaggtcaagcctggctggccagatggtgcctttgacctgctctgtctctgtgcaaaggaatgagctgaaggatgggggtgcagtgtgtgggcagtgggctggggctggcaggactcagtgactaagggaagagaactttcctcactaccagcctgtcttttcagggcaccgcggggggctttgggacttggtgatgaacacagcacagagagctgtccagcatgcgggtccctggcttctcacacttcccaggctccttcagaggctctctccaaagggagctgctctctctagaacccatgaatttggaatataggcaaccactgcattggggaccactgacctcaaacatagagaccagagcaaatggggctcatcacgtgaaactcatctggaactctagcaggttcttttatatatatatatatatatatatattttttattattatactttaagttctagggtacatgtgcacaacatgcaggtttgttacatatgtatacatgtgccatgttggtgtgctgcacccattaattcatcatttacattaggtatatctcctaatgctatccctccccactccccccaccccacaacaggccccagtgtgtgatgttcccccttcctgtgtccaagtgttctcattgttcaattcccacctacgagtgagaacatgctgtgtttggtttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttataacagcatgatttatattcctttggttatatacccagtaatgagatggctgggtcaaatggtatttctagttctagatccctgaggaatcgccacactgtcttccacaatggttgaactagtttacagtcctaccaacagtgtaaaagtgttcctatttctccacatcctctccagcagctgttgtttcctgactttttaatgatcgccattctaactggtgtgagatgttatctcatggtggttttgatttgcatttctctgatggccagtgatgatgagcattttttcacatgtctgttggcgaactctagcagcttcttttcacaagttcatggagagaggtttcccactgagggaatcacatctgtctgatcaaaagaggcttgggaaatggctctcctgttcattccctgaaaacctctgatggaaccactgccactgtggcagccccagcactggcaccccagccatgattggtgccccagccacatctctgctgtgagccccagagccctggttaattaatcatccacgtgttgatggggagaggcccattcacaaaagcgacataaagcccagggagacgtggccgtggcaagaagggtgtgggactacattccgcccccaactgagagattcagaaaccagaaaaaaatggaaaaacatactgtgctcttgggtgggaaaactaaatatcatgaagggagcaatttttatagttttggcctataatacaattccagccgaaatcccagtggaactttgagaatttgcaggaaaaaaaaaaatgtctaaagtacatctggaagacaaacttacaagaaggtcaaataattttgaaaaagaaaatgatatctaagcccacctagagaataagacttgagatccaaagctaaatcaggaggctctagcaaaattgacagataagcaggacagagtgcatggtgcattcacctggggaagagggcagattggtctacaaataggcctgggtccactgactttagctgttatatttggggagaaacttttcaacctcactccatcttaaacctaaaaatattccagatgaattaataaatataaaaaattagaccactaaaaatgtagaagaaaatggatgatctttctataccatagagcaatggaataaatcacaaaggaaaacagatttgactatataaaacttaaaccctgcccatcaaaaaccatcagaaaccaaaataaaaggcaaccaactggagaagatagttgccacaaatatgatcaagggttaatgttattcataaattaagagcccacacaagtcattagaataagcactgagacctgaacagacaagcaaaaagaatgagagtgggtcggcgcggcggctcatgcctgtaatcccagcactttggaaggctgaagcaggcggatcacttgatcccaggagttccaacaccagcctgagcaacatggtgaaaccctgcctctacaaaagtcataaatattagccgggtgtgatggcacacgcctgtagtcccagctactcaggaggctgaggtgggtggatcacttgagcccgggaggtagagtctgcagtgagccaagatcacaccgctgcactccagctggagcaacagagtgagaccctgacttaaaagaaaaaaaaaaaaaaagaggagaaaaatgctgatctcactagtaattaaaacatcaggccaggcgcagtggctcacacctttaatcccagcactctgggaggctgaggcaggcagatcacttgagatcaggagttctagaccagcttggccaacatggtgaaatcccgtctctacaaaaaatacaaaaattcgccaagcgtggtggcacatgcctgtgatcccagctactcgggaggctgagacaggagaattgcttgaacacgggaggcagaggttgcagtaagctgagatcgtaccattccagtccagcctgggctacagagcgagactctgtcccagaaaaaattaaaacatcacatatttaaacaactctaggatatcatttaaaaaaacattaatagactgttttttagagcacttttaggttcacagtgaaactgagtggaaggtacagagacttcccgtatgttccctgccctccacgtacagcctcccccactgccaacgtcctgcaccagagtggtacacttgttacaaccaatgaatcctcattaacatatcattatcacccaagttcatagtttacattagtaaaacatcatctttcatctataagcacaaaaattttttggcatttatttaggtgtatgattaactcagtgttgacaagactcacacttcatacccacttgcactgcatctgagaagcaattggtgtctacagccgctacaccctcaacaagcccgatcttgtttgaaaagcaattggtgatgcttctcaaaattctatggacaaagtcagccgggcatggtggctcatgcctgtaatccctaaactttgggaggccgaggcaggcagatcacctgaggtctggtgaaaccctgtctctactaaaaatgcaaaaattacccaggcatggtggctggggcctgtaatcccagctactcgggaggctgaggcaggagaatcgcttgaagcaaggaggcggaggtttcagtgagccaagattgcaccactgcactccagcctgggtgacaagagtgaaactccatctaaaaaaaaaaaattatggacaaagtttttcaaaaagatatttaatgcaactttatttgtaatattggaacatctgaggccatttcagtgctaactattaggggatggttaggaaaatatggtacatatgtggaaaggaacatttggtagttagtgcccctgatgtttacaaaggcttttagtgaccaacaaatgctcatgctataatcttatgtgaaaaaagcaagtagcataattgcaactatatttttaatgcatagaataaaaggctagaaggaaatatcacagatccttgacatacattcccaaacctttgtaaatccgcggattcatgaaaacagacacatttgcacaagtgcctgatcttttctgttatacattcattagaagtcaagccctggtgccacaaagtatctgccttttcaaatgtgatcagaatgttctcttttgcttcaaggccatttttcacgaagcagtggcatttttgcctcttcatcagagtcaccgtgtgccctggaggactgagaacagcagagccgttttaggatgggacagggcagccaggaggattgggctcactccctactgagtgcctcactcccgtacagcccccatagaggaagaggggttcaaatttattcctcagccagatggcatgtgccgcctgtcctggaatttcacatcacttatgatggaccaaaattccaaaagctgaatccatgattgtcaaagtctggtatggcaggatgtcaacagtaatcgtttctgggcagagggatgattttctcttcccatcttgctttgtataaatacattttctataataaggttgtattacttttctcatcaagaaatagcaaagtactgttttactcaaaatatgaatagagccaggcatggtggcagcttatgcctgtaatcccaacactttgagaggcggatatgggaggatcactttagcccaggagtttgagaccagcctgggcaacatagtgagacccccgtccccactcccccaaagaaaacccacaaagcatttatcctggattattcacaggggccaaaaaaaaaaaaaaattcaggcctcctatagccatgagctacgaatatgaaaatatgcaaatgtgtaagaaaagccagcacatccgatttttacttttactttcacacctctgtccaccatgttccaagagaagaaacttggtcattgaaaggaatagatcaaatccaaagaacaaaaccactgtgctcattaaacttcttagtgttcacaaagctttagctgcaggttgaatggggcaacccgaattggctggctcacctgggctgcagggagcagagatcgcgacactgcactccagcctgggcaacaaagcgagactctatctcaaaaaaaaaaaagttcataaattcaaagttatgaattatttttaaaataataataatttacaataaagatgaggacaaagtgtgagtaaatggtggtttctatccagctctgttgagctgaagtggcatctccctgctggggcttttggggaagaagggtgtgtgttgctcttcagatcccaagcctcatgcccctactgggccctgtggggtgcttctcagcccaccaggagagccaccgttggaacacacacgtgggggacctggtgggtgccggtgtggtgaatgggggccacagcctgactccaggaagccagcaaactcggagctggaggagtcaggacacccccgatgagtcaagagttggttttgctgccagttgacatctgattgaaccatctcttcacttctccgtgcctcactttccttaccagacaggctctgctgatgctgtccctctcctgttcagtcgtgccctcaccgttaaagagaaagagcaaactgctgggcagcagcattgatttttttaatgaagtggaaagagagctgggaataacaagtcgggcccacctcacctgcctcacctggtgggtttatttgttttgtttttttttttttgttttgagacagagtttcaccctgtcacccaggctggagtgcagtggtgtaatctcagctcactgcaacctccacctgccaggttcaattgattctcctgcctcagcctccccagtagctgggattacaggcacctgccacatgcctggctaattattgtatttttagtagagatggggttttaccatgttggccaggctggtctcgatcccctgacctcaggtgatccacccacctcggcctcccaaagtgctgagatcacaggcgtgagccaccatgcctggccgtcacctggtggtgttgaatatgaactgctgcggtgttggtaaattaagcaagcagatagatgtaaataacgcttgggcaggaatatggagcacgggatgaggatgggcggccaactgttagagagggtagcagggaggctgagatctgcctgccatgaactgggaggagaggctcctctctctcttcacccccactctgccccccaacactcctcagaacttatcctctcctcttctttccccaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaaggttagtggacagccatgcacagcaggcccagatcactgcaagccaaggggtggcgggaacagtttgcatccagaattgcaaagaaattttaaatacattattgtcttagactgtcagtaaagtaaagcctcattaatttgagtgggccaagataactcaagcagtgagataatggccagacacggtggctcacgcctgtaatcccagcactttggaaggcccaggcaggaggatcccttgaggccaggaatttgagaccggcctgggcaacatagcaagaccccgtctctaaaataatttaaaaattagccaggtgttgtggtgcatgtctatagtcctagctactcaggatgctgaggcagaaggatcacttgagcccaggagttcaaggttgcagtaagctgtgattataaaactgcactccagcctgagcaacagagcaagaccctgtcaaaaaaaaaagaaaagaaaaaagaaagaaagaaatttaccttgagttacccacatgagtgaatgtagggacagagattttagggccttaacaatctctcaaatacagggtactttttgaggcattagccacacctgttagcttataaatcagtggtattgattagcatgtaaaatatgtgactttaaacattgctttttatctcttacttagatcaggcctgagtggcctctctttagcaagagttggttagccctgggattcttactgtagccacattaataaacaacatcgacttctaaacattctataataccatcttttggccaaattgacttcgcctcttcctctctctttccaaatgaaatgtgtttcatttcactgtcagaccacatggttggggaccccacagagcacacagccctccctctgccttcccatgctggcccttcacccactgctggagtgccaggttggtccaagggttggaccaagttgtctgaggttgtctcaaggttggtcgaggctgtctccgcgctgggttgtgctacaaggagcccttctttccatgggtgtggctggcagtgagtgctcacagcaacagcccacagtgcagcccgagggcaggatggactcagtccctgcctccatacccatttctaaggaggcaaaatggcaaacactctacttttctcttttaatgctaaaaataagaaaacaccttgcagcccagggtatgggtagtgcatggaagccgtggagttgtgaggtgggaagtgacctctgctggatatgtctattcaggaagattgctggagtgggtggggtctctgggaggtcccctgagtgtgggaagctgggaccaccagctttctcgcacagggagtggccatcccagcttggagaggttccaggactggttgggaggcacgtttcagatttctatctgttgaatcagcgaagatattggattatgaggaatttgggaattaggaaagtgggtgcaggtgggttgggggtaggtgaaggaagacatgggcgtattgggggagcaggggctgctcagaggtgttccagaagctctgggtgaggaggtgagagggaccggggaatgcagctcggcccagcctccctgcctgaggtcagccatcacgtggtgatggcaagatggaaatgtgctttctgactgctccagccagtgctgccagattcagctccccagggagggcacctgagaggctccaagccaggagatctgttttctcctttgttttgtttttttttgttttgttttgttttattatactttaagttctagggtacatgtgcacaacgtgcaggtttgttacatatgtatacatgtgccatgttggtgtgctgcacccatcaacttgtcatttacattaggtatatctcctaatgctatccctcccccctccccccaccccctgttttctcctttgaatccttcttagaggccgggcgcggtggctcacgcctgtaatcccagcactttgggaggctgcggcaggaggattgcttgagcccaggagttccagaccagcctgggcaacatagtgagacctcgtctctacagataataattttaaaaattatccgggcatagtggcatgcacctatagtcccagctactcaagaggcagaggcaggaggatcacttgagcccaggaggcggaggttgccgtgagccaagatcccaccactgcactccagcctgggcgacagagacccccatgtcaaataataataataataaataaatccttctcagtcccttcctcactgtgtccccctccactgaatttttccacctcctctcccacttcccccactcccgctttccctctccttctctccccactccatctttttctttctctgctgtttctcgtccctccctcctctccatcccacaacactgcctaccctgtccctgccccaccctggtgctcaggatgtgtgaagtgaggggtggtagcccccaagacctcaaccccgaaggttagcctgttgaaaccactttctcccagctgcccccctggcagttggtgctgctgggggaaactgggattgggggccagattttgcctcttttcctgacaaagagagatgaagagttctctcaccaggtgcctgggactggggtgtgggtgtcccagcctatcccagcgcatctgttctgcatcatgattaatagtgctgctttcagccgggcgcggtggctcacacctgtaatcccagcactttgggaggctaaggtgggcagatcacaaggtcaggagttcgagaccagcctggccaacatggtgaaacctcgtctctactaaaaatacaaaaattaaccaggtgtggtggtgggtgcctgtagtcccagctacttgggaggctgaggcaggagaatcacttgaatctgggaagcagaggttgcagtgagccaagatcgtgccactgcactccagcctgggtgacagagcgagactccgtcctaaaaaaaaaggagttttgctctgtcgcccaggctggagtgtagtggcgccatctcggctcaccgcaacctgcgcctcccgggtgcaagcgattctcctgcctcagcctcccaagtagctaggattacaggcgcctaccaccacgcccggccagttcttgtatttttagaagagacggggtttcaccctgttggccaggctcgtctgggactcctgacctcaggtaatccgcccacctcagcctcccaaagtgctgggattgcaggcatgagccaccgtgcccagtcaactccttctcaaaaaaaaaaaaatagtgctgctttctctttcaagtgtcctgatttgggtgatagtaaatgccactctacttataagggatctacctcagaatgctaattgggacatttttgtagcactctactgttggcagcaggtgatgctcacaacagcccgtgagggtggatgacgtccgcttcacagatgacaaaggagcctcatgctcagaccgtgggctgccagagcaggtccatggctgcagccccacatggaccatatttcccccttgtcactctttccaccaagctcccttggaacttcagttattaagctctcttgggtggaatccaagttagaatcacaacatgtgcctcatatggattgtgccagtgaaaaatgacattctatttagaggcagggcagcctggcttagagtcagtttaaaatatgtattatgctgcaacaaatgtaccatgatcctgtaagatgttcacaacaagggaactggatgtggggtatactgtctgtactaacttcacaagttttctgtaaatctaaaactgttccaaaataacaagttcgtttaaaattaactccaggagaccaggtacggtagctaatgcctataatcccagcacttcggaaggctgaggcaggtggattgcttgagcccaggagtttgagacaagcctgggcaacatggtgaaatcctgtctctaaaaaaaatcacaaaaattagccaggtgtggtggcgcattcctgtagtcccagctacttgcggggctgaggtgggagaatcatctgagcccaggagtttgaggctgcagtgagctgtgattgtaccactgcactccaacctgggcaacagagcaagaccctgtctcaaaaaacaaaaatgaaataaagtccaggaaagaagtaggttttaccactcttattttctgaagagaaaactaaatttaatgtgtaaagtgaggacaagttcaccaagttagtgtttgagttgcctaaaatatgtttgctaaaactattcaaagctttcacataaaacatgatcagaagttctatgccaaaacatatgtgtgtgtatatatatatgcactatatatactgtatataaaaatgcaaaatctaaattgccaaccttttagaaattgctctgaaaggaaagcatttcaagataatttgcttacccaaagaatatactttccaagaaagcaagtaatacttaaggtgttcataatcctcatcaaattaattcttgctactgaaagcttacaaggagctgttttgatgtcgggtgtgacaggtttgacttggcagaaggtgtcactttactaacaacattttaaataagtgacagaagacaagaaactacacgttaaatgccagaacaaagagtgtctaagtggatgctaagagttgaaatatggctggatacctgcccaagagagctgaaaagtagatgaaagttggttacctataaactagtgcaccctaatgaattaaaaggtgttgatgagttaacttgttatgccttccagataagacatgcaaatggggcttcttcctccttcactacttccaagggatttaacaaggagaccaatgcaaatgataaggactgtagggctcaagctggggacagattggggaaagggggaccatcatgcccatatagatgtccctgtgccctggcagtcaaggctgctgaaaaataacaaaacccagaagtctgcgtgatgctgcctctccatttgtccaaagccttcttgcggcagtttgcaggcttttgcaaaagctccaggaccaaggagctatgttcatgctggaagcttgttcaggattagctgttctttgtgggatgggtgcagccagggccaggtgtccagggacagtgttttaacaaagggcatgaggtgtctgatctcacagtggaactccacttgcctttttttcatcttctcattctgcttcatgcacagaaccagccccatcctgaaactgactctaaattactcccgccccaggtggagtgcctttctcggagttcaacagagccttcctgtcgcccaagggacaactccactgaatgcccaagccacacccaaaacctaacaagtaaaaaccaaattctgtgctcccccatcctgggccattcctggtttctctactgctgttggtgataccaccatcagcttgtccatcatgaccctggccagttcctcccacaaccctccacagcacccagggacctcacctccattccatccgacacagatctcctcaccacaaaccttggttttgcaacagcagccatgagacctttacaccctccgcccttcatcctgtcccccactgaggccccagagccattccttaaagcagcgcgccacaaactataacccacaagccaattctggtacccagcctgttttgcacagccagtgaactgacaatgatcttttcatacagccagaaaaacaaaacaaaacaaaaaacaacaaaaaaaaaccccaccattctgagcatgtgacttccatgttcaagatgtctcatgttcagaaaggcccctggaaaaggaggaaggggagctgggcacaaagggagaccctctcagctgagctcctcccatccagacattttcctggacttcctatccaatgacttcccttagcttcttatcagccacccctgtctgcccaggaggctggaagatgtggccttttaactgggcacagctctgtcctctatcatatcagggctctgttcccaaggagggtagagagaatggacaccaggtggaccctcagcagtctgtgccacagagggagtgtttgcaatttccagactaaaagtccccatgtgcttgacggggtatgtgactacaacgtgatgcttgacttttcctcatatgaccagagccactttgtccatctggtacaatgtcagctatctgctaggggccctccaggattcccagtcaattccatatctgcatcaccaccattggcactaaataaaataaaatactcaagttcctgctggtgagcatgagcagtgctacactgggcccttcaaccaaggtgacatgataatgactgaaaataatcactgccacttattggggacgtctcatctgccaggcatggtacaaagtgctttaaataagcattcaacaatttcatgctgacagaagccctgtgagccagtggagctactactatgcccattatacaggggagaaaactgaggcagagagaggttaggtaattcgctcagcctcacacaaccaataggtggtggagccaggatttgggccccatctgcctgactctctagaggctctatcttccagtcttccagagttgagtctaagccatgaataggacaattagacagcagaggaaacccattcagccaccatgtgcatgaagagtaaggaatttctgtcatacagaggggagtgaattcactgagctgagagctgaggaaccattgatctgatggctgagacaccactgggaagactggagaggcttttctgggcatgcagtgccaggcacaggaggagctgagggaagatgactaagaggtactggcaaagaattcagaaattctgatggaagctttacatgttaccatcacatccatccatctatccacccatccatccacccatatcttcctccctccacccaatcatgcatacatccagtcatctatacaccacccacccacccatccatccatccatccatcccttcatccatcccatcatccatccaattatacatacatccaatcatatatctgtacataatccattcttccctcggttcatccatccatccattcatccatccatccacccatcccttccttcatccttcctatcatccatccaatcatatatctgtacataatccattcttccctcggttcatccatccatccattcatccatccatccacccatcccttccttcatccttcctatcatccatccaatcatacatatatccaatcatacatctgcacatcaccagctcatccatctatccatttatccatccatccttccttccatccatcattcatccatcatacatacatctaaccatacatctctacatcattcattcttccatcgattcatccaattatccatcattccttcctccatccatcccattatccatttgatcatacatatatcatctatacatcatccattcatccatccatccatccatccacccatatcttcatccaatcaatcatacatacatcgaatcatctacacatcacccatccatccatccatccattcatctatccacccatccatccatccatccatccattcatctatccacccatccatccatccatccatccatccatccatgtaaccatccagtcatatatccaattacacatccatccagttatacattcatacatgcatctaatcattcaattatacatacacacatccatataattctacatccaattatacctccatccaattacacattcatacacccacctaataaattattaattcatatatccatccatataattatacatcaattatacatccatctaatcattcagtaattcacccaccatccagtcatctatccaataatacattcatccaatcatccatccatccatccacccattcatccatccatccgtccgtccacccatcatggtatgagccatgatttaccacgatggtcccctgtggacagcccaggtggggcagaactgaagggaagcccagggctgcccccataaacatttgcctcctttacatggatgagaactagatccacatgtataaatcctcatgatttgaaggtgcttttaccaacattcactcatgggattctcccaggagctctaggaggaggcaggtagagttgaggtcatctcacgcattttacagatgaggaaacggaggccctgagaggcaggtccaaggccacctgaccagaaagaagtggaactgggacttgaacccagccatcttgccccttggtcccatgctctctagcctgtaactcctgcttcctggtggggcatctccaggaggaccctatcggctggccatgggcctgccctggagtcttttgctctgtgtggccatccttcctccctcaggagagtgtgtgctcccagagcacaggctgtatcttctgagcattttgtcccttcccagtacctagcactcagctctgtatacattgggctctcaagaattctcaaccttccagagtgtaaggccttgacctgctcagccctggatactgcatgatgcattgataagcccataaaataaccagggcagattgactcccagtggccaaagtgccacagggaagggacaattcagcccttctaggaggaggaggaggtagttttctcatttctattaaggcaacaaaagctgccttactaaggacattcttggtggagggcgtgactgtcaaccactgtgatcatttgggcctctcttgcccaggcttcccattctgaaaggacagttttattgtaggtacacatggctgccatttcaaatgtaactcacagcttgtccatcagtccttggaggtctttctatgaaaggagcttggtggcgtccaaacaccacccaatgtccacttagaagtaagcaccgtgtctgccctgagctgactccttttccaaggaaggggttggatcgctgagtgtttttccaggtgtctacttgttgttaattaatagcaatgacaaagcagaaggttcatgcgtagctcggctttctggtatttgctgcccgttgaccaatggaagataaacctttgcctcaggtggcaccactagctggttaagaggcactttgtcctttcacccaggagcaaacgcacatcacctgtgtcctcatctgatggccctggtgtggggcacagtcgtgttggcagggagggaggtggggttggtcccctttgtgggtttgttgcgaggccgtgttccagctgtttccacagggagcgattttcagctccacaggacactgctccccagttcctcctgagaacaaaagggggcgctggggagaggccaccgttctgagggctcactgtatgtgttccagaatctcccctgcagacccccactgaggacggatctgaggaaccgggctctgaaacctctgatgctaagagcactccaacagcggaaggtgggccccccttcagacgccccctccatgcctccagcctgtgcttagccgtgctttgagcctccctcctggctgcatctgctgctccccctggctgagagatgtgctcactccttcggtgctttgcaggacagcgtggtgggagctgagccttgcgtcgatgccttgcttgctggtgctgagtgtgggcaccttcatcccgtgtgtgctctggaggcagccacccttggacagtcccgcgcacagctccacaaagccccgctccatacgattgtcctcccacacccccttcaaaagccccctcctctctctttcttcaggggccagtaggtcccagagcagccatttggctgagggaaggggcaggtcagtggacatctgatcttggtttagtatccttcattttgggggctctgggtgtggcctgggcctctggactttggccacggtgtttgttccagcccttctcctaacctgtcctttccagacactcggcatctaggttattagcacctcgcatactttctgacatgctcctcagtcctgattttgaccatcttctcttgcttcccatctgtgtcagtcaagactgcatttggctgtaagaaacagaaaccccaactaactgtggcatttacatgaagaggtttacttttctcacataatcagatgtctagacttggccagcacctcaagggtcattgatgctctcctgtctttattttctgtcatctttagtggttggattgttgcctcatggttacaaagtggctgctgcacttccaggcatcacatctgcctttgaagcaggaacaagttgcaaagtaaagtggccaaaagggccctgaaactaaatgtgtccccttaggaaagcaggagttttcttgcaagtggcaatcttctgcttatgtctcattggccagagctgggtcttacggccaccccttgctgcgagcaaggctgggacattgagcattttgccgtccaacctctttagcagaataaaccaagggggaagaacgttaatagtggcttttgagtcactagttggcagtatctgcccctctatctttccatcctccccatggagtttcaaggttcctttctcagtacttcttcaggctctgcacgttcatttggatcttgtgtcttggggtgaaaaactggcccaagtgtctccccaagcatccacctttggattaatttggaaaatggctgtcaagtgcccgcctcttgcttggtataatgctacagctttagaggacgcagcaggcatgggccttgccgctgaggttcttagcctcatgagaatatccagatcagattctcttggctccttcttagagccagtgatgcaagacacttcctgctcatcttgtcgggacggttttacaagttgcctgccatcctgagaaagtctacaaaacgatgccagacctcatgccagcttcccaagccttgactctcagtgctccctcaacaggattctggaagaatctcccaaacaagtcgcaatgccctctggaccctgtgcaggcatgagactcaagagcattggctcccacccctggtggagggaacactgctggggctgggatcttgcctggttgctccgcctgcacccaagacaaccataattaaaatgtccttcattgaacttggaaagccttcaaagctgacaactccttatgtgtacccggaaaggcctgggagtgtgccagggcattgctcgggagggacgctgatttggaagcatttacctgatgagagactgacagcagctcctggtagccgagctttccctcctgcctctgctgtgaaggtggacccatccaacagtcaaatgcctgactctggacaggagcggacctatttattgccatgcaagggactctgcacttttgaattgtgggtcatgggcttggatttaggggttagagctgggagaagtcttggaagtcacctagagatgacactgccattttgcagatgaggaaaccgtccaatcaaaatggaccaaggacttgcccaaagcctcacagcaaaaccataggcccccgcactaaccccagagtccctgtgctgtcttaaggatcaaatagttgtaagcaatcatctggttttcagtatttcttcttttaaaatgcctggggccatgcccagcagtctgtttcactgcagcgtttacacagggctgccgggctttcctggtggatgagctgggcggttcatgagccagaaccactcagcagcatgtcagtgtgcttcctggggagctggtagcaggggctccgggccctacttcagggctgctttctggcatatggctgatcccctcctcactcctcctccctgcattgctcctgcgcaagaagcaaaggtgaggggctgggtatggctcgtcctggcccctctaaggtggatctcggtggtttctagatgtgacagcacccttagtggatgagggagctcccggcaagcaggctgccgcgcagccccacacggagatcccagaaggaaccacaggtgagggtaagccccagagacccccaggcagtcaaggccctgctgggtgccccagctgacctgtgacagaagtgagggagctttgcgtgtttatcctcctgtggggcaggaacatgggtggattctggctcctgggaatcttgggttgtgagtagctcgatgccttggtgctcagttacctccctggctgcctgccagcctctcagagcatttagggccttctggacttctagatgctcctcatcttgcctcagtcagcgcgtcagttccagagacttctctgcagggttttctggggcaggtggtggcagacccgtgccttcttgacacctgaggtcagtccaccctcctgctcagactgcccagcacagggtcacctcccaaggggtggaccccaagatcacctgagcgcacagagggtgcagatgactggaccacaccttttggtgatcttaatgaggtggtcccagaggagctcagacatgcaatctagcatccagttctgggactctgtctccttttcaaacgtattcatgtagaacaggcatgacgagaatgccttgtcaacatgggtgatggggaatcaatcagacagggcgccgggctcaaggctgcagtcacccaagagtggctcagcccaccaggccctaggaaacgcctgcacagcctggagctcctggagtcatttccttcatgtcttcttcactgcacttacgtaaagatgccagccattggtttggtgatttggagggtgcccagttgcccaacaagaaatgcagaagaggcctagccaggatttcaccagcagtggagagtagagaagatgtggccagaaaagagtttcctttccctcctaaagatggtactccctgcagctactggggaagcctgcagcattctctagggctctgtgtgttgagagcagccccaccctggccccttctgagtgcatttctgctttgtgacttgatccgtgaagtcccctgagatgggcagaggggatgtcctcgaagctggggcagagcctcatccttgaacgtgaaggacgtttgaagactgtggcatgatcacaggatgagatcacagggaacttgagtttctctcctcctctcccttcacagttatttcactgagggaaatccctcccctgcccagaatgaaaactctagccaactcttgacttttccatcactccaaagtagttgaaagtacattagtctccacagtggcaaaacagtgtgcaaaagctaaataattagaacagccagtcccatgtgacagtcaaagcttctaactccattcaaagttgcagccattcccctcgagggctggcagggaggggaggggtaagagaaacaggaaggttcttactgagttggtcctggtgtgagctgcgtcacactccctgcagaggtttcaaggagactctctctctctctgtctccatggggaccttatttgaattcttctactcttaccccagcctgccatctccagctatcctcccctgaagagcccttctgctgcgctggattctggtggccatgtcatctcctcggccccgtgggagtctgaagatctggctgcagcctcacctctgaggtcctgctagttgccacctcttaaacatgatctgaggctcccatgcactctgacctgtgcccacatggggcccacgggaaacacgctggcaagcaaactgtgggtgtgcagacggttctcagggctgcagcacctgtcctttgctctgcccccaaagcaaggccagcccatcttccatcctctagtgttccttggtggggccctgaccacagtccaccaggtccctaaccagaggggacacacaccaggtgtcctcaatgtattgccttgaaacagttgtgctgggactgtgatggggggtggccatgtagccacccccaccacccccaagccactctctccaaggaaatcctcctaaagatccctttacatcctccatgtggtggggaggttctagagttgggtgcatgtgtcttcagctactgacaatgcagaccttagttggcacctcgctctggcctatcctgtttgctgttcttggcgctccagtgaaactccccatgggccatccagttggggtgcagtgtggccacccccttgcaggttcctgccttgctggagagcacagggccctcctggctcttgtaaaacactccccatggtacagagaggccagcagtgatgtgaggcccaacctccctccatggtgttcccaagcagctccctttctggggtcaaggggtggcaaagacagtgcagcgtccaatttctgactcaagccgggcctggctatcgcagctctgcactgtgtgtgacagcaaggcaactcacccagtgccgtggcagtgaccgtgtccgaggaagcctcctcacaccctctgtctcaaggactctggcatttagctggacttgctgtagctctgagcctttctgccattgccatcaccttgtcagaaactcaggccgaatctgcactcagagttgtgcccaggcagttgagccaacacttgctcagcgatattgtcacatgacaaggcactgtcaccactgggcgtcgtgggtagcgcagtgtcggctggatggacccggagggtgtctgtgtcatgctagtgctagtgatgggagccccgtgagcccattgcccgccctcccatgccctcagcagctgcctggggacagccaatggcctgggtgtttctgaggctaccacatggcttccaggaaactcgagaacctttctctcccttgcctacactcttcacacaggcctgtgctggccagcggtggggatccggcattcctatcttaggtgcagaaagtgactgactcattgcaggcctgggagataagactgatggcccagccagcaagatgtatggatttctcagaggcagtggcctctgtcattgtcctcaggaaatgctggtgattctggtggcctgaggtcaatgcatgtcaacgtggccaacttgccttataaactttttttctggacaattgcgtgcactgtcctgtaacagtgtcctgttgtttatgatgcagaaataggtgtttttaaagcctattgattttggtactattaatgtggtcaggaactttctcagtctttcttgtttggggtgagctgtggcttcctaaacaggaacccaagacacccccaaaagctgctcaccagcactgccagcctccctcttaccaagtagcacccgttcaggacattctgcgaaaggcatttgcccagaagttgggaggaaggaaatgtaacattttggggcacctaccatatgccaggcaccaggctaaacgtgttcacacaaattctcttactaaccctcaccatccttctacaagacaaactagtatcttcatcttggggttcaagatgaggaaatggaggctcagagaggttgaatgaatgccggtgcctggatatgaaccccatctgcctgactccgcaacccaggcaaagtctttccttgaacttcccagcagccactgcttagacacagcctccacaaccatggctcagcagcaaattgcttctctgacctcactcagcctgtgtgtccttgttgagtgaggcattcaggaccctggtcccaaagtggagaaagtctttcctactaggtcatagctacacctgcatgtgggtgctgtgccttttgtttagtgaacttttatcaccagcatcctcagcaatgacatttgcagagaagccagagctgaggcaccttggtattcttgggatgtgactttcctgaatgtttaagggaaaatgcccgaaggtacagagagcttggtttctagtaaacaataactgtcttgcttttaccccccttcatttgctgacacatacaccagctgaagaagcaggcattggagacacccccagcctggaagacgaagctgctggtcacgtgacccaaggtcagtgaactggaattgcctgccatgacttgggggttggggggagggacatggggtgggctctgccctgaaaagatcatttggacctgagctctaattcacaagtccaggagattttagggagttggttcttatcaaaggttggctactcagatatagaaagagccctagtggtttttttctaataccatttctgggtaattcctaaggcatttagtgttctgaaagatgctagccttgtccagcctgggagttgagaatgaatgtctaacagaaactctaggccgggcgtggtggctcacgcctctaatcccagcactatgggagacccaggtgggcagatcacctgaggtcaggagtttgagaccagcctggccaacatgtgaaatcctgtctcactacaaataaaaaaattagccgggtgtggtggtaggtgcctataatcccagctactcaggaggctgaggcaggacaatcgctcgaacccaggaggtggacgttgcagtgagccgagatcgcatcattgcactccagcctgggcaacaaaagcaaaactccgtctcaaaaaaaaaaaagaaactcaaatatgtgtgacaggcgattctcactgcaggctgccctgtggctgatccaggagcaaggccttaaccatgtcatccccaagcgattgcttgtaaactttcttctgtgcagccttcaacccttattatgattttcttctcaggaaccaaactgctgtattcaagaaaggcagctttgtgtaatcatttatcataaatatcttaagaaaaatcctagagattcctaattttaggaaatgggagacctatggtactgatataatgtgggctgggcttgttttctgtcatttgctagataaatgaacttgagagcctactgtaaaatgtggaagcttctagattgcagaagggctggaaagacactgttcttttctcccgagtgatgggatctgtccagtatttagagctgcctctgaggccatctgattctaggagactctgcctcgttgaggatattttgaggcctaactacacattcctgcccccagagaggtcacagcctatagcaggctgatgtttctcatgtcacatggcacagaaaggcacattttcgttctcaggctaacaaagagcttcaaaaactattagaagggacagtggctataagagaagaacctcagtcaatgtgtgaaattaactaggaacctggctcctgtttcttttaggtcatgtttttcagcttaggtaaaactagaggctttgataaagcatgacctctagaaatcattgcttttcataaatggaagtgggtttgagttttttctactgattgttagtgcaggtgatgtctacatgcccccagaacatattccatgcaacaaaaaaagcccaggtcaccgtctttgctgggaacttgacttttgtgctcactgaattttaagctttctgacagcagcctggaatcatggagggataaagtacctattagtaagatggaaaaaggtgtttcaggttggagctgcagtctgttgagagtaagctatgggaaggcctgtatacgaggggtggacttttcttctgtaagtgtccagagaccaggcctcctgaagagggcatgggggcttaacttacctggactactgtgtttacaatactcatttatcttgaactcctcctaacccctgagaattgctacatttagtatttgctgagtacttcctagcatcctagggaatcaatagaacattctcccaaccaggctgggtgcggtggctcatgtctgtaatcccagcactttgggaggccaaggtaggcagatcccttgaggccaggagtgcaagactagcctggctgacatggtgaaaccccgtctttactaaaaatacaaaagttagccaggcatggtggtacacacctgtaatcccagctacatgggaggagtaggaggcaggagaattgcttgaacctgggaggtggaggttgctgtgagccgagatcatgccactgcactccagcctgggcgacagagtgagtgagactctgtttaaaaaaaaaaaaaaaaaagaacattctcctaacctggcttcttcctccaggggtgtaattaatcatgtcagtttcctcattgatacacacacacacacactacaatcctgtatccattacttttcaaggtacatttactatttacgtttggggtccttgtctcttttttaatagtgtttcttaaagtcttgtattatatcagagtacagtaacatcccagtcaagagcactctagtaagctctaggaggaaagcgacttccggaaggcagtggagacctgtcctgttggggcagcataggggcagcccctgcctctggtcagttctggcgctcaggctcagggttgcctctgggctgttcttcccagagactgacaaagggctcccataaggcacctgcagagcctgtgagaagctgaagtcaatgttttcctgacaccagttgatctgtgcaggatccattgatttaaccacctgctgtgtggcatgcactgtggtcgatgccaggaacaggaattggaggggcccatgagcatggccagtatcacaggctggaggtgctgctgcgctctgaccgggcctcttggggatgagcccatgtcaaccaccttgcctccgatggggtcgggcccacaggttacctttgtgtgtccatgaccacaccttcctccccgacctcatccaaatctctttcttttccaagcccctgaatccttcagggctgcaggttttgtttaaagcagagctggtgagttgcataggttgttgcgttgggactagatggggtgttcaaagagttgggagttaaaaaacataaagggtatttattaggagaaccaaggagtgtaattctcctgttcttaatatgcggccaggttaatgaatgtcacgtgaatgaaccagaaaaaaatgaagtgtgcccttgatcagctgggttggtgtgcagcaagctgtgtgaccaggggacagcagtggtcctgagggccgtcactgtctgccgtgcagagcccttcctcccacgggggcctacctcacctgtgccaagggcttgtctgtggtcagtgacctggatagatctgaatggggcttctttttcgaggagtcttatggcaggtctctcagtaaagactccattcttgatgatcacacattttggattttccaaatctgtcagagaatgggcttgaggcggggtttgtgggcactagtttcactggtttcatttaccaaaaaggggagcagaagtcaagtatggtggctcatccctgtaatcccagaggcaagagaattgcttgagcccaggagttcgagaccagcctgagcaacataaggagaccccgtctccacaaaaatgaaaaataacattttagtcagacgtggtggcatgcatctgtggtcccagctgcttgggagggtgagatgggagggttgtttgagccctggagttaaagttgcaatgagctgtgattgcaccactgcactctagcctgggtgacagaacgagaccctgtctcaaaaaaaaaaaaaaagaaagaaagaaaggaaaaaaaaaactcatgcctgtaatcccagcactttggggaccggggtgggcagatcacgaggtcaggagatcaagactatcctggccaacatggtgaaaccccgtttctactaaaaatacaaaaattagccaggtgtggtggcacgtgcctgtaatcccagttactcgggaggctgaggcaggagaatcgcttgaaccagggagtcagaggttgcagtgagctgagatcgtgccactgtactccagcctgggcgacagagtgagactctgtctcaaaccaaaaaaaaggggtggggggcgggggcaggagaacagtgagaggtagggagaggaaaggggattctcgctacacccaaaccagataccatctagaggctagaatctttgggaggctcaaattccctagaaagcaggagaagcttctgtagccctcccgctttcccagtagattaagcccagggcggctccagatgtgtgacatgctctgtgcccaaccagagcccatcataggcagaggaataacacccacaccagaagggccctcggaggtcaccacgtccaagaaccctctttacagatgaggaaactgaggcccagagaggggagagccacctagcgagctggtggcggctagaccaggagagctgtcattccaagcaagcaaaggcaacgagacgagcccagagctgtgctcccatctctttgttagggggcctgggatgccctctcagtgtcattttgtccaggatgatgctccctctcttaagcgattaatgcgcccttgctaaccttttgctatcgctgcctcttcaaaccagaggagttgagagttccgggccggcagaggaaggcgcctgaaaggcccctggccaatgagattagcgcccacgtccagcctggaccctgcggagaggcctctggggtctctgggccgtgcctcggggagaaagagccagaagctcccgtcccgctgaccgcgagccttcctcagcaccgtcccgtttgcccagcgcctcctccaacaggaggccctcaggagccctccctggagtggggacaaaaaggcggggactgggccgagaagggtccggcctttccgaagcccgccaccactgcgtatctccacacagagcctgaaagtggtaaggtggtccaggaaggcttcctccgagagccaggccccccaggtctgagctaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaaggtctgtgtcttgagcttcttcgctccttccctggggacctcccaggcctcccaggctgcgggcactgccactgagcttccaggcctcccgactcctgctgcttctgacgttcctaggacgccactaaatcgacacctgggtgcagctgctccactccctcggcctcctcccgtgctcaggctgtggccgcacgcgcccctcacgcttgcccgccactctgcatgtcaccagcacccccgctccgtgctccccaccttgtttgactctctggccacttgatttgtccacaacggcccatcagcccacaggaggtttggtgggtgccttccaccgacaggatgacgggtgccctcatggtgtctagaactctccaaccctcccatgtaggcataagcagccccactttgcagatgaggaaacggaggctcagagaagtacagtaacttgccgaaggccaatgagtagtaagtgacagagccaggtttgggatccaggtaggttgtctctgaaagacacgcctgtcctgcatcccacaacgcctcccaggaggtgctggagtgtggacgcctaacacagagatgtgcagggcacacacagcaggtgacacacacagcatccagaggtggcccagagctcatgctgtgcctttggcccagtgccctgcccccacccactctgccttgtggcaggaagacaaggagcagacacaagatctccctggtccacatgccaccacctccctctgcagaggacaaggggatcctcatgctggcattggagggggttgagcagggcccaccttgagccctcaggagcacgaccacagcagccctgcagggagggattggtgggaggagagtcccaagtatcagggagaggagagttggtgtcccacaggagacctcagagccacaaggcgagcttgttcataaatttgggacccttagcatttcacagttatttgcagagcccagaaatggatgttactgaagctcacagttgcaagcatctgttaaatttttattagattttacttttagggaaaactttgaaatgctataaagaagcctgtgtttaaaagttaagacagaggctgggggcgatggctcacgcctgtaatctcagcactttgggaggccaaggcaggtggatcatttgaggttaggagttcgagaccagcctggccaacatggtgagaccctgtctctactaaaattacaaaaaattagctgggcgtggtggcgggcacctgtagtcccagctactggggaggctgaagcaggataagtgcttgaacccaggaggcagaggttacagtgagccaagatcacaccactgtaccctaagcctgggcgacagagtgagactctgtctcaaaaaataaaataaaataaagttaagagagaaaaaaatatatcctatatcctttgttaaattccaaaacagtaggggacaaataactgacttgacaggttactacaatatttcctgaaatgatgttttcttgaatactggcctactagaggttcataggtgtgtttggattaaaaaagagttccatggcccagtgactgggggaaaaaaataaaagactaaagtaagttaaacaggcttttctgctgcaggacttgtcagagcctttaatgtactaatggccattgtgaccctctgagaaggtcacagagtgggtttcccaaacttacttgattctacctgctaacatttcctggaggaagtttgggaaatgccgatttagcagattcttttgttgtgccgtggatggtgctggttgatgtgggcaaaacaaagaacacgtgagtcagatccgcctggggctcttactaaagtgcaggttcccaggtgccactttaggcttacagacccagttgtggggtaagcctgggagtcttttagcaggtgattctgccacatagtatagttggaaaatctctgggcatactcattgctggtccctctagaaatccaggtgacaatagccaatgagaagctccaagagacccagttgtccatggggtagagggaatgtgatattgaaaccaaagaagaaaatctatgatcagttttcagcagtgactgtcaagagaaggagaagggtgagttagcgctgatgctggctgacaggtcagcgggttggtttcaccaaggagtgtgatgaaggctgatgttgtctgtgggaatgtatgatggtaactggtttgtagctaatttggggaagcagtgagaattcgtgccctttgaagaccagtaagtggcaagaaacccaccaggcctggctcagggctgggctgggcttggctcgtctcagagcagctggggctggtggccaaagccaccattagtgaggggcaggccctgggggtacaaccagcaactaggggacaaagacaaccctgccagcctctcctattctggaggcgtgtgaccagaaatggagatgggttggtcagcataagatggccaggaaggtggaaatcaggactgctggcaatctagccacatgggcaggggagccgggtggttccaggcagtttccaaggccaagagggtgagcaggcacctcacagggaatcagggccaagcctggctgcagtgtggagacaatgcacccacccccatccttggatcttgcaggaggctgggtcctcactgagctaccaacatccatggccctgaggcttttaaaacacccatccatggagtggggctggtcccagtggggtgaggctgaccctggcagaaacagggcaggagcctgtgggttagggagactgcaccttccttagatagcctccatgccatcatgtccccgtgacagtttctgctgcgtcccctctgcatggtcccaccctcggccagcctgctgccccctcttgccaggttgcgctaatcagtgaccccagtgtgctgtgttgatactaacaatgcgaggcctagcagattcaagggaaaagagaaccaactgggtttccaccagacccaactaaacaaacatggacctatcccagagaaatccagcttcaccacagctggctttctgtgaacagtgaaaatggagtgtgacaagcattcttattttatattttatcagctcgcatggtcagtaaaagcaaagacgggactggaagcgatgacaaaaaagccaaggtaagctgacgatgccacggagctctgcagctggtcaagtttacagagaagctgtgctttatgtctgattcattctcatatataatgtggggagtatttgtcactaaagtacagctgtcatttaaagtgctttgtattttggggcaggcttttaaaaagtccagcatttattagttttgatacttaccccagggaagagcagttggcaggttcatgaagtcatgctcctaattccagctttcttagtgtactttcagtgagaccctgacagtaaatgaaggtgtgtttgaaaaccaaacccaggacagtaaatgaaggtgtgtttgaaaaccagccctaggacagtaaatgaagccatcttctcactgcataaactgcacccagatctttgcccatccttctcagtatttcacttcacccattgtttactgtctcaatgactggggaaatgtctggggaaatgctcccgtaattgcacagtggcgtttttcctggaaaatcccaccatggctctagataagacctatttttcttaaaggtatctaaaatttccagcataaattctgtctgaaacacctgaattttaatcagtactggagcccggagggcatctccagttgccacatagctctgagcattcagtggtgtgttgagggctgctcccggaagtgcctgcagagtcagggctccccagcctcatctagtgaggcagtggaagggcctgtggggatttggagagctggcctgggtctctgaagtgatagtgacagctgcttgtcaatcacggtgcacatttagtgctgggggcagggggcagggaataccagcctcatgcatgcatgcattcatttgttccttccttcattcattcattcagtacacatgggtacaacatccctgccctggagttgcccagagtctagggaggggaaagatctattaccctgggcctcggccagctggggagtgctgctggtggagaggggccgtgtgcagcgagggaaggaggagtcgtcaatacccccaccccagctttgctttcttgtcatcagccccagggccccagcctgtgtccctcctctcccattgctacttcatctcctgggtcctccttaccaagcctgaccacacagagggccttggccgcttccatggggaattggaaagcaataagatagcatcccctagaagcccagtgaagtctgggacaggacccttctctgagctctgacttgctcttggaaacacttcgaggcttagcctccccactttgtttcccgagagtgtgacctgttcccctccaaacacccccttctcctccagggccatgcccacccgtcaaaatcccccacgggcaggacgaactgtgggtgtcagtcaccatctatcctgcatcctggttccagggccccccccagccccgcctccatagggacaggcgtgcagacacccgtccctggctgcttcctcttgtggaatgggttcaaaagtaagcagtgttgtttacactgacaaactgaaaaaaaaagaaaaagagataacattggaggcttggcacagtggctcatgcctgtaatcccagcactttgggaggctaaggtgggaggatgtccccagcccaagagttctagaccagcctgggcaacatagcaagaccccatctcaaaaaaaaaatttaattggccaggcagaggtgggaggatcacttgaacccaaagggtggaggctgcagtgagccgtgatggcaccactgcactccagccagggcaacagagggagaccctgtctctaaaacaaacaaacaaacaaacaaacaaaagagttaacattggccagattaggattcaccagatagtgttaatattagtttgatttgagactttaatcagaaagcacatgtgtggtgggggtgggtgtaacctaagtcaggtagaatctttccaacttggggggggcacactcctgattgtagccatatgagtctgtcagtgtggtggaagaggccatgggttaatgggcaggtaaaaaagcaccttgcctggaattgagtagaaagtaaggcccttcagaccccgtgacacacttggggacattttcttgagtaacatcctaagattcatgtaccttgatgatctccatcaacttactcatgtgaagcacctttaaaccagtcgtctccaaattcaggggcacagtaacatccaacaggctggagaaagaacgtactagaacttccattcctttttcatgtcctcttctaaaagctttgtcagggccaggcgcggtggctcacgcctgtaatcccagcactttgggaggccgagacgggtggatcacgaggtcaggagatcgagaccatcctggctaacacagtgaaaccccatctctactaaaaatacaaaaaaacgagccgggcgtggtggtgggcgcctgtagtcccagctactcgggaggctgaggcaggagaatggcgtgaacccaggaggcagagcttgcagtgagccgagattgcaccactgcagtccagcctgggcgacagagcgagactccgtctcaaaaaagaaaaagaaaaagaaaaagaactgtgattggggaggacggtcactttcctgttcttactgatcagaagggatattaagggtacctgattcaaacagcctggagatcactgctttcaaccattacctgccttatttatttttagttactgtccttttttcagtttgtttccctcctccatgtgctgacttttattttgattttatttatgtttatgtttaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcacttcccgaactggcagttctggagcaaaggagatgaaactcaaggtaaggaaaccacctttgaaaagaaccaggctgctctgctgtggtttgcaaatgtggggtttgtttatttgttttttagcctcaaagacctttcttcaaatgagttctggcatagaagcaccgtgtaaaatagttagaattctgggcaaaggggaaaagagagctgggggccatccctctcagcaccccacaggctctcatagcagcagctcctaagacacctggtgggaccttggtttcgaaatcgctactctaaggctgggcacggtggctcacacctgtaatcccagctctttaggaggccgaggagggtggatcacctgagatcaggagttcgagaccagcctggctaacatggcaaaaccctgtctctactaaaaatacaaaaattagccgggcgtggtggtatgcgtggtggtaatcgcagctactcgggaggctgaggcacaaggattgcttgaaccccagaggcagaggttgtagttagctccagcttgggcgacagagcaagaccctgtcgcaaaaattgtttaaaaaacaaacccaaaattgctactctcattgggttcctttgcccattcctgattttggcaagagaaatgcttccagattgccctgatctgggtaggacagcatcacgccatagcaacactgccccgtgagctcactgccccctcaactagcttgtggtccttggttaatgtcagtttcttttttgagtttgtgttatgtctaagggtcatctgctgggtaacggaacccagggactgccctagtccctagactgtgccatgcccgactctgccagctttgtcagtgatgctggtgctcgcctcctcgggtgctcgcctggtctgagcacacccaaggagttcttgaggccttagggttgtttgcgagagaatgaaagaacacgacctagctctctttagcatccttggtcaggttcaacactgcccccaggggcctctggtggagccaaccaccatcagccaaataaatccataattagagtcagaaaatggatgtctgcatatgtgtagtgcactaatgtcctgccgatgattgacatggagtggagagtgacctgatcattgctgtgagctctgctggccttggcacaactcatgctgataactaatgcacacagttcctctgggaggaaatgtcctcagggaacttggagtttgggtggggatgtgggtttgtgtgcccagcaagcccttgtggttgtagcagacactagtggcatctaggaggcaaagggtcaccccagtcttagccacgttttgagtcaaggtggcggagtggggctggtgttgactcttggtggcagtaacttttcccaatggtgaaaaacccctctatcatgtttcatttacagggggctgatggtaaaacgaagatcgccacaccgcggggagcagcccctccaggccagaagggccaggccaacgccaccaggattccagcaaaaaccccgcccgctccaaagacaccacccagctctggtaagaagaacgttctcttgaatcttagaggaagctgaagctctcagaggtacagccttcattttaggaggccttaggccactgagaatgaataacccctggcagctggtcagcagcttgcagtttactaagcactggagtcttcattgccttctcagtccttttgatttctgaggcaaatgttgaatccctacctttttttttttttttcttttgagacagagtttcgcttttgttatccaggccggagtgcagtggtgtgatctcagctcactgcatcctccacctcccaggttcaagcgattctcctacctcagcctccctagtagctgggattacaggcacctgccactatgcccggctaattttttgtatttttagtagagacagggtttcaccatgttggccaggctggtctcgaacgcctgacctcaggtgatccacctgcctcggcctcccaaagtgctgggattacaggcatgagccaccactcccagcctgaatcctcactttttatcaatgaagaaattgaggctgattctgcagcatgataaaaaaaaatacagaaaaaggaaaaaaaagaaagaaatcgagcctctgagagtttgcttgactgagtctaaccagctcattttaaacccgaggaaaatgcagtcacatgactactaagtggcagctctcggagcctctctggccccaagtccagggttccatagaggcagccccagcatggcatgttttcagtccccaaatgagactctggagacaaatgtctctggagacagagcagcagcctggataagtcacaatgggtgacgtcactcagggctcaacccctgggcagcttaacttgctagggacgttaggagtctgctgcaaaacctgagggtcttagctgagcagtcacaggctgggcccgttgccctgggctcctgtgagtaaaacccagtcaattttgagtacccagtaaggcatccattgagttattttgcagccaggagtgctattaagaacagtcgcggctgggcgtggtggctcatgcctgtaatcccagcactttgggaggccaaggtgggcggatcacctgaggtcaggagttcgagaccagcttggccaacatggcaaaaccccgtctctaataaaaatacaaaataattagctgggcgtggtggcgggcgcctgtaatcccagcttctcaggagggtgaggaaggagaatcacttgaacccaggaggcagaggttgcagtgagctgagatcgcaccattgcactccagcctggatgacaaaagtgagattccttctcaaaaaaaaaaaaaaaaaaacagtcgtcctctttggggattagggacagcctgcctgcctgcccgagcacttctctcttccattgccccagtgaagtattccaggcccctgggtttagactctgcaccatgtaggggtgtctgacctgcacttgctccttggtggcacgggcagcctatggcacttgctgcgggctgtgaccaaagcctggcctggatcttggatcttggtgactctgcttctccctggcctgagggagctgcccagagcctgcccaccacctgctgcgtgtctttgcggtggcatttctcgcacacatgccgtgcagtggcacccccaaggatggccattcactaaggcccattgtttttgtcttttcgcttcgtgttttctggcctggtgtttttctcatatacatgtgatccagggataattcccagaattttgacaggattttaagtagcgtttggatcctgctgtttttttttcacttaacatcgggccagttgactcacactctgttttttgttgttgtttttttgagacggagtctcactgtgtcacccaggctgaagtgcagtggcacaatcttggcatactgcaacctctgcttcccaaattcaagcagttttcctgcctcagcctcctgagtagctgggactacaggcacaggccaccacgccctgctaatttttgtatttttagtaaagacagggtttcaccattttggccagcctagtctcgaactcctgacctcaagtgatccgcccacctcggcctcccaaagtgctgggattacaggggactcacactttgtaacaacctgaaacaacgtgatgcatttccctttgggtcttacctgctcttcggtggctgcctgcaggtggagagaccctcccccttgggcccctcgaccttgtttcagaatggggcccctgctgggccagctgtgggtgcctgccacgtgaaggactcattaaggccctgtttaagcctgatgataataaggctttcgtggatttttctctttaagcgactaagcaagtccagagaagaccaccccctgcagggcccagatctgagagaggtactcgggagcctacttcgctgggagcagcctccctttgcgtgtgtggccattcactggcttgtgtttctagagccgggaggacccttttctgcaatgcagggttcacacagggttcgcagcctgaagatggagcagtccgaattctcttccctgtgcagtttgcgcagctgtgtttgtctgatgggctttctaatcctgtgtgctctccttgacttcagggacaatggcattacaggcatgagccaccatgcctggctgtctccctatgtttcagatgaagacataggcttaaggaggtcaggtgacttgcccacgaccactctgtaaataagaggcatgaaaagtatttggagccaccaccaccaagcccactggtcaccctgggtctctgaagtcagggaggcaggaggatgggaggtctgaggaggcagagaggctgagcctggaggccctggaggccgaggccccatctgttgtttccttatgtggaaaataagaggcttcgtttgtcctattgccacagagcgtactacttcaggaacatccaagacatggaaatccgcagggcacggtggctcacgtctataatcccggcactttgggaggttgaggtgggagaatcgcttgaggccagaagttcaagaccagcctgagcaacatagtcagaccccgtctctataaaaaacattatttttaaaaaagacatggaagtcaaattctaaaaactggtgctggctgggtgcggtggctcatgcctataatcccagcactttgggaggccgaggcgggtggatcacctgaggtcaggagttcaagaccagcctggccaacatggtaaaacctctactaaagaaatctttactgaaaatacaaaaatccagtctctactaaaataagtctctactaaaaatacaaaaattagccaggcgtggtgctgcacacctgtaatatcagctactcgggaggctgaggcaggagactcgcttgatcccatgcagcggaggttgcagtgagccgagatcacgccattgcactccagcctgggcatcagaataagactccgtctcaaaaaaaaaaccacaaaaaaacaaaacaacaacaaaagaaaactagtgcttattcgtcactggccaagctgcccattggctacatgggtgcttcaaagagctgcccttctccaggtctggccagcaggtatgtgttacagcaaatgcctggggcagcggcaggggcattgctgcgggaagcttctggacttgcaggaaagctaagttctcagactgcaggggagctaagcacacctcggcacagggtgaggcctgcggttctcagacttcagtctttgtggagcttgagaaaaatgaggctttgcaggtcccacccctagagattctgctctatccactcttgaaggggatcgagaaatttgcattttgcaactcccactttcctccttgaaagctccggagattctgacgcagggttccgtgggccacactttggaaaatacagacccatgagatagaataccagactgttgaagtgtaacgggggcctgggaagtgcagtaacagaagcaagtttgagggtaaaggacacccagaggagggagggacagcatctgcatggagaggagaagagaccccccagcagcttccagggtgttggaagggtgcgctagtaactgctatgcatggcaggtggggaactgtacgtcagggcacagcagcatgaagcggtatggctcgtgtggacagctagggacaggcaggcgtggagcaggcatcctgttctgaaggccaaatcccacagaggagccagggtgctggcaggagccctgaactagccgaacagctgaacagctgaacattcaccctgtggggaaagggtcagaagcgtccaggcttgagggcacagctgggtctcgtcactgcatcacccttatttaggataaaggccctgaagaattgtattagaggttggcaaagcatatctaccacctcctggagccacgctggccgcagggattataattatttccattttcaaattaaggcctctgagctcagagaggggaagttacttgtctgaggccacacagcttgttggagcccatctcttgacccaaagactgtggagccgagttggccacctctctgggagcgggtattggatggtggttgatggttttccattgctttcctgggaaaggggtgtctctgtccctaagcaaaaaggcagggaggaagagatgcttccccagggcagccgtctgctgtagctgcgcttccaacctggcttccacctgcctaacccagtggtgagcctgggaatggacccacgggacaggcagcccccagggccttttctgaccccacccactcgagtcctggcttcactcccttccttccttcccaggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgagagtggctggctgcgcgtggaggtgtggggggctgcgcctggaggggtagggctgtgcctggaagggtagggctgcgcctggaggtgcgcggttgagcgtggagtcgtgggactgtgcatggaggtgtggggctccccgcacctgagcacccccgcataacaccccagtcccctctggaccctcttcaaggaagttcagttctttattgggctctccactacactgtgagtgccctcctcaggcgagagaacgttctggctcttctcttgccccttcagcccctgttaatcggacagagatggcagggctgtgtctccacggccggaggctctcatagtcagggcacccacagcggttccccacctgccttctgggcagaatacactgccacccataggtcagcatctccactcgtgggccatctgcttaggttgggttcctctggattctggggagattgggggttctgttttgatcagctgattcttctgggagcaagtgggtgctcgcgagctctccagcttcctaaaggtggagaagcacagacttcgggggcctggcctggatccctttccccattcctgtccctgtgcccctcgtctgggtgcgttagggctgacatacaaagcaccacagtgaaagaacagcagtatgcctcctcactagccaggtgtgggcgggtgggtttcttccaaggcctctctgtggccgtgggtagccacctctgtcctgcaccgctgcagtcttccctctgtgtgtgctcctggtagctctgcgcatgctcatcttcttataagaacaccatggcagctgggcgtagtggctcacgcctataatcccagcactttgggaggctgaggcaggcagatcacgaggtcaggagttcgagaccaacctgaccaacagggtgaaacctcgtctctactaaaaatacaaaaatacctgggcgtggtggtggtgcgcgcctataatcccagctactcaggaggctgaggcaggagaatcgcttgaacccaggaggcagaggttgcagtgagccgagatagtgccactgcactccagtttgagcaacagagcgagactctgtctcaaaacaaaataaaacaaaccaaaaaaacccaccatggcttagggcccagcctgatgacctcatttttcacttagtcacctctctaaaggccctgtctccaaatagagtcacattctaaggtacgggggtgttggggaggggggttagggcttcaacatgtgaatttgcggggaccacaattcagcccaggaccccgctcccgccacccagcactggggagctggggaagggtgaagaggaggctgggggtgagaaggaccacagctcactctgaggctgcagatgtgctgggccttctgggcactgggcctcggggagctagggggctttctggaaccctgggcctgcgtgtcagcttgcctcccccacgcaggcgctctccacaccattgaagttcttatcacttgggtctgagcctggggcatttggacggagggtggccaccagtgcacatgggcaccttgcctcaaaccctgccacctccccccacccaggatcccccctgcccccgaacaagcttgtgagtgcagtgtcacatcccatcgggatggaaatggacggtcgggttaaaagggacgcatgtgtagaccctgcctctgtgcatcaggcctcttttgagagtccctgcgtgccaggcggtgcacagaggtggagaagactcggctgtgccccagagcacctcctctcatcgaggaaaggacagacagtggctcccctgtggctgtggggacaagggcagagctccctggaacacaggagggagggaaggaagagaacatctcagaatctccctcctgatggcaaacgatccgggttaaattaaggtccggccttttcctgctcaggcatgtggagcttgtagtggaagaggctctctggaccctcatccaccacagtggcctggttagagaccttggggaaataactcacaggtgacccagggcctctgtcctgtaccgcagctgagggaaactgtcctgcgcttccactggggacaatgcgctccctcgtctccagactttccagtcctcattcggttctcgaaagtcgcctccagaagccccatcttgggaccaccgtgactttcattctccagggtgcctggccttggtgctgcccaagaccccagaggggccctcactggcctttcctgccttttctcccattgcccacccatgcacccccatcctgctccagcacccagactgccatccaggatctcctcaagtcacataacaagcagcacccacaaggtgctcccttccccctagcctgaatctgctgctccccgtctggggttccccgcccatgcacctctgggggcccctgggttctgccataccctgccctgtgtcccatggtggggaatgtccttctctccttatctcttcccttcccttaaatccaagttcagttgccatctcctccaggaagtcttcctggattcccctctctcttcttaaagcccctgtaaactctgaccacactgagcatgtgtctgctgctccctagtctgggccatgagtgagggtggaggccaagtctcatgcatttttgcagcccccacaagactgtgcaggtggccggccctcattgaatgcggggttaatttaactcagcctctgtgtgagtggatgattcaggttgccagagacagaaccctcagcttagcatgggaagtagcttccctgttgaccctgagttcatctgaggttggcttggaaggtgtgggcaccatttggcccagttcttacagctctgaagagagcagcaggaatggggctgagcagggaagacaactttccattgaaggcccctttcagggccagaactgtccctcccaccctgcagctgccctgcctctgcccatgaggggtgagagtcaggcgacctcatgccaagtgtagaaaggggcagacgggagccccaggttatgacgtcaccatgctgggtggaggcagcacgtccaaatctactaaagggttaaaggagaaagggtgacttgacttttcttgagatattttgggggacgaagtgtggaaaagtggcagaggacacagtcacagcctcccttaaatgccaggaaagcctagaaaaattgtctgaaactaaacctcagccataacaaagaccaacacatgaatctccaggaaaaaagaaaaagaaaaatgtcatacagggtccatgcacaagagcctttaaaatgacccgctgaagggtgtcaggcctcctcctcctggactggcctgaaggctccacgagcttttgctgagacctttgggtccctgtggcctcatgtagtacccagtatgcagtaagtgctcaataaatgtttggctacaaaagaggcaaagctggcggagtctgaagaatccctcaaccgtgccggaacagatgctaacaccaaagggaaaagagcaggagccaagtcacgtttgggaacctgcagaggctgaaaactgccgcagattgctgcaaatcattgggggaaaaacggaaaacgtctgttttcccctttgtgcttttctctgttttcttctttgtgcttttctctgttttcaggatttgctacagtgaacatagattgctttggggccccaaatggaattattttgaaaggaaaatgcagataatcaggtggccgcactggagcaccagctgggtaggggtagagattgcaggcaaggaggaggagctgggtggggtgccaggcaggaagagcccgtaggccccgccgatcttgtgggagtcgtgggtggcagtgttccctccagactgtaaaagggagcacctggcgggaagagggaattcttttaaacatcattccagtgcccgagcctcctggacctgttgtcatcttgaggtgggcctcccctgggtgactctagtgtgcagcctggctgagactcagtggccctgggttcttactgctgacacctaccctcaacctcaaccactgcggcctcctgtgcaccctgatccagtggctcattttccactttcagtcccagctctatccctatttgcagtttccaagtgcctggtcctcagtcagctcagacccagccaggccagcccctggttcccacatcccctttgccaagctcatccccgccctgtttggcctgcgggagtgggagtgtgtccagacacagagacaaaggaccagcttttaaaacattttgttggggccaggtgtggtggctcacacctaatcccaacacctggggaggccaaggcagaaggatcacttgagtccaggagttcaagaccagcctgggcaacatagggagaccctgtctctacaattttttttttaattagctgggcctgttggcactctcctgtagttccagctactctagaggctgaggtgggaggactgcttgagcctgggaggtcagggctgcaatgagccatgttcacaccactgaacgccagcctgggcgagaccctgtatcaaaaaagtaaagtaaaatgaatcctgtacgttatattaaggtgccccaaattgtacttagaaggatttcatagttttaaatacttttgttatttaaaaaattaaatgactgcagcatataaattaggttcttaatggaggggaaaaagagtacaagaaaagaaataagaatctagaaacaaagataagagcagaaataaaccagaaaacacaaccttgcactcctaacttaaaaaaaaaaatgaagaaaacacaaccagtaaaacaacatataacagcattaagagctggctcctggctgggcgcggtggcgcatgcctgtaatcccaacactttgggaggccgatgctggaggatcacttgagaccaggagttcaaggttgcagtgagctatgaacataccactacaccctagcctgggcaacacagtgagactgagactctattaaaaaaaaaatgctggttccttccttatttcattcctttattcattcattcagacaacatttatggggcacttctgagcaccaggctctgtgctaagagcttttgcccccagggtccaggccaggggacaggggcaggtgagcagagaaacagggccagtcacagcagcaggaggaatgtaggatggagagcttggccaggcaaggacatgcagggggagcagcctgcacaagtcagcaagccagagaagacaggcagacccttgtttgggacctgttcagtggcctttgaaaggacagcccccacccggagtgctgggtgcaggagctgaaggaggatagtggaacactgcaacgtggagctcttcagagcaaaagcaaaataaacaactggaggcagctggggcagcagagggtgtgtgttcagcactaaggggtgtgaagcttgagcgctaggagagttcacactggcagaagagaggttggggcagctgcaagcctctggacatcgcccgacaggacagagggtggtggacggtggccctgaagagaggctcagttcagctggcagtggccgtgggagtgctgaagcaggcaggctgtcggcatctgctggggacggttaagcaggggtgagggcccagcctcagcagcccttcttggggggtcgctgggaaacatagaggagaactgaagaagcagggagtcccagggtccatgcagggcgagagagaagttgctcatgtggggcccaggctgcaggatcaggagaactggggaccctgtgactgccagcggggagaagggggtgtgcaggatcatgcccagggaagggcccaggggcccaagcatgggggggcctggttggctctgagaagatggagctaaagtcactttctcggaggatgtccaggccaatagttgggatgtgaagacgtgaagcagcacagagcctggaagcccaggatggacagaaacctacctgagcagtggggctttgaaagccttggggcggggggtgcaatattcaagatggccacaagatggcaatagaatgctgtaactttcttggttctgggccgcagcctgggtggctgcttccttccctgtgtgtattgatttgtttctcttttttgagacagagtcttgctgggttgcccaggctggagtgcagtggtgcgatcatagctcactgcagccttgaagtcctgagctcaagagatccttccacctcagcctcctgagtagttgggaccacaggcttgcaccacagtgcccaactaatttcttatattttttgtagagatggggtttcactgtgttgcccaggatggtcttgaactcctgggctcaagtgatcctcctgcctcagcctcgcaaattgctgggattacaggtgtgagccaccatgcccgaccttctctttttaagggcgtgtgtgtgtgtgtgtgtgtgtgggcgcactctcgtcttcaccttcccccagccttgctctgtctctacccagtcacctctgcccatctctccgatctgtttctctctccttttacccctctttcctccctcctcatacaccactgaccattatagagaactgagtattctaaaaatacattttatttatttattttgagacagagtctcactctgtcacccaggctggagtgcagtggtgcaatctcggctcactgcaacctccgcctcccaggttgaagcaactctcctgcctcagcctccctagtagctgggattacaagcacacaccaccatgcctagcaaatttttatatttttagtagaggaggggtgtcaccatgtttgccaagctggtctcaaactcctggcctcaggtgatctgcctaccttggtctcccaaagtgctgggattacaggtgtgagccaccacgcctgcccttaaaaatacattatatttaatagcaaagccccagttgtcactttaaaaagcatctatgtagaacatttatgtggaataaatacagtgaatttgtacgtggaatcgtttgcctctcctcaatcagggccagggatgcaggtgagcttgggctgagatgtcagaccccacagtaagtggggggcagagccaggctgggaccctcctctaggacagctctgtaactctgagaccctccaggcatcttttcctgtacctcagtgcttctgaaaaatctgtgtgaatcaaatcattttaaaggagcttgggttcatcactgtttaaaggacagtgtaaataattctgaaggtgactctaccctgttatttgatctcttctttggccagctgacttaacaggacatagacaggttttcctgtgtcagttcctaagctgatcaccttggacttgaagaggaggcttgtgtgggcatccagtgcccaccccgggttaaactcccagcagagtattgcactgggcttgctgagcctggtgaggcaaagcacagcacagcgagcaccaggcagtgctggagacaggccaagtctgggccagcctgggagccaactgtgaggcacggacggggctgtggggctgtggggctgcaggcttggggccagggagggagggctgggctctttggaacagccttgagagaactgaacccaaacaaaaccagatcaaggtctagtgagagcttagggctgctttgggtgctccaggaaattgattaaaccaagtggacacacacccccagccccacctcaccacagcctctccttcagggtcaaactctgaccacagacatttctcccctgactaggagttccctggatcaaaattgggagcttgcaacacatcgttctctcccttgatggtttttgtcagtgtctatccagagctgaagtgtaatatatatgttactgtagctgagaaattaaatttcaggattctgatttcataatgacaaccattcctcttttctctcccttctgtaaatctaagattctataaacggtgttgacttaatgtgacaattggcagtagttcaggtctgctttgtaaatacccttgtgtctattgtaaaatctcacaaaggcttgttgccttttttgtggggttagaacaagaaaaagccacatggaaaaaaaatttcttttttgtttttttgtttgcttgtttttttgagacagagtttcactctgtcgcccaggctggagtgcagtggtgcgatctccgcccactgcaagctccacctcccgggttcatgctattctcctgtctcagcctcccaagtagctgggactgcaggtgcccgccaccacacctggctaatttttttgtatttttagtagagacggggtttcaccgtgttagccaggatggtctcaatctcctgacctcgtcatctgcctgcctcggcctcccaaagtgctgagattacaggcgtgagccaccgtgcccggccagaaaaaaacatttctaagtatgtggcagatactgaattattgcttaatgtcctttgattcatttgtttaatttctttaatggattagtacagaaaacaaagttctcttccttgaaaaactggtaagttttctttgtcagataaggagagttaaataacccatgacatttccctttttgcctcggcttccaggaagctcaaagttaaatgtaatgatcactcttgtaattatcagtgttgatgcccttcccttcttctaatgttactctttacattttcctgctttattattgtgtgtgttttctaattctaagctgttcccactcctttctgaaagcaggcaaatcttctaagccttatccactgaaaagttatgaataaaaaatgatcgtcaagcctacaggtgctgaggctactccagaggctgaggccagaggaccacttgagcccaggaatttgagacctgggctgggcagcatagcaagactctatctccattaaaactatttttttttatttaaaaaataatccgcaaagaaggagtttatgtgggattccttaaaatcggagggtggcatgaattgattcaaagacttgtgcagagggcgacagtgactccttgagaagcagtgtgagaaagcctgtcccacctccttccgcagctccagcctgggctgaggcactgtcacagtgtctccttgctggcaggagagaatttcaacattcaccaaaaagtagtattgtttttattaggtttatgaggctgtagccttgaggacagcccaggacaactttgttgtcacatagatagcctgtggctacaaactctgagatctagattcttctgcggctgcttctgacctgagaaagttgcggaacctcagcgagcctcacatggcctccttgtccttaacgtggggacggtgggcaagaaaggtgatgtggcactagagatttatccatctctaaaggaggagtggattgtacattgaaacaccagagaaggaattacaaaggaagaatttgagtatctaaaaatgtaggtcaggcgctcctgtgttgattgcagggctattcacaatagccaagatttggaagcaacccaagtgtccatcaacagacaaatggataaagaaaatgtggtgcatatacacaatggaatactattcagccatgaaaaagaatgagaatctgtcatttgaaacaacatggatggaactggaggacattatgttaagtgaaataagccagacagaaggacagacttcacatgttctcacacatttgtgggagctaaaaattaaactcatggagatagagagtagaaggatggttaccagaggctgaggagggtggaggggagcagggagaaagtagggatggttaatgggtacaaaaacgtagttagcatgcatagatctagtattggatagcacagcagggtgacgacagccaacagtaatttatagtacatttaaaaacaactaaaagagtgtaattggactggctaacatggtgaaaccccgtctctactaaaaatacaaaaattagctgggcacggtggctcacgcctgtaatcccagcactttgggaggccgaggcgggccgatcacgaggtcaggagatcgagaccatcctagctaacatggtgaaaccccgtctctactacaaatacaaaaaaaagaaaaaattagccgggcatggtggtgggcgcctgtagtcccagctactcgggaggctgaggcaggagaatggcgtgaacccgggaggcggagcttgcagtgagccgagatcgcgccactgcactccagcctgggcgacaaggcaagattctatctcaaaaaaataaaaataaaataaaataaaataataaaataaaataaaataaaataaaataaataaataaaataaaatgtataattggaatgtttataacacaagaaatgataaatgcttgaggtgatagataccccattcaccgtgatgtgattattgcacaatgtatgtctgtatctaaatatctcatgtaccccacaagtatatacacctactatgtacccatataaatttaaaattaaaaaattataaaacaaaaataaataagtaaattaaaatgtaggctggacaccgtggttcacgcctgtaatcccagtgctttgtgaggctgaggtgagagaatcacttgagcccaggagtttgagaccggcctgggtgacatagcgagaccccatcatcacaaagaatttttaaaaattagctgggcgtggtagcacataccggtagttccagctacttgggagaccgaggcaggaggattgcttgagcccaggagtttaaggctgcagtgagctacgatggcgccactgcattccagcctgggtgacagagtgagagcttgtctctattttaaaaataataaaaagaataaataaaaataaattaaaatgtaaatatgtgcatgttagaaaaaatacacccatcagcaaaaagggggtaaaggagcgatttcagtcataattggagagatgcagaataagccagcaatgcagtttcttttattttggtcaaaaaaaataagcaaaacaatgttgtaaacacccagtgctggcagcaatgtggtgaggctggctctctcaccagggctcacagggaaaactcatgcaacccttttagaaagccatgtggagagttgtaccgagaggttttagaatatttataactttgacccagaaattctattctaggactctgtgttatgaaaataacccatcatatggaaaaagctcctttcagaaagaggttcatgggaggctgtttgtattttttttttctttgcatcaaatccagctcctgcaggactgtttgtattattgaagtacaaagtggaatcaatacaaatgttggatagcaggggaacaatattcacaaaatggaatgggacatagtattaaacatagtgcttctgatgaccgtagaccatagacaatgcttaggatatgatatcacttcttttgttgttttttgtattttgagacgaagtctcattctgtcacccaggctggagttcagtggcgccatctcagctcactgcaacctccatctcccgggttcaagctattctccttcctcaacctcccgagtagctgggttgcgcaccaccatgcctggctaacttttgtatttttagtacagacggggtttcaccacgttggccaggctgctcttgaactcctgacgtcaggtgatccaccagccttgacctcccaaagtgctaggattacaggagccactgtacccagcctaggatatgatatcacttcttagagcaagatacaaaattgcatgtgcacaataattctaccaagtataggtatacaggggtagttatatataaatgagacttcaaggaaatacaacaaaatgcaatcgtgattgtgttagggtggtaagaaaacggtttttgctttgatgagctctgttttttaaaatcgttatattttctaataaaaatacatagtcttttgaaggaacataaaagattatgaagaaatgagttagatattgattcctattgaagattcagacaagtaaaattaaggggaaaaaaaacgggatgaaccagaagtcaggctggagttccaaccccagatccgacagcccaggctgatggggcctccagggcagtggtttccacccagcattctcaaaagagccactgaggtctcagtgccattttcaagatttcggaagcggcctgggcacggctggtccttcactgggatcaccacttggcaattatttacacctgagacgaataaaaaccagagtgctgagattacaggcatggtggcttacgcttgtaatcggctttgggaagccgaggtgggctgattgcttgagcccaggagtttcaaactatcctggacaacatagcatgacctcgtctctacaaaaaatacaaaaaatttgccaggtgtggtggcatgtgcctgtggtcccagctacttgggaggctgaagtaggagaatcccctgagccctgggaagtcgaggctgcactgagccgtgatggtgtcactgcactccagcctgggtgacaaagtgagaccctatctcacaaagaaaaaaaacaaaacaaaaaacccaaagcacactgtttccactgtttccagagttcctgagaggaaaggtcaccgggtgaggaagacgttctcactgatctggcagagaaaatgtccagtttttccaactccctaaaccatggttttctatttcatagttcttaggcaaattggtaaaaatcatttctcatcaaaacgctgatattttcacacctccctggtgtctgcagaaagaaccttccagaaatgcagtcgtgggagacccatccaggccacccctgcttatggaagagctgagaaaaagccccacgggagcatttgctcagcttccgttacgcacctagtggcattgtgggtgggagagggctggtgggtggatggaaggagaaggcacagcccccccttgcagggacagagccctcgtacagaagggacaccccacatttgtcttccccacaaagcggcctgtgtcctgcctacggggtcagggcttctcaaacctggctgtgtgtcagaatcaccaggggaacttttcaaaactagagagactgaagccagactcctagattctaattctaggtcagggctaggggctgagattgtaaaaatccacaggtgattctgatgcccggcaggcttgagaacagccgcagggagttctctgggaatgtgccggtgggtctagccaggtgtgagtggagatgccggggaacttcctattactcactcgtcagtgtggccgaacacatttttcacttgacctcaggctggtgaacgctcccctctggggttcaggcctcacgatgccatccttttgtgaagtgaggacctgcaatcccagcttcgtaaagcccgctggaaatcactcacacttctgggatgccttcagagcagccctctatcccttcagctcccctgggatgtgactcgacctcccgtcactccccagactgcctctgccaagtccgaaagtggaggcatccttgcgagcaagtaggcgggtccagggtggcgcatgtcactcatcgaaagtggaggcgtccttgcgagcaagcaggcgggtccagggtggcgtgtcactcatccttttttctggctaccaaaggtgcagataattaataagaagctggatcttagcaacgtccagtccaagtgtggctcaaaggataatatcaaacacgtcccgggaggcggcagtgtgagtaccttcacacgtcccatgcgccgtgctgtggcttgaattattaggaagtggtgtgagtgcgtacacttgcgagacactgcatagaataaatccttcttgggctctcaggatctggctgcgacctctgggtgaatgtagcccggctccccacattcccccacacggtccactgttcccagaagccccttcctcatattctaggagggggtgtcccagcatttctgggtcccccagcctgcgcaggctgtgtggacagaatagggcagatgacggaccctctctccggaccctgcctgggaagctgagaatacccatcaaagtctccttccactcatgcccagccctgtccccaggagccccatagcccattggaagttgggctgaaggtggtggcacctgagactgggctgccgcctcctcccccgacacctgggcaggttgacgttgagtggctccactgtggacaggtgacccgtttgttctgatgagcggacaccaaggtcttactgtcctgctcagctgctgctcctacacgttcaaggcaggagccgattcctaagcctccagcttatgcttagcctgcgccaccctctggcagagactccagatgcaaagagccaaaccaaagtgcgacaggtccctctgcccagcgttgaggtgtggcagagaaatgctgcttttggcccttttagatttggctgcctcttgccaggagtggtggctcgtgcctgtaattccagcactttgggagactaaggcgggaggttcgcttgagcccaggagttcaagaccagcctgggcaacaatgagacccctgtgtctacaaaaagaattaaaattagccaggtgtggtggcacgcacctgtagtcccagctacttgggaggctgaggtgggaggattgcctgagtccgggaggcggaagttgcaaggagccatgatcgcgccactgcacttcaacctaggcaacagagtgagactttgtctcaaaaaacaatcatataataattttaaaataaatagatttggcttcctctaaatgtccccggggactccgtgcatcttctgtggagtgtctccgtgagattcgggactcagatcctcaagtgcaactgacccacccgataagctgaggcttcatcatcccctggccggtctatgtcgactgggcacccgaggctcctctcccaccagctctcttggtcagctgaaagcaaactgttaacaccctggggagctggacgtatgagacccttggggtgggaggcgttgatttttgagagcaatcacctggccctggctggcagtaccgggacactgctgtggctccggggtgggctgtctccagaaaatgcctggcctgaggcagccacccgcatccagcccagagggtttattcttgcaatgtgctgctgcttcctgccctgagcacctggatcccggcttctgccctgaggccccttgagtcccacaggtagcaagcgcttgccctgcggctgctgcatggggctaactaacgcttcctcaccagtgtctgctaagtgtctcctctgtctcccacgccctgctctcctgtccccccagtttgtctgctgtgaggggacagaagaggtgtgtgccgcccccacccctgcccgggcccttgttcctgggattgctgttttcagctgtttgagctttgatcctggttctctggcttcctcaaagtgagctcggccagaggaggaaggccatgtgctttctggttgaagtcaagtctggtgccctggtggaggctgtgctgctgaggcggagctggggagagagtgcacacgggctgcgtggccaacccctctgggtagctgatgcccaaagacgctgcagtgcccaggacatctgggacctccctggggcccgcccgtgtgtcccgcgctgtgttcatctgcgggctagcctgtgacccgcgctgtgctcgtctgcgggctagcctgtgtcccgcgctctgcttgtctgcggtctagcctgtgacctggcagagagccaccagatgtcccgggctgagcactgccctctgagcaccttcacaggaagcccttctcctggtgagaagagatgccagcccctggcatctgggggcactggatccctggcctgagccctagcctctccccagcctgggggccccttcccagcaggctggccctgctccttctctacctgggacccttctgcctcctggctggaccctggaagctctgcagggcctgctgtccccctccctgccctccaggtatcctgaccaccggccctggctcccactgccatccactcctctcctttctggccgttccctggtccctgtcccagcccccctccccctctcacgagttacctcacccaggccagagggaagagggaaggaggccctggtcataccagcacgtcctcccacctccctcggccctggtccaccccctcagtgctggcctcagagcacagctctctccaagccaggccgcgcgccatccatcctccctgtcccccaacgtccttgccacagatcatgtccgccctgacacacatgggtctcagccatctctgccccagttaactccccatccataaagagcacatgccagccgacaccaaaataattcgggatggttccagtttagacctaagtggaaggagaaaccaccacctgccctgcaccttgttttttggtgaccttgataaaccatcttcagccatgaagccagctgtctcccaggaagctccagggcggtgcttcctcgggagctgactgataggtgggaggtggctgcccccttgcaccctcaggtgaccccacacaaggccactgctggaggccctggggactccaggaatgtcaatcagtgacctgccccccaggccccacacagccatggctgcatagaggcctgcctccaagggacctgtctgtctgccactgtggagtccctacagcgtgccccccacaggggagctggttctttgactgagatcagctggcagctcagggtcatcattcccagagggagcggtgccctggaggccacaggcctcctcatgtgtgtctgcgtccgctcgagcttactgagacactaaatctgttggtttctgctgtgccacctacccaccctgttggtgttgctttgttcctattgctaaagacaggaatgtccaggacactgagtgtgcaggtgcctgctggttctcacgtccgagctgctgaactccgctgggtcctgcttactgatggtctttgctctagtgctttccagggtccgtggaagcttttcctggaataaagcccacgcatcgaccctcacagcgcctcccctctttgaggcccagcagataccccactcctgcctttccagcaagatttttcagatgctgtgcatactcatcatattgatcacttttttcttcatgcctgattgtgatctgtcaatttcatgtcaggaaagggagtgacatttttacacttaagcgtttgctgagcaaatgtctgggtcttgcacaatgacaatgggtccctgtttttcccagaggctcttttgttctgcagggattgaagacactccagtcccacagtccccagctcccctggggcagggttggcagaatttcgacaacacatttttccaccctgactaggatgtgctcctcatggcagctgggaaccactgtccaataagggcctgggcttacacagctgcttctcattgagttacacccttaataaaataatcccattttatcctttttgtctctctgtcttcctctctctctgcctttcctcttctctctcctcctctctcatctccaggtgcaaatagtctacaaaccagttgacctgagcaaggtgacctccaagtgtggctcattaggcaacatccatcataaaccaggtagccctgtggaaggtgagggttgggacgggagggtgcagggggtggaggagtcctggtgaggctggaactgctccagacttcagaaggggctggaaaggatattttaggtagacctacatcaaggaaagtgttgagtgtgaaacttgcgggagcccaggaggcgtggtggctccagctcgctcctgcccaggccatgctgcccaagacaaggtgaggcgggagtgaagtgaaataaggcaggcacagaaagaaagcacatattctcggccgggcgctgtggctcacgcctgtaattccagcactttgggaggccaaggtgggtggatcatgaggtcaggagattgagaccatcctggctaacacagtgaaaccccgtctctactaaaaatacaaaaaattagccgggcgtggtggtgggcgcctgtagtcccagctactccggaggctgaggcaggaaaatggcgtgaacccggaaggcggagcttgcagtgagcggagtgagcagagatcgcgccactgcactccagcctgggcgacagagcgagactccgtctcaaaaaaaaaaagcacatgttctcgcttctttgtgggatccaggagatagagaatagaaggatggttaccagaggctgggaagggtagtgaggggatggtggggggatggtcaatgggtacaaaaaaaatagaataagacctagtatttgatagtgcaacagggtgactatagtcaataataatttaattgtacatttaaaaataactaaaagatagccgggtgcagtggcttacgtctgtaatcccagtactttgggaggctgaggtgggcgtttgagaccagcctggccaacatggtgaaaccccatctctactaaaaatacaaaaattagccaggcatggtggcgggcgcctgtaatcccagctactcgggaggctgaggcaggagaatcacttgaacctgggaggcagaggttgcagtgagccgagatcttgccactgcactccagcctgggtgacagtgaaactccgtctcaaaaataaaaataaaaatacagctgggcacggtggctcacgcctgtaatcccagcactttgggaggccgaggcgagcggatcacaaggtcaggagatatagaccatcctggctaacacggtgaaacccggtctctactaaaaatacaaaaaattagccaggcgtggtggcaggtgcctatagtcccagctactcacaaggctgaggcaggagaatggcatgaacctgggaggcggagcttgcagtgagccgagattgtgccactgcactccagcctgggcgagagagtgagactccgtctcaaaacaaaaacaaaaacaaaaacaaaaacaaacacacaacaaaaacctaaaagaatataaatggattgtttgtaacacaaaggacaaatgtttgaggggatggataccccattttccatgatgtgattattatacattgtgtgtctgtatcaaaacatctcatgagccccataaatatatacacctaactatgtacccacaaaaattaaaaaaatatattttttaaggtgaagagggaggcgagatgctggccttaacccctaacccgttgttctccctgcaagctgtccacagggcctctcagactcgaggttcagctatatggatgcatgagcttggtccccagccaacatgggagacacttcaccatcggcagcagctacagcacaggaaccctgggtcactgccatgtcccctctgtgactttgtttaaacagaaaatgatgctctgggccggctgtggtggcccacacctataatcccagcaccttgggaggcgggggtgggcagattgcctgaggtcaggagttggagatcagcctggccgacatggcgaaaccccatgtctactaaaaatacaaaaactagccaggcatggtggcacatgcctgtaatcccagctacttgggaggctgaagcaggagaatcacttgaacccaggaggcagaggctgagtgagccaagatcgtgccaatgcactccagcttgggtgagggagtgagactccgtctcaaaaaaaaaaaaaaagaaagaaaaagaaaagaaagtgatcctactggaaccatgcttactcccctccccacctcacactgtgtagaaattagtgctgtcggccaggcgcggtggctcatgcctgtaatcgcagcactttgggaggccaaggcaggcggatcacgaggtcaggagatcaagaccatcctggctaacacagtgaaaccctgtctctactaaaaatacaaaaaattagccgggcatggtggcaggcacctgtagtcccaactacttgggaggctgaggcaggagaatggcatgaacctgggaggcggagcttgcagtgagccaagatcgcgccactgcataccagcctaggtgacagagtgagactcagcaaaaaaagaaagaaagaaagaaagaaatcagtgctgtctatacttctttctgcagtgatggaaatattctgtatctgtgctgtccagtatagtagccactagctacatgtggcacttgaaacatggctggtacagttgaggaagagtggctgccatatcggacgacacagctatagattctgtcaccccaccccgagagtccagagcggggacttctgccttaggccctattcagggctgatttttacttgaacccttactgtgggaagagaaggccatgagaagttcagtctagaatgtgactccttattttctggctcccttggacactttgtgggatttagtctccctgtggaaagtattccacaagtggtgccactaccccagctgtgagagcagctgggagctgcttttgtcatctttccctggaaagtcctgtgggctgtctcttcctcatgccttgtcccatgcttgggcatggtgtcaagcgtcaggagggagaaagggtccttatttatttatttagagagggacccttcttctgttcccaggctggagtgcagtggtgcgatctcggctcactgcaacctccgcctcctgggttcaagtgattctcctgcctcagcctcctgagtagctgagattacaggcacatgccaacatgcccggctaattttttttttttttttttttttttttttttttttttttttgagatggagttgtactctcattgcccaggctggaatgtaatggcacaatctcggctcactgcaacctccacctcctggattcaagcaattctcctgtctcagcttcccaagtagctgggattacaggtgcccgccaccatgctcaactaatttttgtattttttttttagtagagacgaggtttcaccatgttggtcagactggtctcaaactcctgacctcaggtgatccacctgcctcggcctcccaaagtgctaggattacaggcatgagccaccacgcccggcctgaaagggttcttatttagtgtgcattttgacattcaatttaattccaaggtcttgtggggtcatggtttacaggatgttgatatagaaaagacttcacttaatgggccgggcgcagtggctcatgcctgtaatcccagcactttgggaggccgaggcaggcagatcaggaggtcaggagattgagaccatcctggctaacacagtgaaaccccatctctactgaaaatacaaaaaattagctgggcgtggtggcaggcacctgtagtcccagccactcggttggctgaggcaggagaatggcatgaacccgggaggcggagcttgcagtgagcagagaccatgccactgcactccagcctgggcgacagagcaagactctgtctcaagaaaaaaaaaaaaaaacagactttacttactggaagccaaccaatgtatatttagagtaatttttcctgggctgagctgtcatttacttttgcagtatctcaagaagaagagtttacagtgtaaatatttgatgcacactttgattatatagatgaagcaaactattttcaagagctttgcaaggacttacttgtatccaaacaccattctaaaggagtcttacctacttctaaaggctggtctctacttggaaccacttgcttggccctggttcaagtcctgctgcaaacctggaagtcctgtcattgtcttcttccctccagagcagtggcacccaatctaatttttgctgtgccccagcagcccctggcactttgccctgtagactgcagacctcatgtaatgtatgttaagtccacagaaccacagaagatgatggcaagatgctcttgtgtgtgttgtgttctaggaggtggccaggtggaagtaaaatctgagaagcttgacttcaaggacagagtccagtcgaagattgggtccctggacaatatcacccacgtccctggcggaggaaataaaaaggtaaagggggtagggtgggttggatgctgcccttgggtatatgggcattaatcaagttgagtggacaaaggctggtccagttcccagaggaggaaaacagaggcttctgtgttgactggctggatgtgggccctcagcagcatccagtgggtctccactgcctgtctcaatcacctggagctttagcacgtttcacacctgggccccaacctggagaggctgaccaatgggtctcaggggcagctcggttgctggagtttttgtttttatttatttttatgtatttaaggcagggtctctgtattagtccattctcacactgctaataaagacatacccaagactgggtaatttataaaggaaagaggtttaatggactcacagttccacatggctggggaggcctcaaaatcatggcggaaggcaaaggagaagcaaaggcatttcttacatggcgacaggcaagagagcgtgtgcaggggaactcccatttataaaaccatcagacctcatgagatttattcactatcatgagaacagcatgggaaagacccgcccccatgattcagttacctcccactgggtccctcccatgacacatggaattatgggagctacaattcaagatgagatttgggtggggacacagccaaaccatatcagtctccctctgtcatccaggctggagtgcactggcatgatctcggctcactgcagcctctacctccctgggtcaggtgatcttcccacctcagcctcccaggtagctggaactacaggtacctgccactatgcctggctaaatattttgtatttcctgtggagacgaggttttgccacgttgcccaggctggtcttgaactcctgaggtcaagcaatatgcccacctcggcctcccaaggtgctgggattacaggtgtgagccacagtgctcggcctaagtcactgcagtttttaaagctcccaggtgattcttcagtgcagtcaaaagtgagaactggctgggtgcggtggctcatgcctgtaatcccagcaccttgggaggcgaaggtgggcagatggcttgaggtcaggagttcaagaccagcctggccaacatggtaaaaccccatctctactaaaaatacaaaagttagctgggtgtggtggtgcgtgcctgtaatcccagctacttgggaggctgaggcatgagaattgcttgaacccaggggacagaggttgtagtgagccgagatcgtgccactgcactccagcctgggcaacagagtgagattccatctcacaaaaaaaaaaaaaaaagcgagaaccactgtcctaggccctgatgtttgcaggcaactaaaaaaggaagtggacatccccagtcagctgtggcgcaccaagaacaagtcatgggaacataacctaattttctaaatgggttactaggcacttagagcaaaacaatgatgccgaaatcctgatttcagcaaagcctctgcctgcctgtcttggaagtatccacatgaggctgctggggccttggtgtccccagcagtttctagtctctaggtcttgctgtgggtgtctgtgcagtgagggtgtgtgtggcgctgggtgagctctgtctaggcctggcacaggatgcggtctggtagctgctgcttctcttctgcagaagcgcagccaagcaccctctggggtttcaggcccacacccagcctgaagttctgggagtggctcactttccaaccttcagggtctcccagcagctgactggggagtggtggagggaaaagggattgtattagtccgttttcacgccgctgatgaagacatacccgatactgggcagtctaaaagatagaggtctgatggactcacagttccacgtgactggggaggcctgacaatcatggtggaaggtgaaaggcttgtctcacacggtggcagacaagagaaaagagcttgtgcaggggaactcccctttataaaaccatcagatctcgggagacttattcactatcatgagaacagcacgggaaagaccctcctctatgattcaattacctcccaccaggtccctcccacaacatgtaggaattgtgggaactacaattcaagatgacatttgggtggggacacagccaaaccatatcagggcgtcccagaaagggtatagggtctgagacccaagtcagcatgagaaagtatgcttctcatggtggcccagttgggtggaagtggcagccgggccgtctttccaccaggccactcaagtagcagctgagagacccctgccctggccagtccccgccctcccctcttgccactgcctctggttctgaacagatgggcaccctcatcttgtatttgtgattaatgtctaacaatgtagttttgtgagaagggtttgctgatacagccttgctgcagatgctgcgaactgtggcctggggcagaccttacctccagacacgccctgaggcaggggagggcactggcccgtagctggccgagagctctcgggttgcgcgacagggatacttttcagcggctgggtcgctatccaaagtgagaaaacgaggagggaccaggaggctgtccgcctcaagagatgtgggggccaggtccagttatctggggaagcagtaagcttctctgctgtttctaaccccaggcctcccctggtctaaggcagggcctcccagcctcggggcactttaaagatatctgggcctggccccatccccacagtctgactgagtgggtctggatagggcctgagcattggtgatttcctgggtgaaaggaggcccctcacagtctctggaagcttctctgtgttaggaaaagctctgggcttgactctgctttgaaagtcaagatccgcaaatcctctcagcctcagtttctccttcagcaagatgaaatggaaatgctgtacctacgtcccggggtggttgtgagacccaaaaaagacaatgttctggaaggttcctggtgcgttgcagtcctctaagaacctgagttagagccacgctgagtctcagcttcttggctccttctgtttcaaactcgtccatgtgatagctcaggaagggtaggcagggccctgccccctactcagaaaacaccatcctggtcctggggatccccgcagcattagtcccctgttttcccagtgtattgagaaaaattgctaacaagcagtggggcacaccaccagcctcctgggttcctttcagtttggggatttttggacattcccaggaatgtcttaaaaaacacttcaaaaaacattaacataaatatttttatcaaagcctgtattaaatggtctttcaagaaaatacagtaacaggtcaggcatggtggctcatgcctgtaaccccagcactttgggaggccaaggcaggcagatcacctgaaatcaggagttcaagaccaacctggccaacacagccaaatcccatctctacaaaaaatacaaaaattagctgggtgtggtggcacacacctgtagtcccagctacttgggaggccgaggcaggagaattgcttgatcccggaggcggaggttgcagtgagccgagatcgtgccactgcactccagcgtgggtgacaaggtgaatctttgtctcaaaaaaaaaaaaaaaaaaaagataaaatacagtatacagtaatagagaacaatccttttttcaaagtagtgaccccaaatgaacaaaatatgcatctagcttaaatgcgaacctggttttctctacgcccattcaagcccctgcaataggggcccttcaccccgcatccatggactcctaaaattatatggaaaatggctgtgtgtgagtgtggatggacatgtgcacacatatttttggctttaccagatgctcaaagagcctaggacccaaaaagggctgagaatgaccgtgtcggccacttcagggtcatcaggaattgctgtgcactgctcacttctccagtgaacactttctgcttctgtgtttcctggtatcctttgggactcctggctaggtcatgtgtttctctactttcaaaagggcttcagccaggcacgatggcatgagcctgtagtcccagttgctctggaggttaaggtgggaagattgcttgagcccaggaatttgaggccagcctgggcaagtagataggtagatgattgatagatagatagatagataaatagatggatagataagtcgctagacagtcatccatccacccatccacacataaaaaggcctttgtcatgtcatgttttgtggcccacctgccagtgttgcccacagttgctgcccctccaaactcatcagtcactggcaaacaggaggaatgtgtggctcatgtctgggcatcagtggctgtgggagacatccttgatcttctccagcttctccttccacattttcctttgcaatctggcaatatctattaaaataaaatgtgcatgccttttgacctaagagcttcacttctaggacccacttacacgtgtgtgacatgatgttcatacgggtttatttatctgaggttgttcatacacaccattgcctgtaatcactaaaggcgggagcagcctacacatccatccacagaggagtagatgccttttggtacatccgtggcgacggaatactaagcagcctgtgtatctatacactcacacgtgtttgtttatgtgtggaatatctctggagggtacacaagaaacttaaaatgatcactgtctctggggagggtacctgggtgcctgggaggcaggtcagggaaggagtgggcacaggtattaccaattggaagacaataaaaacaacagctcctggccaggcgcagtggctcacgcctgtaatggcagcactctgagaggctgaggcgggcagattgcttgcgtccaggagttcaagaccagcctgggcaacatagcaaaaccccgtttctattaaaaatacaaaaaattagccaggtgtggtggcatgcacctgtaatcccagctactcgggaggctgaggtgggagaatcacctgagcctgggaggtcaaggctgcagtgaggtgagattgtgccaccgcactctagcctgggcgatagagcaagaccctgtctcaaaaacaaacaaaaaacagtccctggcactctgggccaggcctggcagggcagttggcagggctggtctttctctggcacttcatctcaccctccctcccttcctcttcttgcagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgca

SEQ ID NO: 15349 - DNA, 134987 bp, Human; identical to SEQ ID NO: 15348

SEQ ID NO: 15350 - DNA, 134987 bp, Human; identical to SEQ ID NO: 15348

SEQ ID NO: 15351 - DNA, 23574 bp, Human
  misc_feature (1)...(23574): n = A,T,C or G
agcctcctccccatctcccacttgatggagtgcctctgatgccatctgatttgttcgggatgacacccgtcaccatgcaggacaacccagctgaccagaagcagagagaaactgtgggggcagtggcccacctttagtttggacagtctgcaggtgcaatgagctgacttcataatcatcacagagtgtaacaattacaggccagcctccccccttgatttgaggctactgctgccaggctagctatgtggctggccagaccaagggccagtgtgactgtgaagcagcatcatgagaggggtaaaaccaaggaacagactgcatgagcccttgggccccttccagctctaatactccatggtgatggcagccctgcccttctctgaagatctcaaaatgcctgacacctgtgtccttccgcactgccctgggaaggagaataaggatggtgagagatgggcgtgggatgtagaggatggtggtgtggccctgagagataggcagtattggaaagtgtctgctggggagggaaactttgtccgtagaagctaaggctctctatcctgaaaccataggctgcagactccactgtgcccagtcggttagtgaaagggaaagcccacatggttcataggggttcatggctcacatatgatcagacttcactgctagaattctaaatgtgccacacccacactcccaagtactttcctgtgtggagtgacaatggtggcagttgcagtgggatacagagatgggccacacatgatctctgctctcagagaaaccaccttacagtaggaaaacatgtacacagcttcaggggtggggaggggggctgttagaaagcactggctttgcagagtcagatgtggatgtgaagtccagccctgtgccgcctagctgggtgacctttggcaagtgatttaacctcactgaacctcagtttcttcattggtgaaacagggataaaaaatagcgcctccctcacagatttgtgatgagataaccatgtaaagttttatttcttcctatggatgaggcaaagcaaaggacatttaaaaataccaaatcatatctttttgtgtgtgttctatataaccaaggtttcttgcccttaaaaaaaataaaaaataaaataaaaaatagaggccgggcacggtggctcacacctgtaatccccgcacttcgggagaccaaggcaggaggattgtttgagcccagtagttcgagacctgtgtgggcaacatggtgtaaccccattttgtagaggcgaaacctctacaaaaaatacaaaaattagctgggcaaggtggcacgtgactgtagtcccagctactcaggaggctgaggcaggaggatcgcttgaacccaggaggtcgaggctgcaaagctgagatctcaccagggcactccagcctgggcggccgatcgagaccctgtctcaaccaaaacaaaacaaacttttgaaaaatagacgcaggtgccctctggatgctttgctgcttcttgacacctgtcgtataatctgtaatgatgtgatttctgcgattccttttcattgtctgtctttcccttgctcacagtaagctccctgggggtaagggcgggtcgtcttgtgtcgcattttgtctccagcggagatccgttccgtttggaacggaagctggcgcacagaaggctctttagaaggtcggtgtgtgtgttgcggcagaaggtagaggccgaatgtggccgcgggtggcgtgttgagcgcggagggggtcgtgggactcgggaacctgtgcaggcggtggagaggggcgcagcggctctgccccgtgcggcccgcagatggcgctgcaggccaggtcctcgccgcgcgccagcctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacaggtgaccgggtgtgcgcgtgccagggagccgcgcgggcctcgcacaacctgggcaggccccgagggctggcgcactgccctggcatacctgcagggcgcttcccctccattcctagagggccgcgcttctggagaggctcaggaagggtgggcgtggggagccaagctctaaaacagggtagagattcctactgtgtgcagggcaccgcgccggctcctgcagctttgttatttcacactggcctcctgagacggcctgccggggggtagaattgacaccccatttgacagatgaggaaaaaccaagtgtgggaggccccagtcctctctgccaatccgctatacgtgttttgttttcagtggtggacctggtttctgcagacctggaagaggtagctcagaaatgtggcttgtcttacaaggtgagctcctgatctccacattccaaacctgagtgtctttttaaaaagtccatcccaagccagctgggcgcggtggctcatgcctgtaatcccagcactttgggaggccgaggcgggtgggtcacttggagtcagaagtcaggagttcgagaccatccaggccaacatggtgaaaccctgtccctactaaaaatacaaaaattagctgggtgtggtggcccacgcctacaatcccagctactcgggaggctgaggaaggagaatcatttgagcccgggaggcagaggttgcagtgagccgagatcgtgctactgcactccaatctgggcgacagagtgagaccctgtctgaaacaacaacaataacaaaagtccatcccaagccaaagggagcagagggttctcagatattgagaagtagggtgaatgacaccctgggatgccagcttctacgggcaatttgttgctgagcagtctggggccctttggcaggccctggttgccctgaggcgggtgctgctggctcagttctcggctttccccgtgaatggcgctgatctctacgaggaactgaagacctccactgccatcctgtccactggcattggcaggtttgtgtgtgtacttggggaagaaggagagaggcaggaggatggggcctcctctcagctctgcttttgatgcttgagtctagacgggaggggttttttttttaaccaataatggatgggaaggaaaggggtcaggacatctgaattcttatcctataacagggttatggggtatctcagccttggcactattgatatttagggacaggtaattatttgttggggggtggaggctgtcctgtgcagtgtaggatgtttagcagcatctctggcctctgcccactagatgccagtagcaccagccctgctccagttgtaaccatcaaaaatgtctcctgacatggctaaatgtcccctgggaggcacaattgcctctggttgagaagcattgtcctataacacaagctgtcagtatctcattattttcaccatcttctctggccctacttcttattttacttaaggatatggcaagagagaacatttactgagtgcctactatgtgcaggcattacctgtatgttctaggtaatctcttcagtgactctaccagttagagataattaaccctacttgagtttagcctaagaggagcaagtggcaaaggtgaggctcaagcgcgggagtatgtggcccagaacttattcaccacatctgcagcagtagagaacaggagagttcagagaaagaaggagttgcggtccagatgcagtgctcatacctgtaatcccagcactttgggaggctgaggcggcagatcactggaggccgggagtttgagacctgcctggcctgcttgcccgcccaaaatgatgaaaccccgtctctactaaacatacaaaaattagtcgggcgtggtggcgggcgcctgtagtcccagctacttgggaggctgcagcaggagaattgcttgaatgtgggaggtggaggttgcagtaggccaagatcgcaccactgcactccagccttggtggcagagcgagactctctcaaaaaaaaggagcagttatgtcccgccacgttgtttggtgggttggggaagagttgcaaagacgacagacgtttgctggccaagtgagtcttgacctttttcctggtctgtttgttcagaaattgatgaataactgccaccataaaggtctttggattggtgtggccctttctgtttccttaacacattctcttggcagggttcatgcagtgtggtgcttgctttccctggttgggggtctgagtctgtgatccatcaagcactggctaagggcctgctgggtgcttggtatgtgcagatgatacatacacgaatgaggcaaggcccctgcccttaaggcctctagttgggtgtaggggaaaatcaagtgaatacaagagagctgtaagcaccgagggaggcaacggtaaggagggagtggtgaacaggaagccgattggccttgggcttagggagtttataaatccaacagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacggtacattatttcatttattcgtcacaaccaccaatgagcatgttactgtttaaatcatcattctaggccgggcgcagtggctcacgcctgtgatcacagcactttgggaggctgaggtgggcggatcatgaggtcaggaaatcgagactgtcctggctaacacggtaaaaccccgtctctactaaaagtacaaaatattagctgggcgtggtggcgggcgcctgtagtcccagctactcggaaggctgaggcaggagaatagcatgaacccgggaagcggagcttgcagtgagcggagatcgcaccactgcactccagcctgggcaacagggcaagactccatctcaaaaaaataaaataaaataaaataaaataaaaataaatcatcattctataggtgaagaaattgggactcaggttaaatgacttgttcaagattgtgcagttagcaaacggcagaccagttatttgagttcatgcttgtcacactcctaagtctaagaacgcggctcttaactcatctgcccggctgtctccctggaggcgggaggccattgtgaaagcagggttatagacagtggggtagaggtgtgcagggtggaagggtggcagaggccaagcagggccctggcagtgctggcctggggtatgtgagtccagtctagaacagtgggagacatgttgaagaggaactgtgacaagacctactaccaggaggaatgtattgtgaagaatcaaagctgactcaccaggtttctagcctttctttctttctttcttttttttttttgtcggagtttggaatgtattgtgaagaatcaaagctgactcaccaggtttctagcctttctttctttctttctttctttctttctttctttctttctttctttctttctttctttctttctttcctttcttccttttctttcttccttccttccttccttccttccttccttccttccttcctttccttctttccttctttctttcttttttttgacggagtttcactctgttgccaggctggagtgcagtggcgtgatctcggctcactgcaacctccgcctccagggttcaagtgattctcctgactcagcctcccgagtagctgggactacaggtgcgtgccatcaacgcccagctaattttttgtatttttagtagagatggactttcgccatgttggccaggatggtctcgatcttctgacctcgtgatccgcccgccttggccttccaaagtgctgggattacaggcgtgagctaccatgcccagtctctagcctttcttaccgtgtgctgtggacagttaatggtgtaactttaaaacttgggaggaggggagttctgtagtcagaagtttgagaaatgcctgactaatccaaattaaacaggtttctctgttgtaggccgcctcagaacctttagtgctgaggtgcaatgattccttacagggtgttatagcatgtaacgtactttgggaaaagctatgttgatgagggagattgattattccttataggccagagctaggtctgttcatcccacagtcccctcattttagaataagactgtcaggaaatatgaggcattgaagtggtgtgtgaatggatgactgaaagaatggctaaaaggcagttcagagggaaaggcagaggataagtcccagaaatcacctgtattctaggcagtggtaaaacccaggtgtacttctgcttcatggggcaagacaggggtctctccctgttgacatgcggagttaaaggtgatggggacatattggtaggaaggttctctgggcagtcggagaggcacggaatggaaactcaggtgagaagttggctggaaggtggatttgggaataccttatacagactgatctccacagccaaggatgtggttgattcttgactagagtcaacaccagtgcttcaaccccagctgcacgttagaatcatctgggaaacttgagatattcatgctctggtcccaactctatatattctaatttaattagtctaggtcagtggttcccaaacttgtgtgcccattggagtcacctgaggactcttttaaacattacgaagtccaagtctcccccagaccaattaatctcattcactgtgagtgggacacaggcatcagtattttttaattttttaatttgttttttagagacagggtcttgctctgttgcccaggcaggagtgcagtggtgcacaatcatagttcactgcagccttgaactcctggactcaggcagtctccctgcctcagcctcccaagtagctgggactacaggtgctcaccaccatgcctggctaattaaaaaaaattttttttttttgtagagacaggggtcttgctgtgttgccaaggctggtctcaaattcctgggctcaagcaatcctacctctgtctcccaaagtgttgagatgacaggtatgagccaccatgcctggccaggcatcagtatttttttgaagctcccaggtgaatccaatgtgcagacaactttgggtactgctgacataggcattttttaaaaaactcccctgattttattttatttaattaattaattttatttttttgagacggaatcttgctctgtcgcccaggctggggtgcagtggcgcgatctcggctcactgcaagctccacctcccgggttcatgccattctcctgcttcagcctcccaagtagctgggactacaggcgcccgccaccacgcccagctaattttttgtatttttagtagagacggagtttcaccgtgttagccgggatggtctcgatctcctgacctcgtgatccacccgcctcggcctcccaaagtgctaggattacaggcgagagccactgcgtccagccaactcccctgattttaatgtgcaggcaggattgagactaactactctagtctaatggttctgaaacttgagcaggcttcaaaatcacttggaggccttgttgaaactcaagtttcaagtgtgggctgcattcccagagtttctgattcagtaggtcttggggagcggagctgtgaatttgcatttctagctagtccttaaaggttgctgatgcacctggtctggggaccacactggggttcctctgatctcaatgggaagaatggaatcaggagtggtagaggctggatacttattaaacagagatggggtgagcacaattatctcaagaagccacagggctagagtggtaaccagagtgttttgactggcaggaacctgtgggtataatcatggggagtccctggaattaaaatggttgggggccaggcacggtggctcatgcctataatcccagcactttgggaggccaaggcgagtgggtcacctgaggtcaggagtttgagaccagcctggccaacatggcgaaaccccatctctactaaaaatacaaaaattagccaggcgtggtggtgggtgcctataatcccagctactcgggaggctgaggcaggagaattgtttgaacccgagaggcggaggttgcagtgagccgagagcacaccactgcactccagcctggtgacagagcgagactccgtctcaaaaagaaaaaaaaaatggatgggatgcttactaaagtgctgttcggcatatacagagaggtcatgggaggtcatcaagaaccatctcaaggactggaacctaggaaggtgattgtagggctaggaaaggtacgcatgtgatcaggcattggtacaggccgtggcatagaagaaacttcagcctagagatagggcagggcatggagggtaggtggtgacctgtttcatgtggttgagggagagaacctggtttaggaattggcatgtcatgaggtttatcccaagtctttcacagccagtgttgatgatacagaagcgaaataaaagtgatagcacctttctgttactcatttttctggaatgattattgggtgcctcctgtgtttcaggcactgtgctagtgctggggatgcgacagggatcggacccagtccttgccccatggtgctctcagctagatgagcaagacaaacaaaaacaagcaaataacaagataattacaaactcctaggactagtgaggatacaagaccaacacatacaaatcaactgcatttctctatactcacagtgaacatgtcaaaactaaaataaaaaacactaccatttattggccggccgcagtggctcatgcctgtaatcccagcactttggaaggtcgaggcaagtggatcacctgaggtcaggagttcgagaccagcctggccaatatgatgaaacctggtctttactagaaatacaaaaattagctgggcgtggtggtgggtggttgtaatcccagccacttgggaggctgagacgggagaatcacttgaatctgggagatgcaggttacagtgagcggatattgtgccactgcacttcaacctgggtgacagagtgaaactgtctcaaaaaaacaaaacaaacaaaatggctgggcgtggtggttcacgcctgtaatcccagcactttgggaggctgaggtgggcagatcacaaggtcaggagatcgagaccatcctggctaacacagagaaaccccatctctactgaaaatacaaaaattagctgggcgtggcagtgtgtgcctgtagtcccagctgctggggaggctgaggcacgagaatgacgtgaacctgggaggcagagcttgcagtgagccaagattgcgccactgcactccagcctgggcgacagagcgagactccgtctcaaaaaaacaagcaaataaacaaacaaacaaaaacacaatgccatttatagttgtttcagagaaatgaaatacttgggtataagtctaacaaagcatgtgtagaatctgtatgctgaaaatttttaaattgctgatgaaagagatcaaagatgactcggataaatggatgacatgtactttgttcatggattgggagactgaacataatgaagatttcaattgtccccaagttgatctgtaatttaacgcagttcctattaaaatcccagcaagttttttttttctatagacatagacaagcttattctaataattacgggaagaccagttttacctagattagctaaaacaatttggaaaaaggatagctggaggaatcagtctacccagggttaagacttgctatatagctacataattaagcctagtgtggtattgaccaagggacagatggacacagatcagtggaacagaatagataacccagaaatagacctccacaagtatacacaactaatttttttttttttgagacagagtcttgctctgtcacccaggatggagggtactgctgctattacagctcactgcagccttgacctccctgggctcaggcaatccttccaccccaagcctcccgagtagctgggactacaggtgtgggacaccatgcctggttatttgtatttgtatttttttttttttagacggagtttctctctctctcttttttttttttttgagatggagtttcgctcttgttgcctgacctggagtgcaatggcgtgatctcggctcaccgcaacctccgcctcccgggttcaagcgattctcctacaggcacatgccaccaggcctggctaacttttttgtatttttagtagagacggggtttctccatgttggtcaggctggtctcgaactcctgacctcaggtgatccacccgcctcggactcccaaagtgctgggattacaggtgtgagtcaacgcgcctggcctgagtttctctctttttgcccagactggagtgcaatggcgtgatctcggctcactgcaacccccgcctcccgggtttgattcacctgcctcgacctcacgggtagctgggattacaggtgcatgccaccatgcccagctaatcttgtatttttaatagagatggggtttcaccatgttggccaggctggtcttgaactcctgacctcaggtgatcgcccgcctcggcctcccaaagtgctgggatcactggcgtgagccaccgcgcccagcctgtttgtattttttttatagagacagggtttcattatgttgcccaggctggcctcaaactcctgggctcaagcaatgctcccgcctcagcctcccaaaatgctgggattacacacaattgatttttgacaagggtacagaaacaatgtgttggaggaaagacagcctttgaacaaagggcgctggagctattggacatcataggctaaaaatatacaataatcaacctaaaccttataccttatacaaaaattgaaaatggatcatagacttaaatgtaaaaccaaattgtctaatttttagaacaaaacaggagaaaatctaggcaaagagttcttagatttgatgccaaaagtatgatccatgaaaaaatttttgattaatggggcctaatcaaaatttaaaacttttgctgtgcaaaacagaatgaaaagagaagtacagaatgggaaacatagttacaagccatgtattcaacaaaggacttgtatctagaatgaagaaagaattcttaaaacccaacaataaaaaatcaaacaattcaattagaaaatgggcaagggctggctcacacctgtaatcccagcactttgagaggctgaggtggtcagattgcttgagcccaggagttcaaaactggcctgggcaacgtggcaaaaaccctgtctctaccaaaaaaatacaaaaattagctgggtgtggtggcacatgcctgtagtcccagctacttgggggagctgatgtgggaggatcacctcagcctgggaggtcaagattgcagtgagctgtgaccatgccactgaattctagcctgggtgacacagtgagacgtgagaccctatctcaaaaaaaaaaaaaaaaaaagccaggcgtggtggcttacgcctgtaatcccagcacttcgggaggccaaggcaggttgatcacctgaggtcgggagtttgagatcagcctgaccaacatgaagaaacctcgtctctactaaaaatacaaaattagccaggcgtggtggtgcatgcctgtaatcctagctactcgggaggctgaggcaggagaattgcttgaacctgagaggtggaggttgtggtgagccgagatcacgccattgcactccatcctgggcaacaagagtgaaactccgtttcaaaaaaaaaaaaagttcaacactattaactattagggaaatgcaaattaaaaacacagtgagctattatttcatacctatcagaaagactaaaataaaaaaataatgataataccaaatgctgatgaagatgtggagacactggactactcatatatacattgttagcggatatgtaaaatggcatagccactctggaaaatagtttggtagtttcttataaaattaataatgcatttaccataccacccagcaattgtattcttgggcatttatcccaacgttgtaaaaacttgggtttatacaaaaacctgtaaaaaatgcttatagcagttttatttatagtagccccaaagtggaaacaaccaaatgcccttcaatggatgaatggttaaataaactgtggtacatccataccatggaatactttttagcagtaaaaaggaatgaactatccatatatgcaataactgggatggatctcaagggaatgatgctgagtaaaaaagccaatcgcagggccaggcacggtggctcatgtctgtaatccccgcactttgggaggctgtgttgggcggatcacttgaggtcaggagttccagaccagtctgcccaaaatggcaaaaccccgtctctactaaaaatacaaaaattatccaggtgtggtggtgggcgcctgtaatcccaggtactcgggaggctgagacaggagaactgcttgaacctgggaggtggaggttgcaatgagctgagattgcaccactgcactccagcctgggcgacagagcgagactccgtctcaaaaaaaaaaaaaagaaaagaaaaaaagccaatcacaaaggttacacagtgtataattctatgtacataactttgttcttgaaataacataatagagattagtggttgccagggattcgggattaggggtgaatgggaggaatgtggctataaaagggtagcaggaggaagacttatagtgatggaaatgttctgtatcttgattatagtagtcgtgtaaatctacatatgtgataaaatggcataggactagacacatcaacacacgtgcttgaatgctaggaacactggtgaaatctgaataagctctgtggatagtaccaacatcagtttgctacttgtgtgatatactatagtccttttttttttttttttttttttttttaaagagaaaagggtcttgctatgttgcctgggctagacttgaactcctggactcaagtgatcctcccaccttagcctcccaagtaactgagactacaggcccctggctagtacaatacattttgtagtacagttgttattattaaggtaaaccaggtgaagggttcatggactttttgcaacttcctgggaatctataattatctcaaagttgttttttcttgttgttgttgttgttgtttgttttgtttttttgagacagagtcttgctctgtcaccaggctggagtgcagtggcgtgatctctgctcactgtaacctccacctcctgggttcaagcgattctcctgcctcagcctcctgagtagctaggactacaggcgtgtgccaccatcaaagtttaaaaaaagcgacaaattttgggaaacgctatcaaggaaacccacaaacagctgggcgtggtgactcacgcctataattgcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggcctggacaacaaagagagactccgtctcaaaaaaaaaaaaaaaaaaaaaaaaaaaaggaaacccacagggcctgagatgaaaaatgaagggagaaccttctgatggggtggcagaggcctctctggagagctgatctttaagagtggagggatgaagagagaccagagaaggcacatttgggcattccctccttaccagaagaaaacaccaggagaagcctcctggccagtgatgttcaaagacagaaccagtgcttgaaagaaatgtcttacttttcttcttggtaccttttcccctgtcttcctcctaacctcttgtgttgattttcttctcttctgccatcagtcttgataaactgcttgatgctggtctctatactggagaagtgactgaaattgtaggaggcccaggtagcggcaaaactcaggtacatgtgaggccagcagtcaggaggatttaggggtgagggtggtagatgcatagcccagggtccctgggggagcttcagcgtactaatgggttcagagcccaacagagagaagatgggtaataaggaatggggtcgggactcagcccatttgtgttgctggaatctgggcaaggtttggtggggagctcccatctggaccctctctgaagtgtcaagttcatccaatgcccccacccccaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggtaagggcaggatgctgggttccattgagattctgacacaggaaaaccccattatcccttaacattgtaagaatttgggttgaatagtcattccttgccttcaaacttgctgttctattaatacatctcgtattccttaagccacccctgttgatgccatcatcccatttgggatgctactcacactgattcttccaggaaaccctcccaactctttgcatgccctaaaccagggctggcaaacaccaagctttgtgtttccagtccatttctcacctgtgagagacatcactaatcagtcatatccctctttcctgctgagttctgagtactttacagctcagcacccaggcagccaccactgtgacaactgaccattagacaaagctcatttgccaccctggacctgagtccttgcatccaggtgcctcttccttctcagccttaccttgacccccctactccctcttatccaaagtccttgcttttcttttccaccgcttcaggcagaagctctccggaggatccaggtggtgcatgcatttgacatcttccagatgctggatgtgctgcaggagctccgaggcactgtggcccagcaggtgagcctgctgttctgcccctccttgcttaattcagctttctaggtgctatctctgtgggcaggtgtcctactacagactgtttggaaatgcagatgtgcaatctggtgactccaactatgcttgctactcccaggatggaattcccgagcacctaaatcacatacctcattgtttacatgttcatcttccctgctgaacagtaaagccccctgagtggaaggatcatgtcatatttatgtctgcattccccactaggtgagtgaggaatacttttagctgcaagtaatagaggttgtctgacagagacttgaagcttgaggacatttaattatgtcacatgagttgggaggttggcaggtccatgctatcagggcaatagatttgtgtgtctgattttcttgttcttcccctcatggttgcaaagaggctgccaaagctccaagcatcttgtcttcacacatccacatccatattcaaggcagtaaaagatagatggttcttttctgtacctcctcccttttatcagggatgaagaatctttctccagagcccactaatagacgtccctcttccccttacatctagttggccaaaatggggttatgtgtgtatcttggactaagacctgggcccaccatccctgaagtcagatttctgcccagtcgctgaacacattcagagtcatgttaatgggaaggatttagaatggcatttgggttggcactttgctactcatgttgggtgcttagacaggatttggtgcactgatttataaatgactagatgtggaggataccttaaagatagaatagtttatctcaaacttttcctctcaccccaaagcatgacgtgttcacacgggcatccccacgactatatataaagtcaatgatttttacaaactttagaacatataatagttgaacaagctgggagtggtggcccacacctgtaatcctaatgactccagaggctgagacgggaggattgcttgagcctagcagttggaggttgcagtgagctatgatcataccactgtaccttagcctggtcagcagagctagaccccgtctttaaaaaaaaatgttgaacaaatacttacctcagaagtcatagctggttatgacccaccagcttgttgagacatgaagctgagtagtgcttacctcacttttagagatgagaagagtgaaggccggagaagtgaagtgagttgaccaaagttgaccaaatatttagggcaagaactaaccttatagcccaaacctctcaattccagatcagaagactgtattttttactgtaggaccattagatgatatatcttctattattgcataataagttaccaaaaccttagtggcttaagacatagtatttcttatctcacagtttctaggggttaagaatctgagactaggagcggtggctcacgcctaaaatcccaatgctttggaaggccaaggcaggaggatcacttgagcccaggagttcaggaccagcctgggcagcatagcaagaccctgtcttaaaaaaaaaaaaaagaaaaagaaagaagaaaagaaaaagaaccagaatcaggatataagaagtaagggagaagagaaaagaagcatcaaaaacagtttaagtccagggaaaccaggaggattctcctgcttgtgtaaagacagaaaattatggttagaaagatggcacaggctaggcttggtggctcatgcctgtaatcctggcattttgggaggccaaagtggccagatcacttgaggccggatttcgagaccagcctggccaacacggtaaaaccccgtctctgctaaaaatacaaaaattagcacccatagtgtgcacccaatgtgtgcacccatagtcacagctacttaggaagctgaggcatgagaatcgtttgaaccgaggaggcagaggttgcagttagctgagatcatgccactgcactccagcctgggtgacagagcaagacttagggaatttatttggaggcattttagatacggaagatgaggcctagaggcatgatctagaaggagacagtgaagtaaagagaaggctaaactcttcagcaaaggaagttaggaatttgagggtggtagttagcaggacaagggaaagaaaggagggagtcagaaaaggaaaagaagggccttaccaccatggtgggaggctggacacaggagagagatggctgctgagagatccatgaccagaggcctcaggactctctgcggagctttctgaaatttgatgactttaatgtagtttttagttattttattttattttttttgagacagagtcttgctctgtcgcccaggctggaatgcagcggtgtgatctcagttcactgcaacccccgcctcccagtttcaagcgattctcctgcctcagcctcctgagtagctgggattacaggtgtgcaccaccacgcccagctaatttttgtatgtttagtggagacggggtttcaccatgttggccaggctggtctcgaactcctgacctcaagtgatccaccgccttggcctcccaaagtgctgggattacaggcgtgagccactgcgcccagccactttagtgtagttttgatgtcctgtgatttaaaccctttctttctacccaagtcttcattgaagtctgttacacatgccaatgggacgagggagacattgctgctgatgacattctgtgatgcccgtgcagcttgctgtatttgggatgggggggctatttcttactagttttagatagaaaagcaagcttgtcctgtaatgtgtcctagaggctgacaggttcatgagtgcttcccccacattccttcaggtgactggttcttcaggaactgtgaaggtggtggttgtggactcggtcactgcggtggtttccccacttctgggaggtcagcagagggaaggtgagtgatgtggcagagcctggggccagtggaatgtgacctcgcctcccagctctggagtctggtctctggccagccccatccctggttccccactgccctccctctctgcttctcctcctcctgcaggcttggccttgatgatgcagctggcccgagagctgaagaccctggcccgggaccttggcatggcagtggtggtgaggaagcaggcttggccaatgaacttgatttctagttattgcgagctctttatttcccttaaatgtcagcttctgaaccccaaagtggccctttaggaaagggacatatcccagcttccctgggtcagctacagctttgcaccataaatagctaagggaatcaggaatcgtcttgttgtttttttgttgttttgttttgtttctacattttttctttttagtcaggtttattgaggtataatttacatagagtaactttctccttgtttgaagtttgactaatggatatagttgtatccagtcttgtgaccccaccaaaaggtcccccaggcccaggcaaccactgatctgttttccatcccaatagtttggccttttccagagcttcatataaatggatctttttgctattgaagtaactttttctgcttatgaggtagtttttttaaagtctgcatgcttctcatagaaaggatagaaaataaatatgattcaaatttgtcatcaatctccacatccacagaaaccatattaatatttttacatatctccatacaatactttttctgcatatttacttatacttttagccaactttctttctttcttttttttttcttttgagatagggtttcgctctgtttcccaggctggagtgcaggggcacaatcacagctcactgcagctcgaccttccaggctcaagcaatccacccgcctcagcctcccaaagtgttggtattacaggtgtgagcccacacttaaccagctttctaactaaactaacctcatgaaaaaataaaaaaaaataggccaggtgcgctggtttatgcgtgtaatcccagcactttgagaagccaaggctggtggatcacttgagcccaggagttcgagactagcctgggcaacatggcaaaaccccacctctacaaaaaatacaaaaactaggtggccttggtggcaggagtaattgcttgagcctgggagatcgaggctgcagtgagctgtgatcatgccactgcactccagcctgggcaacagagcaaaacctcatctcaaaaacaaacaaaccaaaacaacaacataaaaaataccatctgagtccatttcctatgttttaaaatagattttttagaaatgtaatttttagcagctatatattttttccagtttcttttattgtggtaaaatacatgtaacataaaatttactatcttaaccactttaaggtatacagttcggtggtgttaaatacattcataacgctgtacaaccatcaccaccatccatctctataactcttcaccttgtaaaactgaaactctgtacccattaaaaataactcattttccccttccccagcccctgacaaccaccattctactttctgtatctatgctttttgactactctaggaacctcatatacatggaatcatatggtatttactttttgtgactggagtatttcacttagcataatgtccagaaggttcatccaccttgtagcatgtgtcagactttccttccttttaaaggctgagtgtctgggcgtggtggcccacacttgtaatcccagcactttgggaggctgaggctggcggactgcatgagctcaagagtttgagaccagcctggaaagcatggtgacatgtgccccatcgccttctggttcgggtcaaacctgaggcatcgagatttagtggaaagagcggggcacaagtcaggaggcccaggttctagttccagacctgccattaggttttgtaaccttggggaagttatttctctgtgctaggcctctgttttcctctccgtaaaatgaagcggtagtaatcgatgtcctctatactagcattatggatctgtaagtctgtttctgctgcaggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacaggtgagccagccccaggaagatgccagtaatcttgggccctggagggtggtttccatacccacagatgtcttcgagaagaactctttagaggctgaaaccttgcaactaaagaagctacccacttgggttgcttaactccactgactccttacttcttcttccagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaatgatcaggattggttactggccacatcttttaaaggaaggtcatctttcttggttagagagcctgttgtgtaattaatcagttatgtcttggctgcaggaaaggagggtccgagttacactcagaaagtaatgacatttagaggtgatgaatgcaacagggatagaatcatggaggattgggaaggagtggcaaactggcaccagggtgttggattcaggacagggttggtaagcctaagcctgggggaatcctagcgcttgctttcacagaagacctcaggagaaattaatcttcagtatctttataccatgggtgattggcacattcctgcaaccacagtaagatgcaatacatgaagctggaaattgcaaattcttgccactcaaggtactatttgggcatcttcagcccacagcagacatgaccaatcgggcacaagcactcttttttgtggaagtcaaagtgtttttagaagtttttctcaatatagcactccagggggccactaccagtcagttggagttggtattcaaggtggagtctggttgccgtctctgccctgttcccattatgtagtgagttcaggtacttaatacctaactgaggaccctaggactgcagtttgagatcatctggggccaggcacagtggctcacacctataatggtagcactttgggagcctgaggcgggaggatcacttgagcccaggagtttaacagtttaaaatcagcctgggcaacatgatgagacatcgtttctacaaaaaaattttttaaattagctaggcattgtgatgtgcacctgtggtccctgctacttgggagcctgaggcaggagaatcgcttgaaccttggaggttgtggctgcagtgagccctgatcgcaccactacaccccagcctgggtaacagagcaagaccctgtctcaaggaaaaaaaaaatcatctggcccatcctgttacttaacagagaaggtacctgaggctcaaaaaggatgactgacagtcctagtggcagaatggaggtgggatctggaacccacaacttgattcctaggactcttttttttttaattcccacattggctgggtgtggtggctcacgcctgtaatcccagcactttgggaggctgaggtgggtggatcacctaaggtcaggagttccagaccagcctgaccaacatggtgaaaccccgtctgtactaaaaatacaaaaattagccaggcatggtggcccatttcctgtaatcccagctactcaggaggctgaggcagaatcgcttgaacctgggaggcggaggttgcagggagctgagatggcgccactgcactccagcctgagcgacagagtgagactccgtctcaaaaaaaaaaaaaaaatgcaaaaattagccaggcgtcgtggcgcatgt

SEQ ID NO: 15352 - DNA, 9440 bp, Human
cgggattagggagttacgggttccctgaggagtgaactatggagggtgtggtttgctgttgtctggggaagccggtgccaacccgaagcctggacaggggaggactggaatcccggcacacgctgcccatgcactgcacgcccatctactgcagcctcttcgtggcgtcccggcaccccccctcctccttccctcttcccaacgccacgaccaccacccccagccgccgctggagcccccggtttcccgcctagtcgtttgtttttgtacgtaaaaggtgtctccggatcacagttttctcacaactttctcgccagggttgcaactcctcacccgaggcgcttcccggtccactccttcccccgcgccggcgccgcgcctccggtctccccgcccccatcaggaaaccgcccgaatcaactttgcaagagtgctctgcgggagacagacactcagctcgcccaggacccggaccctgtggactttggatggattgggggagggggcacagaaagagggacgggaggagggagattctgctgctaagagcctcctccccctccaaagatgtgcgctgcgcttgggacaaacttccaggtcaagaaagtacggggggacaatggcaacagccgctgaattgcaaagcccagcagtgcaggggagccgcctgggattccggacccggctgcaccccaaccttccacaaggctcggtcttggactacccccactctacagcagaactctggcctccgcctgcgcctattcccgctctctctctgtccctcccatcgaaacccacgccttaccggagcaggagggggcccaggcacggtgctgcccgccgtccgcgccgcgcggggccgcgggtgccgccgccactgatcctctaaacgcggtctccccgcactctcccgggccgggggatgcagaatggtttacagagggaccgcgaggcgctgattggtcgcaggccgcagtgacgtcggcgggcgctgcattaaggcgagggggcttccagagctcagccaacagccaggagcagtgaccaagccgccggagctggggagagacgcaccggggcggcgactgggccaggagaccagggactgagggacgcgcccggggagggccagcaacaagccgcggcccgggcgcgacagcggcggtccgcgccgagccgttccagccgccggcctactgtagccgctgcgccaggacatttttttttaaagctctccaagctgcccccctcctccccgactcctcccgctgcaaaagaaaaacaaaaaaaaaaaaggaaggaggctagaaaggaaacccagatttgccaccacaacgaaaaaaagaaggggaaaaggaaaaggagagaaagtcgagcgactgtggggttagacggaggcagacagagcgtgggccgagcgatgcggggctgtgcgcccaggcggccgcgagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgagtactttcctcccacgcctctgctgctacctccccgcgggcccttcccggccagcttcggatcagaggttagcgtggcctcgctgcccagttaggaactgcttctagagagggcagccaagtcccgcgggcgcccgcctctccgccagctggcgcgctgggagcccgggacgcggccctgcttgcatcctggaaactatgggtctgggtttggctgcatgtgcctgggaagaaagggtctgagcctgactcggcccagaagccccttcaagcttggaagagacagggcagcctcgggcgttgtagcccggactgctgtctttcccggagccaagctctgcagcaactgcattctccaggccttcggggttgtttgccctccaggcagagcccaggctccctcccggccactaccttttccgaccccgagcggtcttggcggtaagctccgagccttttgcgtagagtgtctgggccaactgccctgtcagcggcaggaaagaactcggccttaaagccgatcctgcacgcccgggggtcttccccaaacccggacatgcctccgagtgcagacctggacaaactgctgcactgtagcctgcgaagtgcccggagctttttcctgcttccctggctgccgaagttgtctggtggttcggcttcagccccaggtgactccgactcccacgggctccgctcagtagtcctcctaggaaactgccagccacagccagcaacctccttgatgaaacctgggggaaagccgagacctccagcttgctggtggggagacttctccctaccccccttattcgtttagcattttaattatattatcgtacactcacaattttgccgctccattcacacaaacacacaagtcaacagagaagaacgggcacaaatgcgaattgtaattccaccctacggatgtgaaatatcgcaatttactcggctgacttggtctctgcttttctgagtttgtggtcatagttcaaaccagggagcaggaggaagagggattcaaagccactcagagggccaagacgcgctgtccccagtgccgctccaggactcgtggctggggttgggttgcgtggaaccatgaagcaaagctccgtgctcgctggtatttcgggagaacgcgcaggctgagcctctgagcctccgcgggctgcccggttttcctcaaggactggatcatagcgggagggtggcaaaccgtactcgtacccgctgccagtgggtccctgagcctggcttccacaacccgcggcagagcgcccagagccagctcccgcagctcccgcttttgccaacctgtcccgctttaggcaagagcgtggcggcggccccgctaaggctacggaggggggctctccgcggctatgtttgtttaccaacagcggggctagacatcgccaaccccatgcctatgtgcgggtccttttgcgatgaaggagagaaaagcggcgctccgcgcacgtttatatagagttctaattgtaattcgacttttctgaatctaatcggaaaataagtgccccgttccccccgcccacacaggtcactgccttgccaccttctttagacgatgcatctttcctctgggataacgctgggagtgaggctggggcttggcgggtagcttgggcccctggctctaaccgcgtgtatcccctccctaactcttccctggtgccgcgctctctctcctgctgcctcctcacctgcttaaccggaattctgcctctctttatctctctcttcccttctttctgtgctccattcctcctctcctacttcctccactttttacatcttccctctttctcgctgtcatctttctctccgcctgtctccccttgcccctggctgacccatccccgcccccgccccccacccccacccccccgcaggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcgggtgaggccccaattcctggctggctaggtgcaagcgggtcctgggggaggaaggctcgccaaggccccggctcatctgtcctttccctcttagccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtcaggccccggcgcgcctctccatcccacagaggcccacactgccactttgggcacccaggccgagccaggagagcccagaatccagagagaagtgagagatggagtccagaggtggggtgcctagacacatcccgagcctgcgggacctatgaaatgcctgatgccttcgagcatctagaaagtcctcttcccagcccaacagaggtgatcgtggcagtggagggggagggacgggagttcagccagaggctggaggaggagaactgttgaacactctggagagagtggggagccctctttctgcacataccccaccccacctcgggttcggaagggtcagagaagtctcagtgtcccccagagtcaatcagtccctctgccttctgcacaaagtgaactcttcctaagtctgcaactccaactttgtgatcgcttgctccaattagacaagccccagatcagggacttcccctccaaagagaggtggttccgccgggagtcagctctgcttccagcgggttggagtgaaatttgggtatgggagcctacctggaggcagctgggcctgtgggcggaaaggaggtgagactgctgaagctccaggccagggggagtctctggctcagtgctaggtgtccggttcaccgggcctgatgccctgcgtggctgtgggtggatgtacctgcctgggaggctggctgtgcatgtgcacatgtgtgcaacacggaaggccctgaggcctacaggagactgtgagaacctgtgtacatgaatgagaagtcgtgtgtctgtgtcactattggcaagaggctgtggataagtatgtttggcactgtgagattgtacatgggtgtgaaaaggagattgtaggttttggtatcataggctgtttctgtgtctctgtcatggttggggggagggttgctgcaagagaccgtgaaatggaaacgcggtgtgtgtctgacattattttggagaggcgtagtctctatgtgtgtacagccccagagaagcggtaactgtgatagtgtgactgttagaaaaactccagctataccacaactctccccctccagacacggcggcctgtccaggtcctcctgtgggattcctgctcaccattggctcagggtccgccctgagtggtcctagtcagagatcgcaccgtcaccactaccctacacacacacacaagcgcgcgcgcgcggtgtcggctagccaggcggtgaaggggtgctggctaggcccggagcaccccggggtcgggggtggagtctcggtggcctcaccccgccgccatgtgctgcaggtctggttccagaaccggcgctccaaggagcggaggatgaagcagctgagcgccctgggcgcccggcgccacgccttcttccgcagtccgcgccggatgcggccgctggtggaccgcctggagccgggcgagctcatccccaatggtcccttctccttctacggaggtgggtgcgcgccgaatggcggggcacggccaggtcggggcgggcttcgttggaagcgggtggcagcgcgggggggcacgcctcgctctctgtaagccactggagagttggggcgagtagggagaaggctgggagtaaatcaaggggaggcggcgagaccgaggacccaattcacggccctgaataacgggggtagctggtaaggggcagctcccgggcttgcgcccagcctcctccctgcacccaggcccgcgagggctccccgcgatccgcgagttccccgcgtggccttcctcagcccgccgaggtcgcgtcttccctccctttcggtcccgccggcccccggccgggccctgacgtcctgcgccctccccgccgctccgcagattaccagagcgagtactacgggcccgggggcaactacgacttcttcccgcaaggccccccgtcctcgcaggcccagacaccagtggacctacccttcgtgccgtcatctgggccgtccgggacgcccctgggtggcctggagcacccgctgccgggccaccacccgtcgagcgaggcgcagcggtttaccgacatcctggcgcacccacccggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatagaaaaaaaaaaaaacataaaaagcaagtccccacccccttcctccagcctcgagaaccattctccttctggggagaccggatggaaaagggggacacgaaataggatccaaatcggcctcgaggtgggactgggatccgcgcactggctgtcgacgtgcagaactggggctccccaaaggaaacgcagacctctccccaactcccacctggacccggatccgtagacagaccccgcgggcgtgtgcgcctggcaggcgggcggcgaaaagacgtccagggcagccgcgggtgcgcacagccgttggcgatgccaggagccgtggggagggaggccgtgagcacagccgggtgaaggaagtgaagcggcccagggcgctcccgggccagccaggagggttctagctctgggatatcccttattagtgttgtctcagagttcaacaacagcgacaaaaaactcttatagcttcagaaacgccgacctgccgtgcatcaggtgggactatatatatattttttgtctatctggatttttggtttttgtttttgccaaaattgcaaaattctaaatgtaaagccctccgtatcaactcttctaccttcgcaaaactacacatacacacatacacacgtacacggacacactcggtaagatggtctccagccagaccgctcagtaaaatgacttgaacatcagctgtacaagaaaagtattctaccttcacacacaaaaagttaaaaaaaaaaaaaaaagactattgaactaaaaacagtcaactgtttacgtataatgttaaattcaggagttcagtgttttactaatatatcctgttttgaaacctcttgttcgaaaacaaaatgttttgagcaatcaaccaaaattgttccttttcttttcctgtagatgttctgacagatttgcagggctttcggctcactgtgctagtatgtaaaaaggtgttgtttacacgaggcaaagagaaaacatgctattcagacagttgccaaatagaataattatagcacaaatactgtaaaggtgcctggcaccagcaacctgagaaagtgttaaaaaaaaaaaaaaaaaaagtgttacaagatttaaaaaaaaacatctttgctaatttttttgtcctgttgaacattcatggaattgttaatatgacttatatagacccacacaggttttatttttgtgtctttaaaataaaagtccaaaatatttaaattttatggtcaaatatgcagtcaacagctgctactttttctttatatattaaatttctcatatgtcttttattgttctaataaacctaagcttgtgtgacctccagtgcatattagaccattcactgtatgaaagaaaacatgttgaataaatttgtgagtttttaataaaaatagaaaatctgatgtttagataattggtgtgttatttgatgttttcaaaggggaaccctgatggggagctgaatgggtcctcagaagccaggtggaaaagagaggcaggattgggatgatatatctgtttttgccttggctatggctgaaaccttttgctaatgccagccaagcttttctctgtggcttcctgctgttattagctacagatttacatcctgtggatttaactgataccgttgaagagatgtttgctgataagttaatatagaatttgaaatagaaatcaaatccatggctaaaaaatgagtggtccaggtctgtgattaggcataagatccaaggcattccctctttcactctccctgcacatgcaaaactgggcttgtatcagatacttgtaatacatagttagaggtggtccttttcagtttcaattcatttcctatagataatccggctttctaatttggtagtttgaaagataatgtaaaggctttctaatttggtggtttgaaagataatgtaaaatgaatgtatagtacagctagaaatgaaatactttaatccctttcacagaactgatatgaaattgttgt

SEQ ID NO: 15353 - DNA, 5139 bp, Human
gcctcaggaaacttataatcatggcataaggggaaacaaacatgtcctccttcacatggcagcaggagaaaaatgagagccaagcaaaggggaaagccccttataaaaccatcagatctcgtgagaacttactatcacgggaatagcatgggggaaactgctcctgtgattcaattacctcccaccaggtccctctcatgacaggtggggattatgggaactacaattcaagatgagatttgtgggggggacacagccaaaccatatcaattatctttcaaaatgagggggaaattaattcccagataaacaaaagttgattgagtttgttagactaggtcacctctgcagggtgaaattaaaggacccttgacagtaactaaagtcatttgaagaaataaagatctcaatgaaggtaaatacataggccactaccgaagctagtattattattatttttttgagacagagtcttgccctgttgtccaggctggagtacagtggcacgatctcagcccactgcaacctctgtctcctggaggggtcaagcaattcttatgcctcagcttcccaagtaactgggattacaggtatgcaccaccatgcctggctaatttttgtatttttagtagagacagggtttcaccatgttggccagcctggtcgcaaacaggtgatctgcctgccttggcctctcaaagtgctaggattacaggcatgagccaccatgcctcaaccaaagctagtattatttggacaagggtttgtaactctactttttgttttctacactttttttttttttttgagacagtcactctgtcgtccaggctggagtgcaatggcgcaatcttggctcactgcaacctctgcctcccaggtttaagcgactctcctgcctcaacctcccgagtagctgggactacagacacatgccaccacacctggctaattttttgtatttttagtagagacggagtttcactgtgttacccaggatggtctcaatctcctaacctcatgatctgcctgcctcggcctcccaaaagggctggaatttccgacgtgagcccccgcgcccagctcttttttttttcttttgacagagtctcactctgtcgcccaggctggagtgcagtggcatgatctcggctcactgcaacctccacctcctgggttcaagcgattctcctgcctcagcctcctgagtagctgggattacaggcgtgcgccatcacgcccagctaatttttgtatttttagtacagatggagtttcaccatgttggtcaggctggtctcaaactcctgaccttgggtgatccgcccacctcagcctcccaaagtgctggaattacaggcatgagccaccgcgcccggcctccacattgttttctacataatttaaaattctttttttttttttttttttttttttttttgagacagagtctcactctgtcgcccaggctggactgcggactgcagtggcgcaatctcggctcactgcaagctccgcttcccgggttcacgccattctcctgcctcagcctccccagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcccataatttaaaattctaatgtgtttaaaataattattagtttatgtttcggggaacatggataaagatataactttgttacaaacaaccaaatggggtggggatggagctataaataagtagattttttggccaggcatagtagctcacacctgtaatcccagcactttgggaggctgaggtgggcagactgcttgagcccaggagttcaagaccagcctaggcaacatggtaaaacctcatctccccactggctgctctgaaaagccatctttgcattgtgcctcgtcagcctccttgctcgccgcagccgcctccgccgcgcgcctcctccgccgccgcggactccggcagctttatcgccagagtccctgaactctcgctttcttttttatcccctgcatcgcgtcaccggcgtgccccaccatgtcagacgcagccgtagacaccagctccgaaatcaccaccgaggacttaaaggagaagaaggaagttgtggaagaggcggaaaatggaagagacgcccctgctaacaggaatgctaatgaggaaaatggggagccggaggctgacaacgaggtagatgaagaagaggaagaaggtggggaggaagaggaggaggaagaaggtgatggtgaggaagaggacggagatgaagatgagggagctgagtcagctacgggcaagcgggcagctgaagatgatgaggatgacgatgtcgatacccagaagcagaagaccgacgaggatgaccagacagcaaaaaaggaaaagttaaactaaaaaaaaaaggccgccgtgacctattcgccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggagggaaaaagaaccaaaacttccaaggccctgctttttttttcttaaaagtactttaaaaaggaaacttgtattttttatttacattttatatttttgtacatattgttagggtcggccatttttaatgatctcggatgaccaaaccagccttcggagcgttctctgtcctacttctcactttacttgtggtgtggccatgttcattataatctcaaaggagaaaaaaaaacttgtaaaaaatgcaaaaatgacaacagaaaaaccatcttattccgagcattccagtaacttttttgtgtatgtacttagctgtactataagtagttggtttgtatgagatggttaaaaaggccaaagataaaaggtttcttttttttccttgtctgtgaagttgctgtttatttttttttggcctgtttgatgtatgtgtgaaacaatgttgtccaacaataaacaggaattttattttgctgagctgttctaaaacaaacaaaaacaaaaaaaacctcatctctaaaaaaacaacaaaaaaattagctgcatgtggtagtgtgtgcctgtagtctcagctactcgggaggctgaagtgggaggatcacctgagcctggaaggtggaggttgcagtgagccaagatcgcgtcactgcactccagcctggatgacagagcaagagcctgtctccacaaaaaaaaaaaaaaaaagagaaagaaagaaaagaaaagaaaagaaaaaaagagggagaaagacaaaaccatcaaatttatttaatatgttttatatggtacaggagtcttcatattgaaatgaagacccaaagaaacagataagtgttagtgtgttttgtagtaggtttgatgaagagtagacagttgtggagaaatatgataggacataaagggtatgatctcataataactgggggaaacttagcaagacctaagtttagatttctttgtgacttttttttttttttttttgagacggagtcttgctctgtcacccaggcttgagtgcagtggcgcgatctcagctcactgcaacctcctcctcccaggttcatgccattctcgtgcctcagcctcctgagtagctgggactacaggcgccctccaccacggctggctaatttttgtatttttagtagagacagtttcaccatgttagccaggctggtctcaaactcctgacctcaggtgatccacccgcctcagcctcccaaagtcctgggattacaggcgtgagccactgcacccagccaacactttgtctttagagataagaatgttctcttccaggtgtagagagggcacctctcacacgagagacctgcttaagggaaagatcagaaaacttatcccaggtttataacctgcttcaggtgagaatgatgaaggaatcctgcttccatgatttttctcaaattccttcagctcaaaatagtattccgaggtgtcatattttaggtactacgttttgagtcccagtagagaagacacaaattaccaatgtctgaaacaaaaacagacattaaaaggatagagaacgtattttatgtcagtaaatcaacaacttagatgaaatggacaaattccttgaaagacacaagtaactaaagctgacctaagaagagaaaatatgaataacctagattagagaaactgaggtattaaaatttttcctgttacatatgtatctgcagttaggaatcatagcactgcatacttgtggaccctaaccctttccttcccatggaatccccaagaaggaacttcaattactggacaaaagacgagaatcttcaagcctgttcaattgagtaatggtagtgggggagcttttggtaggatgatcagaagtcaaaagacctcaagataatcacttcttgtctgccatgcagcttgtgatgtaagatgggcatcgggctgtctcctttttgacagttattttctttggaaagtgaagcaagggcttagggggaaggaagcatcgaataggtatctccatggaataggataccacataggcgtttgggcttcaatggactctaccttgtaatacaattcattgcctcaaatgcattatgtataagtacctctctagaacaggtattggaattgactaattaaagagtcaagtggtagccagtcgtggtagctcacgcctgtaatcccagcactttgggaggccgaggtgggcggatcacaaagtcagatcgagaccatcctggccaacatggcgaaaccctgtctctactaaaaatacaaacaattagctgggtgtggtggcacatgcctgtaatcccagctactcgggaggctgaggcaggagaatcgcttgaaccacagagtcagaggttgcagtgagctgagatagcaccactgcactccagcctagcgacagagctagattcagtcttaaaaaaaaagaaaaaaaagtcaaccggctcattaaagagtta

SEQ ID NO: 15354 - DNA, 37385 bp, Human
tgaggacacagccagttatttttaaaataactttattgagatataatccactcatttaaagtggtttaactacagttaaactacaatttagtggtttttaatatattcacaggatgtgcaaccatcaccaaaatcaattttagatcattttcttttcttctttttttttttttttttttttgagtcggagtttcgctcttgttgctcaggctggagtgcaatggcacggtctcaactcactgcaacctccgcctcctgggtttaagccattctcctgcctcagcctcccacgtagctgggattacaggtatgctctcccaggcctggccaactttgtatttttagtagagatgggtttctccatgttggtcaggctggtctcgaactcctgacctcaggtgatcagcccacctcggcctcccaaagtgctgggattacaggcgtgagccaccatgcccggctgaattttagatcattttcatcacctcaaaaagaaacccagtactcattaaccgtcactctcctttccaggatccctccatccctgccattcttcaaccctagcccttggcaaccactaatggattttttggtctatttagatgtgcctgttccagacacttcattataaatggaatcatacaatatgtggcctattgtgtctggcttttttcacttcacataaagttttcaaggttcagacatattgaagtgtgtatatcccttcattttttttcattgctgaataatatttctttcctttttttttgagacagagtcttgctctgttgcccaggctggagtgccgtgatcacagctcacttcagcctccaactccagggctcaaacgatcctcccacctgggcctcccgagtggctaggactacaagcaccaccaccacacccaagtaatttttaaattttttgtaacacacccaactaatttttaattttttttgtagagactgaatcttactatatgggtcttcttccttcttctttcttcttccttcttctccttcttcttccttcatcgttcttcttccttctttcattcttcttcttcttttttttttttttaaatacagtgtctggctctgtcgcccaggctggagtgcagtggtacaatcttggcttattgcagcctctgcctcccaggcccaagtgatcctctcatgtcagcctccccagtaactgggattacaggcatgtgccaccacactcgactaatttttgtatttttttgtagagacaggttttgctatgttgcccaggctggtctcgaactcttgggctaaagcaatcctcccgcctcggcctcccaacgtgctgggattacaggcgtgacccaccacccctggccagtatttcttaatttgtatagtccacactggtttatccattcatccagtaaaggacatttgcgttgtttccactttttgactattatgaataatgctgctaggaaagaacatttatatacaagtttttgtgtagtcactcgttttaatttctcttgggtatgggagtggccaatattctgaagaactgccaaatttcttcccaaagtagctgcactattttacatacttagtttttgtttttcgtttttttttaaataaagaacctttagggtttcctcagcgtcccagaggagggcctgcttccggcaccccgccttcagggctgcctccgcagagcaccaaactcccgtccccgccattccaggccctggcacttaggagccaaaacctcaggtcaggcgcactttgggcctccagcccagccccgcctcctcagcgctagctagtaggcaaaaggaaaacagctgccccttaatgaggctatgtggacatcgtagttttttttccagtcagtagcgcagagactgtgataagaaaaatcacaattcccagaatgccgcggtgctacggcagccgaaggggccattccgtgtgcagcgctcccgcccaccctccggtctcggcggctctccagagcgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtaagtcttgtggtttgcacgcgccgccgccttcttgtcgctcaatgctagtcccgcggctgaacctccgctatgtagtccacgccaacacccaagagacacctgcctaaaacatccctgcgcctctccagtccactgcccgatggtacccagccaggaaatcagggaacaccggggctgcgtttttccaggaagggccctctctggaaatttttcactcccagggcgtttgctagctttccaggtagtgcaacccctagtccttaacttgcctgtcgagataagaaactactgtactttttcttcttgcacttttttgctgcctcctctctccagtttggagactttagtgcacgctgaaccagccttattccccttgacgattccccttctctcaggctcccttactcaatgccccattcatataatcagttcactccccctctgagctatttcctgtggttggttggaacaccgctaagctcctgttgctatttggccagtgtggagtttaacctccactagaaagccttctctaaaaaaatactgattttcctcttgttaactttaatagcccatcaccatccaatttccctgtccaaatcacttactttatgattataaaataatagataatgttcattattggttaatccaaatagtttatctatgtatagcctttttgtctttatttattaattgagacggagtttcgctcttgtcgcccaggctggagtgcaatggcgcgatctcggctcaccacaacctccgcctcccgggttcaagcgattctcctgcctcagcctcccgagcagctgggattacaggcatgcaccaccatgcccggctaattttgtatttttggtagagatggggtttctccatgttggtcaggctggtctcgaactcccaatcttaggtgtccgctcgcctcggcctcccaaagtgctgggattacaggcgtgagccaccgcgcctggccgcctttctctctttacatctacccacattagtgttgtttagttttatttcctgaagatagggatggtcaaagatttgtttattgatgtttcaggttgttttggatttggacttttttattttaaggaatcagacttctaaaatttgccagtttttaaagtaaaaaccgtccttctttgtgcttctcagcgtcttctgtttcacagtctttggcatactctttacgatagctttgtcctttgtttgggtgtctttttttgctgctgctgcagtttttgtttcacatatcctcagagagattcaaaaaatttccaacttctctgtgttccttgttttattctttccttcttgttttctcttcctcttcatgtagaaggctgtgaggaagtgacagatggaagggaaagcccagtgcagtactctggaattgttactcacctagaggaacggattgcttgtgaagtagtaaacccctcttaataggaagtggtatttccaagacagaaggggggcgagtttcaggaagctatcagctcataagagtgcttaatatgctcagtacacacattaattcccttgacaagaatcttgcccttgtttgtttacaacaatgcaacagaatgcgggataacattgtagactcttcagttttactatagtaacattcgtggggtatgatattggggaagtggtatttccaagacagaagggtagcgttctaaaagttttccagaaaaatcagcaagtaattttttttttttttttgctttgaatatttctttggggaggggacatcacacttctttcttttttcttttttttctttttttttttttttttttgagacggagtctccgctgtatcgcccaggctggagtacagtggcacgatctcggctcactgccgagaattgctcttgggttcaagcaattctcctgcctcagcctcctgagtagctgggactacaggcgtgtgccaccacatccagctaaatttttatttttcgtagagacagggtttcaccatgttgatcaggctggtctcaaactcgagtgacctcaggtgatccgcccacctcagcctcccaaagtgctaggaatacaggtgtgagccactgcgcccggccaggacatcacacttctactcaatgaagataaacgtttttacaccttttgtcttttttacccctattatgccacgaattcatagggaataagttctagtagctcaggctgttttccactggtggagtaggctggtgcttcaattgaacccaggtacctttcttatttagtttccttttttttttttttttttgaaatagggtcttgcactgttgcccaggctggagtgcgttggtgtgatcacaactcactgcagcctcgaactcctgggctcaaagcaatcctccacctcagcctcccaagtggctgggactacaggaatgcacatccattcctagctaattttttgcagagatgagggtctcactggcttttttttctgatcattttccttcacacgtttctggaagctgtcagctcttaagagtacttaatatgctcaatatacacattaattctcttggcaagaatctttcccttttttgtttacaacaatgccaacagaatgctgggtaacattgtagactcttcaagttttgccatagtaagatttgtagggcattagtttttttttttttttttgagatggagtctctctctgtcccccaggctggagtgaagtggcacgatctcagctcactgcaatctctacctcctggatttaagcgattctccagccccagtctcccgagtaggtgtgattacaggcatgggccaccatgtccggctaatttttttttgagacagggtcttgctcagtcgcccaggcttgatgcagtggtgcagtcttggctcactataaactccgcctcccgggttcaagtgattctcctgcgtcagcctcctgagtagctgggattacaggtgcatgccaccacaaccgattaatttttgtatttttcttagagatagggtttattagagcctgccatgttggccaggctgacagggttttgccatgttggccaggctggtctcgaactcctggcctcaagtgatccgcccacctcggcctcccagagtgctgagattacaggcatgagcactgcacctggccaactttttgcatttttttttttttttaacagagacagggtttcatcatgttggccaggctggtctggaactcctgacctcaggtgatctgtgtaaggtattcccttttaaacagtccccattccattgatgtctaaaatatcaaccttctttttttttttttctttgagacggagtcttgctctgtcaccaggttgtagtgcaatggtgcgatcttggctcactgcaacctctgactccctggttcaagcaattctcctgtctcagcctctgagtggggattacaggtgtgtgccaccatgcccagctaatttttgtatttttagtagagctggggcttcactaggttggccaggatggtctcagtctcctgacctcctgatccgcccacctcggcctcccaaagtgctgggattacaggcatgagccaccgcacctggctacaatatcacctttcttgtaggtttccatgtatgtggccgaaggaacaactccatgtgttctaaaaggcctggagaacatctgttggtgccttttctctttgcctttgtgttaatcattttggtgaattactggaagatggcagttccagccaaaaggcagaaataatatttcataaaagtctttggtagcttgatctttcagtgttaattttgaaattaaatgttaacactgtatctattatcttgatgagaaaataatactaatgttatgggtatttaaggatggtagaagaacatactgttctttatttttcctaacttgagattcagaatatattctttctgattttcagttttttccttttcagacctttgaaacatttaacaactttctgaaagtcttcaataatttcaaataagtcgaagaaaaatacataggattttgggctacttagctgtaagatcatataaaggttatttctaaaactagcaatctggtggggtgaaggaaggttcaaaatgtcattgtttagcctgaaagagtgaagttaaaatttgagggcaagctatccgtgaattacttcctaaaggatacacaggtaagcacagtgaatttgattctcactctttattaattcattgtttttataagtacttagaaaccagcagctttgaaaaccttagtgagcatcaaaaagaaaattcatttaaatgtctctggatggagagtgcctctggaatactctacttgcactttgaatgcatgttgtagttgtagatgagtaatatttacatgtcatgtataatactggactctccttcaacagtcaggcagtgtgaaactgtccttatataaggctttggcagctcccagccctgcgttttctgtgccctagttataatcccacaaaattgtactgtcctcctagtatatacagacatacacacaaaacacacttttccctcacattctgtatgagtcacactctctcgtcccattttcttcagtgtaagggaagatgaggattggggtttggaagtatggtggctgtgcccttgagagcataaaggatgataaactggctgacagcaagaccagggcaacaggaagaagacagagtaggcaggaacagcagttatagagaggtagtatttgagtgagtaggtcaggaaacatgatgatgataatgtgagggcctccctttataaagattttgtattctgagttgtttttaccagtggtgataaatgagtttgctgcgagttctccacactctgccatctagctggctggagtgagagcaggacagatttgaatggggaatagctttgcctcccaagtttctagcagtgtgcctaatacagcataaagtactcatttatagagattgaattgaattgaatcagggtgacattaaggagattgccctgatgtactcgggctttattaatcagtgtgctccagctgagcaaaccagccagcacatacttacaatggcaaatgagagaaataaagcaagagacagatttggcatctctaaagtgggggtttaggaaagtgttaagtagcagagctcaaatactgagtagatctcctactaggctagttgggaaggaaaaaatcttggctaatttatttaacttttttgagcttccatttccttatctgttaaatgtggccaataggtgaggccttggtgaagattagggttgatacatttaaagctctagtacagactctaacacatagtaggctctcaaaacacgttatcattattatattacctaacagtgattccttgtgctttactacggtgcagtaggtccctgagatgctcattttagtaattcttttttttttttttttttttttttttttttttttttttagtatttattgatcattcttgggtgtttctcagagagggggatttggcagggtcacaggacaatagtggagggaaggtcagcagataaacatgtgaacaagggtctctggtttttctaggcagaggaccctgcggccttccgctgtgtttgtgtccctgggtacttgagattagggagtggtgatgactcttaacgagcatgctgccttcaagcatctgtttaacaaagcacatcttgcactgcccttaatccatttaaccctgagtggacacagcacatgtttcagagagcacggggttgggggtaagttcacagatcaacaggatcccaaggcagaagaatttttcttagtacagaacaaaatggagtctcccatgtctacctctttccacacagacacagtaacaatctgatctctctttcttttccccacatttcccccttttctattcgacaaaaccgccatcgttatcatggcctgttctcaatgagctgttgggtacccctcccagacggggtggcggccggacagagggcctcctcacttcccagatggggcggccgggcagaggcgccccccacctcccggacggggcggtggctgggcgggggctgccccccacctccctcccggacggggcggctgctgggcggagacgctcctcacttcccagacagggcggctgctgggctggggggctcctcacttctcagacggggcggctgctgggcggagacgctcctcacttcccagacggggcggctgctgggaggaggggctcctcacttcccagacggggcggctgggcagagacactcctcacctcccagacggggtggcggccgggcagagacactcctcagttcccagacggggtcgtggccgggcagagacgctcctcacctcccagacggggcggctgggcagaggcgctccccacatcccagacgatgggtggccgggcagagacgctcctcacttcctagacgggatggcggccgggaagaggtgctcctcacttcccagactgggcagccgggcagaggggctcctcacatcccagacgatggacgtccaggcagagacgctcctcacttcctagacggggtggcggccgggcagaggctgcaatctcagcactttgggaggccaaggcaggcagctgggaggtggaggttgtagcgagccgagatcaggccactacactccagcctgggcaacattgagcactgagtgagcgagactccgtctgcaatcccggcacctcgggaggcccaggcgggcagatcactcgcggtcaggagctggagaccagcccggccagcccggccaacacagcgaaaccccgtctccaccaaaaaatacaaaaaccagtcaggcgtggcggcgcacacctgcaatcccaggcactcggcaggttgaggcaggagaatcaggcagggaggttgcagtgagccgagatggcggcagtacagtccagcctcagctgggcatcagagggagaccgtggaaagtgggagacgggagagggagagggagaggagggagagggagaggagggagaggagggagagggagagggatcattttagtaattcttaagtatatgctgttgtataagatttgtaacacctacactaccctttgctccagactatgctccagatgggacaggggcagtggggtgggacataaaatgaacttaagctctgtcattaagttagatagtgtgagaaaggtagtctcctgaggccacctccatgtttaccactaggaaaaagtgcttgtttttatgaaaatttcttcttggccaggtgtggtgtctcatgcctgtaatcccagcactttgagaggccaaggtgggtggattgagttcaggagttcaagatcagcatgcgcaacatggcgaaaccccatctcttcaaaaaatataaaaaattatccaggtgtggtggtatgcagctataatcccagctactcagaagggaggctgaggcacaagaattgcataagcccaggaggtggaggttgctgtgagccgagatcacgccactgcactccagcctgggcagtggagccagactctgtctcaaagaaaaaaggaaaaaggaaagtttcttctcccttgacctgctgcattcaattagaaaatagaaatgtgttattttcagaggctttgatcatagatagaaggttcttattttttattttatgttggactttattgaatgaacacatgaatgaattgaaatatcctaaggcgtcaagatccagttgagggactgatgcaggagtgggccaactactggctgcagcatgccaatgtgagctgccatttccctccacacttcttttctaccttgtgttctacgtgattatctggaaatgaggtttcttacactttccttacccttttaaccctctccctctgccaaagtcttctgattctttccagttctgagtagttctggttctcaaaaaaattttaatttggcaaaaaaatctctttgacattccctcatttatcttttggctccttaaccatcctctgctgcagttggagctaccttccttgggccgtgccttatagcccagacattttctgcttttcctgtcctcttactcacatcaacactttctagaagaccaagacaaaagagccatgttgtctattaaacaaatctctgacagtagacattaatgtgcttgctttcttttcttttctttttctttttttttttgagacggtctcactctgtcacccaggctgggcacaagtggtgcaatcatggttcactgcagcctccacctccctggctcaagcgatcctcccacttcagcctctggaatagctgggatcacaggcacctgccaccatgcctgactaatttaaaaatattttttgtagagacagcctgtgttgtccaggctggtttcagactcccaagctcaagcaatctgcccgcctctgcctcccaaagtgctgagattacggacatgagccaccatgcccggccgccttcctttcttgtctaggttacatgcacatttcaacttgagtacctctacagataattcagaaaccaaggagtaatttaaataccacagaaaccagttgaaatctaagtttaaataaccttaatctaagtttaatctaagtttaaataaccttattcagaatgttttgtcctcttaagattttcagaaaagtttatttattaattcattcaacatttgttggacacctgatatgtacgaggcattgtgctaggcattggagttgcaaagatgattaagagtttgtaactgttctcagggaacattttattgggtgaggcagacaaatagaaaagtaattacaatacagtgaggtagaaaatgagggcaatagaggcaaagttcttttggggcagtaagagtgggtgcttaactgtcgaggaacgtcagacatgggtttacagagtaggaatgaatctttaaagaactggagtcccctccaaaacaggaaagatggaatatcctgttgtaaagcatcttgcacagtaaagtaagtattttggtacagctagagaaggatcgacagactttctgtaaagggccatgcacaccatatggtctctgttggaattattccactctgccattgtatcatgaaagcaaccataagcagaatataatgaatgggcatggctgtgttccagtaaaactgtattttcaaaaactgggccaggcacagtggctcacgcctgtaatcccagaactttgggaagccaaggcgggcagatcacctgaggtcaggagttcgagaccagcctgactaacatagagaaaccccatctctactaaaaatacaaaattagctgggcatggtggtgcatgcctgtaatcccagctactcgggaggctgaggcaggagaattgcttgaacctgggaggcagaggctgtggtgagctgagatcacaccattgcactccagcctgggcaacaagagcaaaagtccgtctcaaaccaaaaaaaaaaaaaaaaaaaaactggcagcaggctatatttgagttgccagcagggcggtgatatattaaccctgagctacagcgtaaagcagaagtagaggtgtggtcagagatgaggatgaaagataagcagggaccaaattacaatatacctggtaaacaaggctgacaaatttgggtcagtatctttcagagtggaagagacctggtgaatcagattctttcgggatagggtctgggaatttaaattttaataggcttcccagttgagtggctcttatgtgtaatgaggtttgaaaaccaaggccataaatgttggggagccattgaagggttttaaagcagaagtgacaaaatctgatttgtgtttttgaagaaaaatgccaatggctatatggagaacagattagggtgaaaatgtaggaactgggacaagaccagaggcagacggtccgattatgaaagaacatgggttttagcatatgactggagttcaaatctcattttcaccctttcaaactgttgtgattttggacagattatttaatctcttcagatattactttcttcagatacggattgggtgtgttaataaggaccttattgagttattgtgagaattaaatgtaatatatgtgtgatcccataccaaaataacttaatacatactgagttcaataaatcctggtcttttttgaattctcactggcatggttagattgcacagaagaaaggcctggactgaagaccatattagagactttacaatgtaagttgcagttgatgcggcgtgcataaaattctgaaaagataaagagtgaagagaatagagagctaaagagaaccctggaaaactctaaagtgatcagaagattcttgaagaataggactcagcaaaataaactgaaaagagaggtcagtgacgtaagagaaccagaagacagggctgttatgccatctaagagtggagagacttttaaaaagaggacttaccagttgtgggggatgagggaggggataggggttgagagaggagaggcagaagttaactctcaggctagagatgcctacttgatctttctcctgtcgactagaaaaactggcagaaaggttagcagcaggaagatgtgagtagactttgctgctttctgtagatctggcaaatataaaaagagaagaagcctaacccacagctgtgaaggaagttatgggagccttaacatcaaatgaaaacgccactgcttgttttttttctttaaagtggtaaagagcagtggctagccacattcatatttatcttaatttttctttaatccgtgggagataacttttctctttatgtttttaagagaaagacaaaacaagccctcctgttttcctttttggctgaggctgctggtacttcttcatctaaatacagtagttctcttaactttaacaacttgaaacttttattagttgccttaattagagcatcaggatgtaaataagtgtaaaaagggtgataaaagaagagttcttaattgcttttcagattttacatccctgagagggagcatttctttgtaacaacttcttttttttttttttttttgtaacaacttctttaaagttgttggtgatagtagtatcagtttaaatcactttcaaaatattgctgatttttctttttcatttcattaaattatcaatcttttaataaatatctcttaaatgcctggctctgtgctggatactatggggttgcaaaagaagtagaaaacacagcttctgtgctcgaggagctcagactacttggggagatagaaaaatgtgtgagtccactaaaaaaaaaataaagcatataaattcagtgggatattaactctgtgttccagaactttgaagaaaaatgacttatggactgagggtggtggtcagtgagagcttcagagaaagagggctagagctgatcttaacaaaataaaacaagatttgcccttctggatggtgggaggatagagggaaaatagaaatgtaggtatagttagaaatgcaggggatggggttcaggctggtggtctctagggagactggcttgagttgatagagagggtgcctgctggggataatgaaagagagaactggctttttgtgggaatcctggatgcagtgggctgaatggtggcccctaaaaagatatgtccatgtctgaatccctggaacctgtggttatcaccttatatggtaaaacaatgaatattaccttgtatggcaaaagatgtgattaaggattttgagaagaggagcttatcctccattatgtggatgggccgtaaatccagtgacaagtgtccttataagactaaggtagagggagctttgatggacagatgaggaagcagcgtgaccactgaggcagattgcagtgatgtggctacaagtcaaggaatgctggcagccaccagaagctggagaggcaaagaatggattcttccccatgacctccagagggaatgcagctccaccagactgccccagtctggacttccagagccagagaataaatttttgttggtttaagccaccacatttgtggtaatttgttacagcagccccaagaaatgagtatactggatatggtgacttagtaagtagtgctgagccagaggtcttttcttgaactcgagggtgacatggccaggggccattagagaaaatttattatttctataatgatcaggtattacttttttacagggaagaaaaacaccctaaagttattaaaagaaaggttaatctggcagctctttgcaaaatgaattgactagggaagtggggtggaaacggagagatggtggggagatgcactgggaacctattgtaacaacctgtgagtagtgccctgactggtattagggagtcagtgaagcaggatatttccctgaccctttcacgggactcacaacgggtgcctcatatactcagcccaccactctcaactccttgcaggagggagcatgtgagcaaatgagtgagggaactggagtgaatgagcacgggaatcggccagctgctttggtgctagcaggagtgaactttatgcaggcccaatggcagcatccaggtaggggtgcctgagacttccgaagccccagagggagtgttacagtgctctttgagctctgccatccgtggatagctcaactgttaatagctcagtggactctttgccttttcttgtgaggcaactgccttccaccagcaaggacaaagggccagtgtgacagccttttgtatctgcacttgtggctcccaagctcttatccagcgtccaggtaaaatgaggtcacacaaatgaattgaaggatggtgaatgcaggggattttattgctgatgaaagtagttctcagcaggagggggaactgaaaaggggatgggactggtaggtaatcttcccttgaagtccagctgtctccagccagactcttctctgaagttatgccgtcaagccattcctctgaagtcaagccacttctctctgacatctagccgtagtctcgtctaccagtctcgtctgggggttttataggcacaggatggggtggggcagggccatgggtgatttaggaaaaggcaacattcgagtgggaaaacagggatgtaagttctcattttgggccgtcatttcaggcttttcggcttgaggatggggttttgtcggggacccacccttttctgtctagaattttctgtcccctgtccctctcagtaggaatggagaagaagagagaaatcagaggtttataaaggaatacattggcatcactttagtgggtgagcatggagaatcacaatagcagagggaaacttcaatgaggtgtaacatgaaaaagtttgttagttaacctcctcagcataccccttaactgagtgcctaatatcaaagtgagttacattaaatgaatgactgtatagcataaatacagcagtgcatttaatgcacctgtcagtgttagagctttttcaggaaattatatgatcagattaatgtgtcctgtctgagatgtggatggtaataggcatgcttgattaccttctgacaggttgccatgatacaaatctagggacttgggttctagtccttgctctgatggaagtctctggactaaaatcttgtcatctatgaaatgaagagatcacatatccttatctgtgtctatgtatacacatccctccaccaccagcattcttgtctatattgatattctgctatctgcaatgttattgtttatttcatatctgcttcttttcactagtctaaatacattaagattaagtgtcctattgttttgtatttatccctagagttttacagtgtttgggacaaagtgggtatttaataaagggtcattgaataaaggaattaatgtgctcctctttacctgaaaaagatgaggataatagtgcttacctcatctgaggtaatgtgaaataacatgagatagcgtgtagagtgcctcactcaaggccttgttcataatgagcgctttctgaccacacaccctggtttagccccgaatttatgtttttattctgtttgtcctgaaaaatgggaggtaaatggtccaagaatctttggaataggattaaatgtgggtgctggaggcttcctcattttaagaagccccagttaactcctaaagagcatgcaactataattatatgttctctttctgtggaagttaaacttgttgactgtgaagcctaggccatccataatttcctcaggcctttgcagactgatttctattttgtctttcgctgtaatggttaattatagaattatcagcaatccctcccttgattaaatccagttttatcttaattctcaaccttaaaactcatgagttagaaccttatgcttgacccctcccctccagaatactcattcttctcataagcttctgtatctgtgctaccttgattctttcctttcagctatttttgctttttcaggctcactaggcaaccatgtctttttaaaaaataatagctttattgaaaggtaattcacaaaccataaaattcacccttttaatttgttcatcctgtgattcttagtatattcacagaattgtgcaatgatcatcactatctaattccagaacagttctatcactccaagaagagactcttacaaacaaactgtggtacatccctctggcagaatactatttagcagtaaaaagaaacgagttgctaggtgtacctgtagttccagctacttgggagggtgaggcaggaggatagcttgagcccaagagtctgagaccagcctgggcaacatagcgaggccctgtttcttaaaaaaaaaaaaaaaagaaaagaaagaaagaaaaataaataaacaagctatcaagccacgaaaagtcatggaggagccttaaatgcatattgctaagtgaaaggagccattttggagaaggcaaaactgtagagatagtaaaaagttcagtgattgtcagggtttcaggagagggaggaagagagggaggaatagatggagcacagggggtttttagggcagtgagacgattctgtatgatactgcttatcaaaattcatagaatataccacaccaagagtgaactctaatgtaaactgtggacttcagttactaataataaatcaatgttagttcatcaattataataaatgtaccacactaatgaaagatgttaataataagggaaactgtgagagtggagaggggatagtataggaactccctgtactttcttcttaattttcccgtaaacctaaacagctgtaaaaaaataaagtctattgatttaaaaaagaaaaaaagaaactctgaggccattaacaggcactccccattttttcttcccttctcagccctaagcaaccattaatctactttaagtctctatagatttggaataatacaatatgtggccttttgtatttgtctttcacttagcataatgctttcaaggctatcagtgttgtaccgtgtgtcagcacttcattccattttatagctgaataatgttccattgtatggatatactactttttgttatctattcatcagttgatggacatttgggttgtttctgctttttaggtatcatgagtaatggtgctgtgaacattgatatacaagttctaatgtggacctatgttttcctttctttttggaatatacctagggctggaattgctaggttataaactttatgtttaactttttgaggaactgccaaaatgttttccaaagtggctgcaccattttacattcccacagcaatgtatgaggatttcactttctccacatctgcaccagtacttgttactggttgtctttttttttgagacggagtctcactttgttgccaggatggagtggtgcaatctcggctcactgcaacctccaactcccgggttcaagcgattctcctgcctcagcctcccgagtagctgggcctacaggcgcgcgccaccatgcccagctaattgttttttatttttagtagagatggggtttcactatgttggccaggatggtcttgatctcttgacattatgatccgcccacctcagcctcccaaagtgctgggattacaggctaagccaccatgcctggcattggctatctttttgattatgtaaacatcctagtgggtgtaaagtgatatattttgtggttttcattcacatttccctgatgactaatgatgttgagtattttttcatttgcttattggcatttgtatatcttctttggaggaatgtctatccaaatccttgcccctttttaaaattgggttgtctttttattattgagttgtaagagttctttatgtattctagatacaagtcccttatcatatttgtgatttacaaatattttctcccattctgtgggttgtctttttaccttgattatccttgaaatacagtttggtagcttgtgcttatcatatctaagaaaccattgcctaatccaaggtcataaggagtaaatcctctgttttcctctaagttttatagttttatctctgacatttaggcctttgttctattttttttaaatttgagacagggtctcactctgtcatctaggccggactgcagtggcacaaacccagcttcactgcagtcttgacctcctgggctcaagagatcctctcgccccagcctcccaaagtgctgggattacagtgtgaaccactgcacccggcttgttcaatttttaatttttgtatatggtacgaggtagtgatccaacttaattattttgcaagtggctatccacctgtcccagcaccctttattgaagagactattctttccccatttaattgctttggcaccttgtcaaaaatcaattgaccataaacgtaaggatttatttctggattctctatgcttttccattggtctgtatgtctgtccttgtgccagtattacactgtcttgattactgtagctttctaataaattctgaaatcagaaagtgtgagccctccaatttgcgtctttttcaagattgttttggttattctgggtccctcgtatttccatatgaactttaggattaacctgccaatttcagcaaaaaggtagctgagattttgataggaattttgttgaaactgtagatcaatttgaggagtattcctttcttaataataataaatcttccagcccactaacatgggctgcctttccatttatcagatcttctttaatttcttttaatgatattttgtggtttttagtgcacagatttgacactccttatgctaaatttattcctgagtattgtattcttttttaggctactgtaagtggagtcattttcttaatttcattttcagattgttcattgatagtgtgtagaaacacaactgatttttgtatattgatcttgtatcctggacccttgctctactcatttagtagctctaataggttttttcaggggggcaagaattcttttggattggattttctatatataaaatcatgtcaccttcaaggagatagctttactttttcctttcctttccctgaatgcttcctattttttcttggtagttcagtgttaaatagaagtgatgagagaagacaagattgttgccttattcatgatctttgggggaaagcattcagtattctaccattagtaagatgttagctgtgggttttttgtagatgtccattatcagattggggaagtttcctcctatttctaggttattgagtgtttttatcatgtgaagatgttgaatttctgtcaagtcctttttttgtgtgtgtgtgagatgaacatgcaagttttgtcctttttttcctgttgatacagtgtattatagtaattgatttctcagttgtcaaaccaacatttattcttgagataaatcccttttagtcatggtgtataatcttctttgttgctagattcagccttctagtattttattgaggattttttgcatataaattcacaagaccatattggtctgtagttttcttctgatatctttggttttggtttcaagtacatattggcctcgtggagtaagttgaaataagctttctcctattccactttttggaagagtttgtgaggttaattatttaaatatttggtagaattcattagtgaagtcatgtaaacctaggcttttctttgattactaatcgaataaaattttttattactgattgtgtcttgttattgctatagatctaattcagattttctatttcttcttgagtctgttttgctactttgtgtctttctaggaatttgtccatttcatctaggttatctagtttttttggcatgcaatttttcctagtattcctttgcatcccttttatttctgtagtgttagtaatggtgtctctttcggtcatgattttagtatttttgagttttttctttctctaatggtccgtctagctaaaggttggtgaattttgttgatccttttgaggaacaatcttttggtttcattgatttttctctgttgtatttccattctttattttattcatctctgcctactatttatcattacattctatctgtctgctttatgtttaatttgctcttcttttgctagtttcttaaggtggaagattagattactgatttgaaaccacctttcttctttaaaacaaacaaaaaggtgtgttccgctccctctgaggaatgctccagttgtaccccatgagttgtggtatgttgtattttctttttctttcatctcaaagtatttttctaatttcccttgtaatcacaattgccatctattttcctcaaagtatttttctaatttctctcataatcacaattttctttgacacattggttatttaagaatgtcttttgttttttaactgtcatttattaaatactgattaccaggtactaagaattatatgacacagttccaggtgcttactttgaaaaagtcatgacctttagtttagcttgtcttaaaagagaaagtgtttaaaacagggagttggaaaattgggacctttagtcttgcttgtaatcagtagactttaacacttttgacatataatgaagacagacttagtatttcagaaaccttactgatgtctaacatctttaatagcccacctttgtgaaagaagctctctgtgaagggtaagaaaaatcactggctagcgggtttcttttctaagtgattggaggtagggagacaggtctttattgtttcccttgggctcactgtccgcatctcacaaatgtgctctagggcagaaaaagacataaaatggatagtgggtaaagaggtatactgttttaaagccagctgtttaaattttcacatgactctatgtcagtagaaataaaattagaacaggaaaaaaagctagatgtgtggggttattttcatagttttctttggagtttatgtcggtacatgaaagtcagtaattttgtttacccatattaatatgcttcctcacagaagttatcaggaaagagcaagggaacaatgtggttatcattgagtttgtgaaaactatgaattgtgaagaatggtcttttggcccaggaattagtgggcttgatttcagttttagctgctggttcttggttcctaattaacgccccctatctgttcctcagtctttatggcttatgaaatatataaagtttagtagttaaggcaactggtactaacctacatttgtgtaatacttttttctcttttatttttttaatctcctcaaattccttttaccaaatactttttttctttataaagtagtctcatatacattgttatagctaagatttacaataatcctgtgttatacttactctcttagaactttaggcattagctgttacaaaaagccaaaacatttggtttattactgagaaaaagttaagctagagaagtggtgattatgtagttttaaatgtaactttataggaaatgacataaaatacagaaaccttggattcatatactatgcctttcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagtcaggatggtctcgatctcctgacctcgtgatccgcccgcctcggcctcccaaagtgctgggattacaggcgtgagccaccgcgcccggccagcctttctaatttaaaaaaaaggaataacacagttccaattaaaatattttgctgccataaaaactaaacaaagggttatagcttttattttatatttttatgattgctaggtttgtttcaaaaatcagtgaagtccatgaagtacactgtgttctctttctggcgtctcaaaagcagctactcctgaattaattaaaaagagcaatatatgaggtattggattatagtgttgtatgattaatgactcattttactacatgaagaatagatgtcattatccatttatttcactacagacatgagttcttgatgtaatatataagcttttcaaaaagtgtattcaatagtaaatacactttgttttaactcaggttgatttcaaaatattttattaaaattatgtgattgatgagatataagcataattttaaatttaacccattttaatatctggatgaactaggtcatcctgcaattgctttcaaatatttggctctgaagaaagtttcattatttttatatatatatataaatttttttaatttttattttttattttttactttttgtttgagctggggtcttgctcttgtcatctagcctggagtgcagtggcccgatctggacccactgcaacctccacctcccacgttcaagcgattctcctgccttggcctcctcccaagtagctgggattacaggtgcccaccaccgtgcccggctaagttttgtatttttagtagagaaggggtttcaccatattggccaggctggtctcgaattcctgacctcaggtgatccacctgcctcagcctcccaaagtgttgggattacaggtgtgagccaccacacccagctagatgtatattgttataatgtaataaaaacatgacgattgggccaggcccggtggatcacctcaggtgggcacctgtaatcccagctacttgggaggctgaggcaggagaatcggttgaacctaggagcaggaggttgcagtgagctgagatcgcgccattgcattccagcctgggcgacaagagtaagactccatctcaaaacaaacaaacaaacaaaaaacatgacgatgatgcagaagagaaaagctttaaaagaccaggttttgaaaacttgaaactaacttggaagcagtactgaagaacctggctttaagacggtgatggaaaggacagattttttttccccagagccttggagtaatctgtgtcatttcagagccaccccacaaaaatgctagatacaatggttggccatcatgatgtgacagagtttggtaaatgtggctgattcacatttaaagcttggttttcttgacctaactattagacttagtaatgatctcatctttttagggtacttagcattgtgaatgtgatactaatagtgatttcaaacaaatcagagtttttgtttccaaacagatattgaccctttgagttttgctatctgggaaggcacctacatttattctaatgatttgccagtgtttgaattttgcatcttctcttttagaattgcctttaaagccttagcaatattcctgtcaggacactaaagatataaaatgtttattcttcgagggcgattttcagaaagagctagacatcagtcattcagaaccatgtcagaaaaataaagtggataatcagattgggaatttaaagaatagtgtatagttctaacatattgtgttatgccttataaaacttataaaaacaggctccaatactacttttcagaaaatctttgaactgtggcattattggaataaatgtaccccctttcaaggtgactgcattaaagaacacttacttgatgtgtaagttcaggttcaagtgtttagtaattcatcatctttaccatatagttacatcttgcataaaaacttgggaaggtttcaaagctaaacaatgaagaagattaaattactttggcagtcacctaataattgtgcctaggcaggtaattgagtaacaggaatattgagaggttgctttatgacatcagtgggagcagggagaaatctactgagacagttgaggctttctgtttgttcctttgggctcaacaaatttgagggaatttatagccaaattccttaggatacatatttatgtgtgtatatatatacgattttatacacatattttatattttattatctaatttgaaaatcataaaaatataggtgaggaaaagctatttataattacacctatcagagaagtcttcactgaccttgttaacttcctttcttctatgtattgtcttataatgttgagatcataatgaacttacagttttgaatgttgagttctttaaatgtattttgttgcaattatttttctcaaggcaataaaaacttcttcatgagtccaggcacaatggctcacacctgtaatcccagcactttgagaggcggaggcaggaggatcgcttgaggccgggagtttgagaccagcctggtcaacatagcaagacaccatctctacaaagcgattttttttttttaattagccaggcatggtgatgctcacctgtagacccagctactagggaggctgaggcagaagatcacttgaactcaggaattcaagaccgcagtgagctatgatggtgccactgtgctccagcctgggtaacagagtaagcgagaacctgtctcaaaaaaagaaaaaaaagtggggcctggcaccatggcttactcctagcaccttgggaggccaaggcaaatggatcagttaagcctaggagttggagaccagcctgggcaacatggtgaaaccccatctctaaaaacaacaacaaaaatagaaaaattagccaggcatggtggctcatgcctatagttacagcgacacgggaggctgaagtggaaggatcacctgagccctggaggtcaaggctgcagttaaccatgattgtactactgaactctagcctgagtgacagagtgagaccctgtctggaaaaaaaaaaaaaaaaaattgtcatgaacaaaatatttagtagacatttttcttatctatctccatatggtttgtaaagtttactggtgagctaaataaataaataaataaagtttttattatctccatatggtttgtaaagtttactggtgagctatttaaactttattatcaaataaataataaaaatgtatattatttcttctttcacattcatggtttcaaaagtgtcagaaaataaattagggaaagacccagaaggcatttgatgggattatgctttcttagttccgtagggcttcactcacgttttgtttataaatgttctctttgctaatatgcagccatattcacttttctgtacacagaactaaggaaaaaattatttcttctctcgcttgctgaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatggtaagaaatcgtcagtaaacacatgaaaaaatcaccttaacagtcaaataaataatacattaaaatacgaaaataccagttatcacctgtccagttggcaaacattggagagaatattaatctgttagccaggatgggggcaaataggcatcttcatacactgctggtgggagcagagtgtacgtgactgttaacactaagggattgtttatgagagaagaaaatggaaaataacccagatggacaataataaaggactggttaaataaatgttactacatccatgtattagactacttcgtagccagtaaaaatcacaatgcacatatatttactgatgtagaaagatacaatatattgctaagtagacaaagcaatataacaatatgtaactatgcatagcataccatttgtgtttaagtgactttatttatttatttttattttttattttttatttttttgagatagagtcttgctctgtcgcccaggctggagtgcagggcgcgatctcagctcattgcaagctctacctcccaggttcacgccattctcctgcctcagcctcctgagtagctgggactacaggtgcccatcaccatgcccggctaattttttttgtatttttagtagagatggggtttcactgcattagtcaggatggtctcaatctcctgacctcatggtccactcgccttggcctcccaaagtgctgggattacaggcatcagccactgcacccagccaagtgattttgtttattttacatgttttattcactcatccattcagcctttgggcagtggctgtaaaaatgtgaaagagagtagataaaacagaattgaaactccattattgtgagctgagggaggaagtgacagaagagagagatgatattactgtgatcattacacaactgggacaggcttctacaggtttttagaaagtaagacaacaaggttggaacatgaagaggagggacatgaacagtgttgtatatattgtccagatatatgctattcagtagatttttttgatatgttgaatgtgacatgctatcaattatttcttactttctgcagtgtaagccacttgagggcagaatctttggtcagctttgtctttgtatacccccaaagtccctagcatgcactctggtagatagtagatgtttaatgattacttgttaaagagagaaaggaaattactaacatttatttctttattttgggagtagaaataatactgtgacaattattaaaaaaaaaaaagattaattctaactagtggcacactgtggggagatgtccttttaaccacaggggccttttaaatctgagcaacactccagtacatcaaagacaattcagcagcagtttttccgcctcttctgaaagatggcagatctcgtacatgtcctcagttataaataggtaataccatggagggtgggattcccagcagcgaacgtgacctctagccatgggagttcctatgtctaggatttctaccagtggttcctgaactctgacaagtaaaagttaatttaaatatgttttaaatttatatttatatttaaaattaaatatgtttcagtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctgtaagtgccatcaatgggagaatttatatttaagagagtgtctcggttgggcgcagtggctcatgactgtaatcctagcactttgggaggccgaggtgggcagatcgcttgagcccaggagttcaagaccagacagggcaacatggcaaaaccccatctctacaaaaaaatacaaaaattcgctgggcatgggggtgcatgcctgtaatcccagctatttgggagactgaggtgggaggatcacctgagcccagggatgttgaggctgcggtgagccatgatcatgaaaccctgtctcaaaaggggggaacaaaaagagggtatctcaaggtagggtatctcagggtagggtttctgttgaccacttttcttagtatgtctttaaataaaatgttgatgccatttttaatacactaataagcaaatgaaatggcattagattctggccaggtgtggtggcttatgcctgtagtcccagcactttgggaggctgaggtgggcagatcacttgaggccaggagtttgagatcaccctggccaacatggtgaaaccccatttctattaaaaatacaaaaattaggcgcagtggtgtgcgcctgtaatcccagctactcaggagtctgaagcacaagaattgctttaacctgggaaatggaggttgcagtgagctaagatcatgccattgcactccagcctgggcgacagagtgagacctcgtctcaaaaaaaaagaaaaagagaaatggcttagattctaaatattaaaatgcattttacatggagtctataaagagcaactgataaatttatcgaaattttattattaatagacttagtccataaatgggagtggcacgaatctagctttttgttaataataataccttttatttgtattttgatttacagtttacagagtactttcatttatatttatcttaaatattccctccattgattgtgttaaggaattatacttattttatagatgaaaaaatagcagaaaggctggctaaggtgcccaaggtcacacagctttaatggtagaacctgtcctcacctaatccaggctgtctagtgcagtagcccatcatcgtaaggattgtttttaattgaggtaaaattcacataacataaaaattgagagccatttagtacattcacaatgttgtgcaaccattatgtctacctagttatgaaacttttaatcgcctcaaaagaaaatcctgaacccattaagcagttattccccattacccacttcccccaacccctggcaaccatgaatctactttctgtctctatggatttacctattctgtatattaatattttatatacctggagtctatacagtatgtgactttttgggtctggcttctgtcacctagtataatgttttcgaggttcatccacattgtagcatgtatcatcagtatttaattcctctttatggtcaaataatatttatatatatacagttgtttatcctttgatggacatatgtttttacctcttagatattgtgagtagtactgctgtgaacatgtgcatataggtatttgttttcatacctgttttgaattcatttgtatgtatacctaggagtcaaattgctgggtcatatgacaattctgtgtttaatttttgaggaatagtcaaactgttttccacagtacctgaaacattttacattcccaccagcaatgtatgtctgctccaatttgtccacatctcatcaacttattttccattttttaaaactatagccatcctaatgggtatggagtggtatctcattgtgtttggtttgcatttccctaatgcctaatgatgctgaacatattttctatgcttgttggccattcgtatgtattctttggggaaatgtctaggtcccctgctcatgttttaattaggttgtttttgttgttgagtggtaacagttctattgggggaacctgcccccaatatttcaatgtaggttctttctattttccataaatgtcggccaactgagaaataaagagagacagtacaaagagaggaattttacagctgggccgccaggggtgacatcacatatcggtaggaccgtgatgcccgcctgagtctcagaccagcaagtttttattaagggtttcaaaaggggaggtggtgtaagaacagggagtaggcacaaagatcacatgcttcaaagggcaaaaagcagagccactaataagggtctaacaaagatcacgtgcttttgagggaacaggacaagggcaaaagcagaaccactgataagggtccaacaaagatcacagggcaaagggcaaaagcagaaccactgataagggtctatgttcagcagtgcacatattgtcttgataaacatcttaaacaacagaaaacggggtttgagagcagagaagcggtctgaccacaaatttaccagggcagagtttttccccaccctagtaagcctgagggttctgcaggagaccagggcgtatctcagtccttatctcaactgcacaagacagacatttcccagagtggctgtttatagacctccccccaggaacacattcctttcccagggtattaatattaatattccttgctaggaaaagaatttagcaatatctttcctacttgcatgtccgtttataggctctctgcaagaagagaaatatggctctttttgtctgacccagcaggcagtcagatcttatggttttcttcccttgttccataaaaatcactgttattctgttctttttcaaggtgcactgatttcatattgttccaacacacattttacaatcaatttgtacagttaacacaattatcacagtggtcctgaggtgacatacatcctcagcttacgaagataataggattaagagtaaagtaaagacaggcataagaaattataaaagtattatttgggagcagataaatgtccatattaatatgaaatcttcacaatttatgttcctctgccgcggctccagccggtccctctgttcagggtccctgagtttccgcaacagagttctttattgtggttataaaacctttatcagatacatgatttgcagatattttctccccttctctaggcttcttttcactttgttgatagtgttctttgatacacaaaatattttaattttggtgaagtccaatttatctatttttgtttttttgttactcatgcttttggtgtcatatctaagactccattgccaaatgcacagttatgaagatttacctgcctcatgttttctaagaattttatggttttaactcttttatttgggtgattgatccattttgaattaatttttctatatggtataaagtgggagtccatatgttgcatgtgagtatctagttgtccaagcaacatttgttgaagaaactggaaagactttaaaatgaatatgtcctatgttgatttcttcattattgtgattgctctgggagcactttaaatagctataaagaaatgtcacaaacctttattattattattattattattatttttttttttttttttttttttttttttttaggtcaacctctgggagcacagaacaatgtttcaatatttttttttttgagaagaagtctcgctctgtcacccaggctggagtgcagtggcacgatcttggctcactgcaacctctgcctcccaggttcaagcgattctcctgcctcagcctcccaagtagctggggttacaagtgtatggcactgcacccggctaattttttgtatttttagtagagacagggtttcaccatgttggccaggctggtcttgaactcctgacttcaggtaattcacccgccttggcctcccaaagtgctaggattacaggtgtgagctaccacgcccgtctagaacaaacttcttatgttttcagtattttttacaaaattgaagaaatcggctttttgataacttttattagataacatttgtcttcatctaggttgacaagtgcactaaaatatcagactccaccactatacaattcacccacgtaaccaaaaaccacttctaccccaaaagctactgaaatgtttaaaaattaaaacatttggcttcatctaaattaaattaatggaaaaaagccaaatcagcttttttttagtctgtatttttaaaaattagccttactgaagatactaaactgaaaaaaaaaatttatgcatcttaaaacagattaatcaaactttattgactctaaaaacattcttacattggtaacttttatttttcagggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttctattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttaccttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacattatgcctgtgtttgactattgttagcatttaagtcactaaagatcaatatatttaatgagttggactctaaatatgtgctactgtaggtatcacatttcccaagtctttttagctatatcatgtctatcttcggaatggtatagtcgggggccctttttatcaataatagccttctattaattagactaattttaagaacaactaatacttcaactggcaatatcatcctataattatccacataaagtagtctttcaggctgctaggtaacttggctgtcttctattccatccgttttatttaactacacgatggtcatgaatcagtggcaggactgccttgtaaagttgtgctgattttgcactgcacaaaagtacatagttaaggaggcgaatggactttaaaatctagttcacattcccctcaacaagctacgtgtggaggaaggggctcttgccttctcaccaaggtgtacatgtggcacaggtctccccagaagaggtgtctttttctaatttgcccaaaggggatacctgtcttaatacatccaccagggggtgcctttttaaaaatgtgcaaagccgtggtgtgttgcagctggcttttgctggctccccagaggagaaccaattgtgtgcatctcttcccaacttgatgttcagtgacatcaggttggtagcttttaatggacaatggtaggagtatttgtatcatagaagttagtaaatgctgcaaattgtggatcccccaccccctcagtcagtttctaacacaccactgaaaaaggcccgatgtaggctagcattgcatttcccagagcaggcacactggagtcctaaaatgtgtatgattaaaggacacatagacctggaagaactctttttataaagctgtaggcagcttggagatgtccgtatcaaattcagattggttcacagacatatggtagttctgactcagaaactgttacgggtcacagaaaaatacacagtccaactctagaaatgactaggaagtgaatcagctgaattactatttttgagatggagtcttgctctgtcacccaggcgggagtgcagtggtgccatctcagctcactgcagcctccacctcccgggttcaagtgatgctcctgcctcagcctcctgggtatctgggattacaggcatgcgcccccacgcccagttaattttttgtatttttagtagggatggagtttcaccattgctggacaggctggtcttgaactcctcacatcaggtaatctgcctgccttggcctcccaaagtgctgggattacaggagtgagctaccacgcccagccgaatcagctgaattcttaagccttagcataaaagcaggcacaactaatacacctactgtgttgtgatacagttcaccagacactcctggattgaggagggctggagctggacagtgaactctggcttacaggccattttgactttgcagtaagaaatatttgggcaggaaaattttcccatgatccaacagatcccaatccaatcttactatgcctcggcaaccctttcctgagaaggacagcagtgcctggcaagcacattataaacctgagtccaggtttatccccttgtgtaatcaagtccatgggctggatgtgacaacacatgtgcctaagctaggtaggcttgaatagtacagaatgaaataggccaaaaggctgtcccaagcccacactgagtttcagatcttacctcttaaatggaacagagaccatgcttgtcagcaccacaagaaaagtttgtacaagacttgtggcaataaatagatacctctaaacctgctcattctcaggccaggacaggcctcagctgccacaaaggaagagagagaatgttgaaaaagtaaggaagaaagaaaaccaaaagatggccaagccttctttcagaaggaggaagatagttcatatgggggctatattagtccattctctcattgctgtaaagaaataactggcag

SEQ ID NO: 15355 - DNA, 26086 bp, Human
taaaaaatatacagtgttattaaaattaattttcctgtttctttgtacttcttttaatgtggctagaaatttaacatgacatatgtgggccaggtgtggtggctcccacctgtaatcctagcactttggaaggccaaggctggaggatggcatgaacccaggagtttgagaccagcatgtgcaacacagcgagaccttgtctctataaataataaaaagaattacttgggaggctgaggcgggaagactgcttgagcctgggaggtaaaggcttacagtgagccatgatggtatcactgcaccccagcctgggtgacaaagtgagagtgtctcaaacaagaaacaaacaaaaaaattagccaggtgtggtaatgcacacatgtggtcctgggtgcttgggaggctgaggtggaaggatagcttgagcctgggtgattgaggctgcagtgagccgattgtgccattgtactccagcctgggtgacggcgagaccttgtctaaaaaagaaaaaacacacaaaaaataaaaaacaaatgtggcttatgtttgtggcttgaattatagttctattgtacaatggtagtctagttcaacttcttgaacagacgagaacgctggggtccggagagaagccctgacttagcggatggcacacactataaagcactgtcatttgcagtcccaccagtctctcagtacccacccccactctgccacacacacccctgggagtcttaggtgtgaaatgggtggactcacagacccctgggctgcatacctcaaagtgttccaacactcaaggcactgcctgtggttttttgggagtgaaataaaaacctaacaatggtggggtcacagtctccagtaggtcacattttaaaagcactttaggctctggagacttggggtgtggggagaagtgaagagaaagctggggagccctgggccttcccccatttcttcatatgcagaataatccagattagtttaccaagcgcgctgataaccactttaaaaacagagtccctcctgcctccccgtggcatggggtagaacctggcttgagccccgacacaggcgggcagccactccaggatcgttccacacgtaaacaaagacgagtttcggtccgattggcttgatcctggaagaggagtgggcagtggagggaggggaaaccaggcaccaaagcaaattccttcatttcataatttcatctggcgcccccgttcaatcagcctgcattgtcgaggctttaggagaggcagttaggaaaggagagatactgatctctcagccccagggcagcactaatggtgcctgtctagactctgacaggtggagctgctgagctaactacggacctggtgggggaagttttccttggctttcacgtggctttggctggggagccctgagaaggtggctgcctcctttttctgaagcctggcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggtttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtaagtgaggcgccaggagcccagagcgctggggcctccggatttaaatcgtctggggagagcggggcgttgggaggggtgggatagaagaggagagaaatcctggtaatggaatacagttggctatgagaaaaaaattccctaggaaacagttcctctagtttaacaactcagatttttttttttttttttcccctttgcgggtttcctaggctaagatagaggcagagagcaaagagataatcagggtaatagtttctgctcggacacattctacaaactttgagtagatggaatccggccaggcaggaggtgagcagctctgggatcactctgcaggaaaagaatagagggagaaagatctcagaggacccgaaggtactgggagtggagggggagtgggaaacaaggggcaggggcaggagggaggacacggtgacagctactattttacccagatgctgcaaaaagcccttctgagttttgggaattagatctagaagcccatcccttttctcttgatgtgtgggcggtcagttccactctggtgtgccttgagttgctcagaaacctgggacagatgaaagttgaatgtgcactgagagtgcaccttccactaccgactttatggataggatttgggaatagcatagatgctgttccatctggtcccttaaacatccatggggaaggctggcaaatagctttattttattttttgagatggagtttcactcttgttgcccaggctggagtacaatgttgcgatctcagctcaccgcgacctccacctcccgggttcaagcgattctcctgcctcagactcccgagtagctgggattacaggcatgcaccaccactcctggttaattttgtatttttagtagagacggggtttccccatgttggtcaggttggtctcaaactcccgacctaaggtgatctgcccgcctcagcctcccaaagtgctgggattacaggtgtgagcccccgcgcccggccacagatagctttaaacatccatgggaaaggctagctaacagctgaaacctgctcagaatcaaggaatttgaaggactttccattcctgacttctttccattcctgattgtctcctcagaggcttgtgtaaacaccacacctgttgaagggttcggccgaatcagccactgctgtgggttcattcctgaaggggaacacttcagctacttcagacacaatgggctagggaccacgggaggggtgagggcggagggggcacacaccctccaggtttgcatgccggtgtctgctaggtgagggaaggaatgaggggaaggaagggccgggagaggcgctacgtgggaaacaagggacctctccaagggcgtggagaggtgagtgcctcaagggcagaatggaatgagcagaaccctttggtttcccgggaagagctctcaaccttgagtcaggaagactgatttctcctcccagctccgcaggaacatggaactgtgatcaggcaaggggctgggcctgagttcctcataggggtcttggggaggcccccagtttcccctcctgtgtttcgattctggcccctctccatctgcacacgtcgccttggaagttccctttagaactggcttttttgtattctagtcttgaatggtaatcgaagacaacagggtatgaagaacaattttgacggcgtgattttattcttctcattctgggtccactactatttaaagtcccaagattaagctgaggaattaatatggtggtatagtaaacaataaattgaggagtatttttgcttgaggaatctttgacttcctgagtagttcagggtgtttgcttcttttattctcatttttattgcactgtggtcagactatatggtctgcacatttcttattttctaattccagatttgtctttgtattctaaatatgctcatttttggcaaatgttccatttggaccatggaccatagttcctattaagcaatcataatagagtagagatggcaaactatggtccatggaccaaatatggcctatagcctctttctgtaaataaagtgatttttgttttgttttgttttgtttttgttttcgtttttttgagatggagtctcgctcttgcccaggctggagcgcagtgacgcgatctcggctcactgaaacctctgcctcccggtttcaaggtttcaagccattctcctgcctcaggctcccaagtagctgggattacaggcgcccgctaccacgcctgggtaatttttgtatttttagtagagacagggtttcaccatgttggccagactggtctcaaactcctgacctcaggtgatctgcctgcctcggcctcccaaagtgctgggatcataggcatgagccacaacctgtaatccactattttactaaaacacagcaatgctcatatgtttatgtatcatctatgctgctttcatgctacaaatgtgtggcttgcagagtcttaaattgcttataacctggccctttatagaaaatctatgctgatcactgatatagaggatctgaattatatgattagtaatggagatctaataagatatgaagatagagaatatttctatttaagtatccatagaacatttacacaattttaccatgttcttattcatattgtatattttatctgccaaggactggtaaagaagtatgaaagtctcatgcaactatagtattgcctttgggttctccttgtattttcagcagttatttatttattttgagacagggtcttgctctgttgccctggctggagtgcagtggcacaatcttggctgactgtaacctccacctcccaagctcaagtgatcctcttgcctcagactcttgagtagctgggtctacaggcacccaccactacacctggctaatttttaaattttttgtagagatggggttttgccatgtagcctaggcttgactcaaactcctgggctcaagcaatcttcctgccttcacttcccaaagtgctgggattataggtgtaagcctctgtacccagccttcagtactttttgttttacgtattttggtgctatattagttggtgcataaaagtctaggatggttttttttttttttttttttttttttgagacagagtctcgctctgtcacccaggctggggtgcagtggtgcgatcacggctcactgcaagctctgcctcccgggttcacgccattctcctgcctcagcctcttgagtagctgggactacaggtgcccgccaccatgcccggctaattttttgtatttttagcagagacagggtttcaccgtgttagccaggatggtcttgatctcctgacctcgtgatctgcccgcctcagcctcccaaagtgctgggattacaggcgtgagccaccgtgcccggcccaggatggttttatcttcagtgtagagcatccctaattattataaaacaagccttttggtcaatataatatctttttgctttgattacaactttgtatgatattaaaaccttaacttctacttaattattttaccttgaacaacttacttaactttgtgtctgacacataatacttgttaaataaatattatgttagtatttctttttattttcatttctttctgttcttttgcttttaactcttgtgtatctttttgttttaggttaggttcttctaggtatgatatagtttagtctttttttttttcaaaatagttaccatttacatttcttgtaataatagttacttgttattgtcatctaattttaggctatatggtttggttgtctccatctccttctgcattagacagtatatatcatatcatatttttagatctactagcaactgagtagatggtagtgccattctcagggctttgaaagataggcttgtaaggagaggtgatcagtttagctttgaacttgttggatccagtgaatattacccttatgtatcagaataagatatttaaatgaagggatctttgagagccttaagatagtatactagtagagggccggcgcggtggctcacacctgtaatcccagcactttgggaggctgaggcgggcagatcacgaggtcaggagttcaagaccatcctgactaacacagtgaaactctgtctctactaaaaatacaaaaaaaaaaaaaaaaaaaaaattagccgggcgtggtggtgggtgcctgtagtcccagctactcgggaggctgaggcaggagaatggtgtgaacccaggaggtggagcttgcagtgagccgagatcacgccactgcactccagcctgggcaacatagtgagactctgtctcacaaaaaaaaaaaaaaaaaaaaaagatagtatactagtagaggacttcactttattttcctattttctggaaatttcatttctttgaattcgggcataagagatttagaagcttcactcaaatattaagctttatttaaaaagatgatttccagtatttcattttatattcacattaatcaagtctacatgtttcgtttagagtaacaggaagatggtaatacgcccagggaactatctggaagtgtagaaattgggatgaacaccgtggttatacttgttttgatctgcctgtggtgctatgatgacttattttctctcattattgcatagaaactcaattcagtgatgttattcagatgttattcataagttattgccatgattcatcacttttatgtcatcagagttgggatggctacccagaataggggatcctggagatttccctgtagacgctttgcatttataaataatcctttatcaagggcagagggatttctgtaggacttctcccttagaagaactcagcctgggtagaaatacgaggattaacatcagcacatattcatctccaaaaaattttcctccccattactcacacttgccaataaataacttgctttgggtaaatattcagcactcagtcttagtccaaagcatttgctcagcaatcactgtgtagagtacagagtaagggggataccaacaaatagaagtttgctctattttcttaagaagcttgttgtctggccaggcacggtgcctcacgccaccttcctatcttcctaggagatagatgccacaaagaagcttgttgtctgataggcagctcagcagtgatattaatttgtaatatataacaaagatatggaaaaacttgagtgccaagaaatatttaattgtaaaaaccatgaagagatcgacacatttagagtgcaataggatttcaagtccaggtgtgatggcttacgcctgtaatcctagcactgtgagaggctgaggtaggtggatcacttgagcccaggagttcgagaccagcttggccaacatagcaaaaccctgcgtctactaaaaatataataattagctggatgtggtggcgcatgcttgtaatccaagctacttaggaggctgaggcacaagaatcgctttaacctgagaggcagaggctgcagtgagctgagatcatgccactgtactcccaggctggagtacagagcaagaccctgtcttaaaaaaaaaaaaaaaaaaaaggccataggattaatagtaataatgataataatttaaaaaactcatgatagaggttaaatcttgggcaaagttttgcagaaatatggtaagtggatcataaataggagggagaggatctttctggttaggagaataattcatgtgttgaggcaaagagcatgagaagaccttaaatgaacccaaattcccttccagatggaaaatacagaactctaggaagatttgcttgccttgcacggaggtggagacgggagttagggaggaaggaggagataggtgggaggactaattggagaaaggccttgaagctcaaactggggctggatctgccgtgacagacaaaaaggagcgaatacgcttctttttttttttttttttgagaccatgtctcactctgttgcctaggctggagtgtagtggcgtgatctcagctcattgcagcctctgcctcctgggttcaagcggtttttgtgcctcagccttctgagtagctgggactacaggcgtgagccaccatgcctggttcatttttgtatttgtagtagagatggagtttcaccatgctggccaggctggtctcttaacgcctgacctcaggtgatctacccgcctcggcctcccaaagttctgggctcacaggtgtgagccactgcgcccggccgataatttctttttaacctcctttgcggactcctacctagatgagatggtgctccacatggttctgtccttggcttcccatgtgatcttgtctcctcttgaggcttcagataccactctaggtgatgactgccagtctgtgcttacagcccaaacctctcctgagcaccaacccatatgcccacggtgcagagacagcacaacccagtgtcaaggagcctggcttttaagagtcatgtaatcttgggcaagttatgtaatttctctgtgcctcagtttcctcagctgttaaaggaaggcataataatagggttgttgtgaggattaaataacaccatatatggccaggagcagtggcttgtgcctgtaatcccagtactttgggaggccgaggcgggcagatcacctgagcctcaggagttgaagagctgcctgggcaacatagcgagaccccacctctacaaaaaatacaaaaagtagctagatgtggtggtgcgcacctgtcccagctattcaggaggctgaggtaggaggatcacctgagcccaggaagtcgaagctgccgtgagctgtgattgtgccattgcatcactccagcctgggcgacagagagactttgtctcaaaagaaaaaaaaaaagaaaaaagaaaggaaaccatatatggctcagaggaaactctcaagaggacttgggtcttttgacttgttattcctggatagctccacgtgcaggtcgcatatttatcaaagagccaacaaagctacacttagcatctctcctttcaagcctgtatttctaggctctgacagtggtgccactcagttgcctaagccagaaatctgggagttaacctgggcttttccattcccaaagccctgtctcttctaccttcataaaaatctcctaccatttcctgttcatctttcatgtttcatctccctgctttcttccctaaagcattaaacattaaaaataattattttaaaaccccactaggtagaatgggtcactgttttccatgtgccctcagcattcctaatgtattccataacttcttagttgtatgtcagtgtgattattattcattccaagggcagtggccacaattttatatttatttatttagttttttgttttgagacagggtctcactctgttgcccaggctggagtgcaatggcatgatcatagttcactgcagcctcgagttcctgggctcaagcaatcctcttgcttcaccctccgagtagggggatcacaggtgtgatcctggctaaattagcacccggctaatttttaatttctttttgtacagcgggggtctcactatgctgcccaggttggtctcaaactcctgggctcgagtggtcctcccatctctcggcctctcaaagtactgggattacaggcgtaagctactgcccccggccagggttgcttgttttggagacttctcagcaagccaatgcttgaatatatggtggtttaaatggagagaggttggggtcagggagaaaagctctagagatgatgacagtgatttagaggtgaaaaggaggattgaattatgattatgactacttataaagagctattctttctgaccatgtgacactggacatgtaccttcctcactctgttaggtttctcacctataaaatgggctgtaggaatgttaaatgaggtaatggatgtaaaagcatgtaaatgagagaatatgtgtaaaaatacataactactcagcatagtgcctgactcataataggactcaggaggtgacagtagctgtcattattcttactcataattacatcatgactgttattactactgattgaatgtagcaattcgagaatagagaaaaaatgaaaatgctagaaagtcacacattttcagggctgggctggcgcgaagacacattttgacagaatgagagaaatctcataggaaggaagacaaagtcagtttgtctttgcaaggttctgggccccagatgattcattctcagatgctctgggaaggactgcgtagaataagcatgggcaaacttccaggcctagtcacaagcaactctacacactttccccatctctctggttgcgaagaggagtctcaggttagaaacccaaagcgggagactcatcacatgttcacgtttttccctgcacagtggtcagtgctgtgtgtcagtcaaggccatgtctagggtcagcgctgctccaggagcctctggctttgtccttcaggtgggcagtcccttgctgtgtctcttcttcagacccttcaaccttacctctagccctggcttttagtttgggtaggagtttgtggcacatactcttttaatgacaggagatggggcaagaatgaggatgagggggagaaagaaagacatctggaagttttgtacatgaagctccccaggtgggtgaacggtggagctgaacatgagttcagaccacgtagttcagcagcgtgtcctgcattttatagatgagaggaggctttgagaggtcaagtgacttacttgttcacacagcctggcagctgaaaccccttctccctaaaggggaggaggaacagagggcttggagttgacccaagaaatgacttcgccctcctcttcctttcctccctcttcctcttgttcttattcttcccttccctctccctcttccccactggtttttctaaacctttcttttggggccgggcacagtggctcacgcctgtaatcccagcactttgggaggccgaggcgggcctgaggtcgggaggtcgagaccagcctgaccaacatggagaaaccccatctctactaaaaatacaaaattagccgggtgtggtggcacatgcctgtaatcccagccactcgggaggctgaggcaggagaatcacttgaacctgggagatggtggttgcagtgagctgagatcatgccattgcactccagcctgggcaacaagagtaaaaactccgtctcaaaaaaaaaaaaaaaaaaaaaacaaaaaaaaaacaacccagaaaaacccaaaaaacaaacaaacaaaagaaccaaaaacccctttctttcatgcctagattcattccaaaaaggtttaagacagcaacaagtgattccaggatctcagctgtgggcatccttgtgttactggatggctgtgtgttaattgttagcagctggaataagtgaagagggtctcgtcctcatactcaaagtcctttgctcatgcccaaggccagaggctactcatgctgaaacattaccatctccctccaaagtgcagggtttagtcactgagtactgggtggagcacatgactggatcccagttaatccctcccagcttaccagtaaaacctcaggattcatgctttcctgggagccacctgcggccactaagataggagcggggttcagacatggccaggcgctcctaatctcagacccaaagtgcaatttttggcagcctgcatgagaaggagggtgggaggaaaggtggctagaaccaagggtagcagcctgggggcttgagaggaaaccaggcacagcccatcctaccctgtctcacgagcagcccgtcctcctcctgactccccttaccccacacaccgagcgccattctcttgctgcctcatctattctggttaggtacttactgagcatcaggtgctaggcaagtggctggggagagacaacgtttaatgactcagtctccgcctgcacagagcctttgagtctagagggagacacagacttactgacaggctgggttgtgtaataagtgctacgggaggaaaagctgagagtgtctgagaatttatgagatgtgtgtctcatcagacttgggcatcaaaaaaaaaaaaaaaaaaaaaccatcctggaggaaaggacctctacgtcaagtgaagggtggggtccatttggtttttataggagcaagttctttgttggctggactctagatctcccgtcctttgactttggttacaaataatatccaaaccaccgctagtctcattctcttttctctttcctgctctagccctttgctcctctcccaggctgtttctctagctccagacagttcatattcctaaatgctgatcacttctcttttccctctcaaatgctgctttctagaaatcattttcagtttttcagaaccctgtccatctcttccaatcccctggtgtctttcccttacctgggtcattctctgggcaacatggcaccctttcagtgcagacttgtttattaataactccagtgagttttattttcctcttactaaattcaaagtactcagaacattttagacttgttgagcaatccctatcagcttagggatggggtgggggaggctaacagaggtgaattaagaatgataattccaaactaattagtcatccagattaaaaaaaatagactaagatggttttttttttttaaagacatttgtgagagaattgggaaatatgaatcctaactagatagttgataataaaggattcttgttagttattaaagtgtggttaagaaggagtttttatcttttagagagacgttctagactggacatgggggctcacacctgtaatcccagcactttgggaggccgagagggggaggatcctttgaagccaggagttcaagaccagcctggggaacatagcaagactccatctctaaaaaaataaagattaaaaaaattagccaggtgtggtggcatgcgcttgtagtttcagcttcttgtgggtgctgaggtgggaagataccttgagcccaggaagtcaaggctccagtgagccacagtcacaccactgcactccaccctgggtgacagagtgagaatctatctcaaaaagaaaaaaaagggctgggcacggtggctcacgcctgtaatcccagcactttgggatgctgaggtgggtggatcagctgaggtcgggtatttgagaccagcctgatcaacatggagaaaccctgtctctactaaaaatacaaaattagccgggcatggtggcgcatgcctgtaatcccagctactcgggaggctgaggtaggagaaccgcttgaacctgggaggtggaggttgccgggcgccgatatcgcgccattgcactccagcctgggcaacgggagtgaaactccgtctcaaacaaaaaagaaaaaagaaaaaaaaatacacatactatttatagataaaattacatgatgtctgagacttgcttaaaaatagtctagggagtggggtggggaatgcagacgaagcaaaattggccatatagtaataattttttgaaatgaagtgctggatacatgggactccattataaaactttctataatgaaaacaagtttttttttaatttttaattttttaaaaatagacacggtcttattctatctcccaggcagaattgcggtgacgtgatcacagctcactgcagcttcgaaatcctgggctcaagcaattctcctatctaagtctctcgagtagctgggactacaagtgtgcccctccgcacctggctaatttttacatttttatttttctagagacagtggtctcaccatcttgcccagactgctcttgaattcctgggctcaaacgatcagcccgcttcggcctcccaaagtgctaggattaaaggcctgagccactgcggctggcctaaataatgtttaaaaggaacttcaagaactatttctccattccctgttgcatgattgggaggtgggaggtggaggtgacatttggggaaactggttttttcttctctttacacccactgccattacttttgttggatcctggtctgtgggttctataaggccctgagactcagcaccctcctgcgcagctgcgctggaagaggagcctataggttctagatgggggctctgccttccctcctgtctgtccagtaccagaactgttcttgaggcaaacaccacatcaatctctgtcaagatttagagtcatcaggttcaaagtccctcataacgatcctgtccctcataacaatcaggtaattatgaaaacaactacttgtccacaaacagtaatacctgatgggtggggaaggagcaattggcagagaggggcagggagagggagagatcaaagggaagagggaaatacctttcctgctagacaacaccctggtgattaatctgccggggtgtggagagacacagtgaagtgcacagggcctgagttccttccgctcgccgcccttgaaggaaatagggtcttcctcttccacattcacggtgtagcctgggagagccctcatacttcctctttcttatgtcaaagaggggaccaaagaggggacatttgtaggcaagacggatcagacttgggtgcttggattgcaggggctgtctatatctgaacctcatttgcctttttcttcctatttctcattctgcactgccctgtagaggtatagcccattctttgtgctctgcttgtggtagcgatggctgtggtgtagcttccaggagggtagagtgtttaggtgacagacccactgtgagggaaggcggtgggaggcccatggccatagtgacaggtgccatccgtctctctcttctactgtggtagaagtggaaacgtgtctgtttctggctttaccatggagtgcttagagcagtgatcagcacatagtggtgctcggtaaatatttgttgaatgaatgactacataaaataaagttgagattggagagccaaattttattaaaattcgggaagatcgatttaagctatatctggtgtcactttaacacactatacataatatcgtgataatatatattcacatgatattcacatatgtatcatacatatgtatgtatatgtatatattgcatatatacatatgtacaatcttcctacttgctatatgaattaaataattttggtaagatgactatctcttctagtggaaaagaaaattttgtggtttttttttttttttttttgagatggaatctctctctgtcacccagcctggagtgcagtggcatgatccccgctcactgcacctctgcctcccgggttcaagcaattcttctgcctcagcctcccgagtagctgggattacaggtgcgtgccactatgcctggctaatttttgtatttttagtagagacagggtttcgccatgttggccaggctggtctcaaactcctgacctcaggtgatctgcccgccttggcctcccaaagtgctggaatggcataagccactgtgcccggccaagaaggttgttttttccgagctgttttttctgctctaaggaaagaggcaggattcaggggatgctttgtatcttttcctgcttcccaacccgagtccttcctcttgttttggatttcttgctgcatcatctctgtccttctttagggctggaggtgacctctgcgagccttcccttcctctaactctggcctctttcctgctgcaacatagttctcttctagtccgttcaaaactttttattgccacgtgaacaatctcattgggaaacaaaaaactcaagaaaaaaaatcccatgcccaaaaagcatggaacacaacaaaaagaatagtgtagaagacacttaaataagcaataaaataatttgaatgaaattgttgacaaactggactatagttatgtctagccttgttgaatctcaacatcttattcgacattgactttggaatttgtgagccacctgttttgaggaaatggggacactcctttctctttttcgatttcccaatttatcttcccacttgtgccctgaatcctgaggacttagatttcctaggggtatggtcaaggagctgggtctaaaattcacacgaagattgtaggggcagagaaagaagcctttctcctgacaaaggacagatatatgggaagtaaactgtaatacagctagtggcttcctgattatccgaatgagtaagtagatttctcactttgtggatggtccgttacctgggatctcctatcctcctggggctgaactaggagagtggaaccagagtcataatgaggcatctgatgaggggaggggtagggagagagagaaagagacgtagagaggaggagagagagaaggatatctcagatctcattttaaggctaatttgagaggagacacgtagagtacttgagaacctgggtcctggcaccagacaacctggattcagatcctggctgtgccatttcctggttgtatgatgttgggcatgtaacttgacttctctgcctcagtttcctcatctgtaaaataggataatagttttacctcatagggttgctatgaaatgaagtaagtaatgtatatatagagtgattagaagtaaaaattcgaggctgggcggggtgactcaacacctataatcccagcactttgggagggcaaggcaagaggattaattgagcccaggaatttgcgaccagcctgggcaacatggtgaaaccccatctctacaaaaatacaaaaattagcggggtgtggtggcacacgcctgtaatcccagctactcaggaggctgaggtcgggggaggatggcttgagcccaggaggtggaggttgcagtgggtcgagatccagcctgggtgacagagcgaggctctgttccccccatccccccaaaaaggagtaaaaattggagcaatactaaaaatgaacatgttagctatgaagattattttttgttggattacccgctatttatgtgccatccaggacgttcctctttacaggtagccaatttagagctggttatgacagacaagacccctttcataacttttcggaattagtggagccatctttacacatcttaaggaggaggccgggcacggtggctcacacctgtaatcccagcactttgggaggctgaaggagtttgagatcaacctgaggtcgggagtttgagaccagcttgaccaacatgcagaaaccccatctctactaaaaatacaaaattagctgggcatgttggcgcgtgcctgtaatctcagctactcaggaggctgaggcagaattgcttgaacccaggaggcggaggttgcggtgagccaagattgtgccattgcactccagcctgggcaaaaagagcgaaactccgtctaaaaaaaaaaaaacaaaaactcaaaaacaaatcttaaggaggaggggcagaataattctgaaccacagagcctaagaagaggacccagccgctggctcagaagggaatgctcggccttctgtagaaaaatctgctattcagagaccatcatgggtaacacggtgaaaccccgtctctactaaaaatacaaaaaaaaaattagccgggcatggtggcacatgcctgtagtaccagctactctggaggctgaggcaggagaatcacttgagcccgggaggcggagcttgcagtgagccgagattgtgccactgcactccagcctgggcgacagagcgagactctgtctcaaaaaaaaaaaaaaagagagagaaagaaaaatctaccattcagataactcctcttatccatgagagaataggatgcttacaaatgataactgtatcagggccaaaggtagaggctgcaacgttatgattaaagtgttaacttcaagtttagatagttccatgttcactaattcctaagaaaacactagtaaaaaaatatcaggaaccctggcaggttatttgtaatatatacacgtatatatatttcaagagacagggtcttgctctgttgcccaggctggggtgcagtgacgtgatcatagctcactgcatccttgaactcctggactccagcgatattcccacctcagccttttgagtagctgggactacaggtgcgtgccaccatgcccagctaattttttaatataaagatggagtcttgctatgttgccctgtctggtctcaaacttcagagagcaaatgatcctcctgcttcagactcctgaagtgctgggattataggcatgagccaacacgtccagccctgtgaagttttttgagattaggcttcaaaatacctcttcagagtgttaggttctctggctttaaggtaaatattaatatagttaaactgggggaagggacatatgggatttcttcctggttcttcaacaggttttagaatttactacaggaggtagaggaaagttagtagctttacttaatgtagtaagctcaaagtcaaaaccctggctaaacatgcaaaattggtttcctaatccttttttagtcttctgtgtctgaggactgtgttaggagattcaataccttctccccactccaacattccttttctgcaggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggtacagatgcagcctggctaggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattggtgtagactgggagagccctcctcacttcccctttcttgtgctgtaatttcctgtggggcagaacacctcagaggtttctgtgcatcaaaataagatgcagcaaagacatggaaaaaggataacgagacaaattcccagcaataagtagatgaggttgtgttttttataaaagataacgaggcattccttccagaaatgtggagcctttgtagatttcagtgcataaaaccaagccatgatttcctgcagtgatcacagagcagagaagggagaaagcccttttatcacaaaccagcaggaagtctctgtaaaattggtaaggattctggtttagtgtgaagaaccacattttttgtgtatgtttctgggcccatgggaaggaacagatcatatttgacatacaagaatcaaatgattcaggccaggcatggtggctcactcctgtaatcctagccctctgggaggctgaggtgggaggattgcttgagcccagaagtttgagaccagcttgggcaaaatagcaagacttcatctctatttaaaaaaaaaaaaaaaaaaaaaaaaagaatcaagtgattttgctcttatctggagttgagacaagccagatgttctcgtgttgttttcataagcaaaagaggctaaactgatggccagaaagtactcctgctcatagggacctattcattggtctccagggtttacactgacctttaagtctaatcacagggggtgggtggttttgggataggaatgaggaacctccaaggccatgttcttagctccagctaaaaataggtctttcctttgctcttaagcctgaggtgtggaacttcctggtgctactcactgcagctatggtccctgtctagggcacttggaagtctgaagggaggcggaggagggcaggaggggttatttaaccacccagcccctcctgtccgttccgtggcttcactccatcacctcactcctgtacttcctgttctcattcactgatgagtcttccttccttcattcatttcaagggccactgtcagctttctcccttaaaatgcttctctggcctccatgctttgctgctcactttcctccctgggtcccctgagccaccccatcccatcaaatccttcctgagcccttccacagttggaaccaacaacctctgaagctttgctcgcagtccagatgaaccaagtcgctgtgctttcctgcctgtgcctgtgctccaggtgtgtctgtcctctgcctggtgtgaccatctccctcttctgcccttctccaggatcaggcattccccagtttcccctggtaatcactccaccctgtgcatctgtaggactttgaaatgctcttatcagggtctgtctcattgcactgttatttatgtacctgtcatatgttccttactctccagtgtcagctgcaaggagggatcattctggttaatctttatgtgcttcaccatctctctcttttttttttttttttgagacagagtctcgctctgtcacccaggctggagtgcagggacataatcttggctcgccacaagctctgcctcccaggttcaagcaattctcctgcctcagcctcccgagtagctgggattacagacgtgcaccattatgcccaactaatttttttgtgtttttagtagagacggggtttcaccatcttggccaggctggtctcgaactcctgacctcatgatccgcccgcctaggccttccaaagtgctgggattacaggcatgagccaccgtgcccagccacgatctcttaaataaaggcgtttaagtgtttgttcagcaaattgggcccataaatttggtgggaaataaatgaattgctttgaactgcattcatgatgattgcatgtgtttatccttgtttcccaagcctttggttttccccaaatacacagaaaacagttgctcatcaatcctgcctcttcccaatgaaaatgatacaaatatatacatattttccttgtcaggcagttgaaataggtaaatccccagtgagattcactctaggtacacccctggccagatctatatctgaaatgactggtttttatgactttttcttttttttttttttgtttgagacagagtcttgttctgtcgcccaggctggagtgcagtggtgcgatctcggctcactgcaagctccacctcctgggttcacaccattctcctgcctcagcctcccgagtagctgggactacaggtgcccgccaccacgcctggctaattttttgtatttttaatagagatggggtttcaccttgttagccaggatggtctcgatctcctgaccttgtgatctgcccacctcggccgcccaaagttctgggattacaggcgtgagccaccatgcccagcccatgacttttcaaatgtgcttttgaagtggtcctaggatgaggtggggctctggtgaagttctgaaaaggggcgtccctagtcatcatagttattcattcattcaaccaatattgtgtttgctttgtgcctggtcctaggcttgaggacctagtctctgtccctccaagaaacttaaggtctgctggagagacaggcaattaaatgggcaagatgtcacactgtgataagtgatacaatggggtgaacataggtgggggccccagtggtttaatttctcctgttcctccatttcaggttttgaagagacaggggacacgctctatgccccctattccacacattttcagctgcaggtaagtgatttttttctccctcttcatcaaaggcattagcacctcaggaacactgatcctttggaaacagacgatgttacctttctcatggcccctagatggccacttgaaggaatgatgggtcttctttcctctaagcggcctcacggggttagtgggtaagaatgagtgcttggcatagagaggacttgggggtgggaggcctgggagaaagggaaggaaatgagacttctgcccagactggagacctgttgaaatggcaggaactggagtgggtttcacgatatgactgtttccttttcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaataaagcaatgtggtttcacatatattatctatcataggctagggactcaagaaatgcatattccccccccactttctttctctctttccttccttccttcctttcttctttctttctttctttctttctttctttctttctttctttctttctctctctctctctctctctctttctttctttctttttgagatagagtctcactctgtcatccaggctggagtgcagtggcatgatctcagctcactgcagcctccgcatcctgggttcaagcgattttcgtgcctcggccttctgagtagctgggattacaggcgtgcgtgcgccaccacgcctggctaatttttgtatttttagtacagacgaggtttcaccatgttgaccaggctggtcttgaactcctgatcttaagtgatctgcccgccttggcctcccaaagtgctgggattacgggtgggaatcaccatgcccagcctcctttccatcttttctttccttctctggtcttcatactaccaaccaagcaagggaggaggagtaaaaggtaaaatcacaaaatactctggatcggcatttttttttttttttttttttgagacagggtctagctctatggcccaggctggagtgcagtggcacaatcatagctcactgcagcctcaactttctgtgctcgagtgattctcctgcctcagtctcctgagtagctgggaccacagacgtgcactaccacacttggctaattttattttttcagagatcacatgtggtttgagggaggatagagaggacagggtgtcaagaacagcatttttaccaagttgatataaaaatgaaacaggatccaggcatgggtctttacactgatagttacagtaagttttaaaatctgagcagcaatttgaatcacttgttgaaaaacacacaaaatatattttttgtagaggtgggggtcttgctctgttgcccaggctggtcttgaactcgagattctcctgctttggcctcccacaagtgctgggattacaggcgtgagctactgcacccggcctgctttctttttagtgaaaaggatctgtgggagcttttattcccatggctgccttcctcaagtcaacctctttccccggaaatggcatcatctctggactgttgtttctccttcttccttctcctccttctcctcctcctcctcctccaccatgcccggct

SEQ ID NO: 15356 - DNA, 29326 bp, Human
ccaagcacaccttatcatcgtttacattctgagcccgaccaaaaatggtaggtaaagtgacaaaggcggaaagaaggcagacagaaagaatcatcttcgtcatgcatttccccttctgcctcatagggtacgtgagaggcttcatgatcccaaggtacctgtcgatgctgatcacgtacaaggtcaagatccaggccgtgcagcacatgacattcacggagaagacgttacagaaaaagtgtccaaagatccacttgcccccgatgaggtcggtgacactgatgaagggcatgaccgccatggccaccgagaggttggccagcgccatggacacgatgaggtagttggagggctggcggagcttcttgacgaagcacacggagataccaccaggcagttgcccgcgatcgcagagagatgagcgtcaggacagagccgatcacaactttctcggccctttcttgatttgctccccgcggccggaggcattgcccggggttgcgtcccaggtgggcgccgggctggccgtcacctcgggggccccgctcagcagatgcggcgtcccggagaccgcgaccggttcggcgccaccgtcggggctcaggtcgggcagcctgccccccacctccggcaggaggaaagagcagaggcgcccgtagaggtccgggtggccgctgctgttaacatccatcactgcgccgccgtgtggcgctgcccaagaagccgccccacccccctccccacccccgcggccgccacaggctccggctttcggccccggggcttcaactcgccggttcccctccgcccggcccagcttgaggcctgcaccggccgctgggcagcgccaggctcggcctcggggccccgcctgtcccagatccccggccgctgcgtgaaacgcgagagcgctgccgagcggggactccctgagggagggacctcggaccccgacggacgcccgggacgcgcgggctctcgggcgctccggcggggctcggcccgcggctccacagcccgctgcacccgcgcggctcggagcaatggaggatcaggcagcggcagaagcttccgtttcctcctttttaaatggctccaaaatatttcttgtcggtggtgtggagtagagatttattggtaaaatacttgacagaaagcaggcactcagctgagtaaatggtgacaaaattggtgagaagatttttgaacaggagtgaacgagaaaagccatgcttagaaaagtcacctggaaactgtgatttagagggatggtaggaaagagtggcagcaggaaagtggtttggatgctctttcaatggtctagaagaggtcatggggcgggggtagagggacagctaccaagacagggagcctggccgccgctgtaccagcgggatcgagccttcgggtagaggaccggagaagcgtgagcaacccggggctcggaggttggagcccaggcacctgagagaggacgttccccaccaccgctgcctaaagccactccaggcgagaatcgctttccagggccccagcggataggttagactcagaataagagaaggggtctgcggagggggacggcctgaggcccgcggccgggttccctccccagacacccgcggaaagcccgaaaggaggcggaacacggcccagcggctcgccacggcgggcccatcccttgcttagccgcctcgcaccctcgcctcaccgcactgctgcactgctgcactgctgccctgctgcccgcccttcgcatcactgacccgccctctctccgccccctcgcctcgccgccccgccctctctctccgccccttcacctcgccgtcccgcccccttgcctcaccgccgggctgaattgccgccccgccctctagccacgccctctggcccctgcctctagccccgcctctcgcctcgccgcctcgccgtcccgccgccttgccgccctgccaccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggtaggcccgcagggctgccgaggacctgaaggattgctgcctcccacccccaccctcgtcggggctgcagcgggtgctgaggggcaggtggggcaggaatgtgctatcgaaggtgcgttctggtgtctgtcgcgagtgcggctctccaccgcccagcatttggactgggaaggaaaggagtgagaggtccccctgcagccggtggtgagaggaggggggtaaacaggagagactgatccaaggagagaatcccaacttggggagttgggcactgcctgttgaatgcattctttcgtttaaaatattccaaacattccgaacagtttgatttgttgagagacactcggttgcagaaatgagtgtcgcaagaaactcccaagtactagagaactgcggatagtagccccctttatccgcgatttcagttacctgtggtcagctcttgtccataactattaaatggaaaattccagaaatacagaagtcctaagttttaagtttccggccattctgcgtagcaggatgaaatcttgattcctgggaccggaatgcccctttgtccaaggtcagcctcctatctctagtacccgcccttagtcacttagtagctagcttggtgatcggatcgaccgtggcggtattcaagtaacccttattttacttagtaatggccccaaagtgcaagcttagcaatgctggcatattgttataattgctgttattttattattgttgttcatctcttactgtgcctaattgataaagttaaactatatcataggtatgtatgtataggaaaaaacgtagtagatacagggttcagttttgtccaccgtttcaggtatccactggggggcttggaaggtatctactatagataagggggactactgtgtaaaagaacaagatctgtgcagaatagatataaatgcgctacgcagggagcacagaggcagtcaattctgccagggggctatgatggggccttcagtggagtgtcctgagctggggcctcagggatgtgtaggagtgcacacaacagagaagagcatgcacaaaggcccagagctgtaccattgcttttggccagttagatcctctggagttgggtacctagaatacagaatgagtgagaagagcataattgctgtcttcccccaaatttatatcagtgctaacatgggctaactggactgcacccctgaaaacaaggagagtgctgctagattataatctcctggtggacaggtagtttaaacagtgcagctgtatacagagctcccaatacgatgcctcatttgtgaaaggactgtattgcctgggggccaagttctgatacctagtacaatgatcttcatatcacgaaagccctcaattagactctaatctgaactctttgacaaccaaagacctttcacctgttcttatctccgtttccccagctctatgtagaatgaacagtttagccctgatcagaggtcccacatttgaatacctgcagcaaccaggcaggtaatggaaatggatgaagctggctgttttaggctataaggcatagtggggactgaggcaaatcagagagtgaactcaggtccccatctctaaacggcagttccagccacttgttgctatgcagtgatatatgaaacagtgttgccaaattcttaaggaaaaccatacatccagattcttagcgaaatcacccaatttaaaattaattcgacaaaaactgttttttgagtgctatgtgccaggcactcttctaggcaatgggataaaagattaaaaccagcaaaattctctgccctcatggaacttatgttttattggctaatgaacaaataaaatgtatcatggatcagatagtgatcagtgctgtgaagaaaagcaagcagggaaggggagtgaggaatagggagtattaggagtgaggctgtgattttgagtagggaaactgacatagttgtgcataggctggacacaaatgcaataaggatgccagttattaatatcagtcctgctgtgagcatccaaaggacccacccaagccaacacagagagctgtctatccgcctccctgggcaatgaaaaaggcacctgataaggtctgcagcatcactggcctccccatcaagtagttgccctactcagaaccacagcctttctcctaacagccctgatgaaggttcctgtgattctaacactttaagaatccatgtgttcttgcttttgtcatggaatggggctcactttgtctttttggattaatgatgatggcccacacaggcggagaggggtctgggctggttcgtggcctgtgccctcagattccttcctcacccattccctgctctgctgtcttcctgtggagtggaagctgacccattcggcctgtttcccaggccagatgtcagccggcgcccagctacgtttgctcagtgggagtctctactgggagataaaaagggagaaaccagagtatttctcctccttctccaccccatcagatccatactactaggagcttctctgtggctttggcttccgctacacaggccaccatgattctagcttctacccagtaacctaggtatctgaacttaggtaacaggtaattctccctctgtgtctcctagggtgcttactaacctctaggttgcctctctgtcccctgctggcatctcagcccctctgttatctgtgcaaccaatcccttgcatcgaagtgcttctgctctaaatactctagtagtttctgtttcctgtttgactcttattgatacagtgtcacttgccgttaatttggggcctctgggataaggagaactccctaataagcatcttctctcagtgtttgatgggaatatggggccatatgggatattggtaccaggctaaagcaaatcatttaacccaaatgaacctgtttctacagctataaaatgagtataaaaatatcttttccatctatttccagagttactataagtattaaattctttaaaaccatgaaaacattttgtaaagtagtatacataccctacaaatatagtaatagcattatatcagtgctcatctcagcttcattctttctagctgtgtggtcacaggccaacttagcccctctgaagctaattgtggaagaaaataatagttcatatattaatagattgttttgaagttcaaatgagataaccaattataaaactgttcaatgttagtacttggttggagatggtaatggttagctttactgtagttttacagtaaagtttgggtaaattacttaacatcccgtgagcccttgaattcctcaactctaagatgagaataacaatgccaatgtgaaattaattaattatgcatagatacttgtaaaccttttttttttaaatatacaaacataaaggtattatttttgaagagaacctctccctgaaattatattttatcctggaaacagcctgggtcagaaactattgtccactctcctgggcaaatgatggcataccatattccccacatagcatgggcttcaggctcaccagatgttggggactgattccaagtacttggcagggaggccagtgctgccgcagaccttatcaggtgccttcttaattgctcagggagggaggagggtagacagctctctgtgttggattgggtgggcctttggatgctcacagcagaactgatattagtaactgacatccttaatcagatttgtgtccggcctgtgcacacaggttaggacctgatagcctggctttgagtcctggctccactattcacccgctgcagtttgggcatgttacttaacctcttgttccccagtttcatctgaaaatgaagattaaagccctaacttcttcacagggttattggagaaattgaatgaatgaatccacgtaaagcatttaaaataacaccagacaaatagaaagtactctgttaggttaattgttatgatcagtattttcttgtaatgagaaagcaggtttccaacattagcatgtatacccactacatgaagtggcaagaaaaaaactgacctttcaaaggacttacaaatcccatagccagaggcattcttgttaaacctttgtctgggacttgaacttgaccaaggttcccactgaatgttgaaaattggtttttgtagccacaggccaaaatctccatctaggaactgattgggagcatagactaatggagatggggtgaaggagggctactattgtgttccatgtcacaagcaaatgcactaaagatgttaaattttaagaatcaagactgtattaacttagctgccttattctctacagcagtagagaattctggttaaatacatttaaatagagctccctggagaactagaatagttttacaaatccatctcttaagcctgaattttcacagtggtcccgtggttcaaatgagtggttatggatacagatgctatgaaaacaagtgatccctgcgctagaactggtttaatacattgtggcccagcttttctccaggagatcctattagacgaggtcctcatctctctgcccatctattatggctcttgtattccttgtcattagagtaaaactaggttttactctgcatatctcctttctcacaaatatttgtagagtgcctacaatatgcaaggcgtggtacatctaggtacagagagatacagcggtgaacaagagaaacagtccttaccctgtggggcttgtgggtggaggtgggagtttaacacatcatttaattgtaattacaataagtattgtgttatgaaggtacagcgtgggtaagaatatcacagggaacctattttaagtcaggatcctctctgaggaagtaacttttaggttggagcctgttagatgaatagggagacaccaggcaaaggcaggaggagaatgctccagggagagggagcagcagacacagaggccctggcgtggaaatgaccatggcatcaaaggaaacagcagaaagctgcagagcaggtgctgtgagtgtggctggcaacgtaggtagaagctcagtggtgcctgcatcatcaagggcaggttaagaacttgatgaatgaatgcctttaggcagcagattaattaacacagttagattggtgtagagtgccctatatatgctctctggacaatcccaacctcattcacagctctagtctccccttatgctaatgactcccaaatttacgcctctatgccagtcccctgctgagctccagacctgtgtgcccaactacccaatggacagtttgctcatctgtatcaggaggagatgaactgatggacacatgagaccccttccagctctagagttatctgactttaggggttcctagaaaggagggatcactcaggaggaggaggtggtgaagttgagccaagccttgaaggatgataggtgtatcatgggggacttggctctccaagtcaagctggagtcccttcttggcagcctttctttccttgctgtggactttgtgcctggagaacaggccaagagcacaggttgctcgtgccattttatagatctcttttctgctgcagagaccctccattcaagacccagacatacttgcaaaatcctatgtttaggtcacaaatgtcagttgaactaatttagagtagatgaactggcttgctatcaaatcaccatcactggactaatggttacaaaatccaactcccacaacagcctctgagttcttctgagatctggcccctgccagaacaccttttttgtgtcctgcttgacagtctttgctccagccacaactatttgtaatatttgtactcacagtcatcatactgttcttgacccctcctcgtttactcttatggtacccactacctggaatatcctccccaaatgatcagagcatttactgcattgtacaataatttgtgtaatactcctcaccatcctcctgattatccctatcatattaatctccaaatctgtaccacctggcaaagtttttcgacaatgtttattccatgaattaataaagtagtgactgaacgtccagttgggtgatctgtgaccacctcaaagtcagcttgacctccccaaacatgttatcacatacacccatgccccataaactaacctaagtggtcctttcctgtgttcccatactgccctggcactccttgccccctaaaaatatcattagatgataaccttctgttttcctggcatcttcccttatagcacctgtaacaatgttcagcacgtggtagatactcagtagttgttggttaaatgaataaaagaagaaaaagaccaaaggaaagagccagttagctctttctccagtgagatcttgtttttggtcttcccatttgtaaaagaagtaactgcgtaaaatgacttctgatacctctattctgaatttgatatgggcatacaactgtccgcccaaagtatctaacacagtggctaaagagagaggttacagactgggcaacattgcaagaccccatctgaaagagagagagagagagagagagagagagagaggaaaagaaaaaaaaaaaaagcaaagacactttggaaggctgacataggtggatcgcatgagctcagaagtttgagaccagcttgggcaacgtggtgaaaccctgtctctacaaaagaagacagagaaaacaaaatacaaaaaaaattagctgggcatggtggcacacacctgtagtcccagctacttaggaggatgaggtgggaggatcacgtgagcccaggaggctgaagttacagtgagccaagattgtaccactgcactccagcttgagcaaccatgagaccctgtaagaaagagaaagaaagagagagagagagaggaaggaaggaaggaaggaagggagggagggagggagggagggggaaacgaaagaaaaaaagaaagacagagagaggaaagaaaggaggataaagaaaagaaacagaggtttaaatgctcacttcaccccccatagctttagagaaccttgcaacgagtattagactggagtagactagagtttgggaactggaatttttgtttcagtttcaccattcagtagttacatcactttgagcaacttagtctctctggttcttcattttctccttgataaaattagttagattaggtaaactttaaaaccattttaggttctgaacttctgtgattcacaggatagtgtttctggaatttaaaacattacaagtgccaagggtaggtgcgctctcaaatgaaaggggagttctggaattctctgcagcaacagaaagagcaaaacaccctaagtttacttaacagtttgctactgaaggctctttggaagtatcagattcaccagatggagggcttcacagcagcctcagaatgattcagcacggtgccccacagtcaaggctgacttgctgcctcatgattcctggtctggcgcaatttcctctaccccatgtgaagggggatttaagtacaaacttggcactcagtgttaaaattacaatattaaggccgggcacagtggcatacctgtaatcccagcactttgggaggccgaggtgggcagaacacctgaggtcaggagttcgagaccagtctgtccaatgtggcaaaaccccatctctactaaaaacacaaaaattagctgggagtggtggcgttcgcctgtagtctcagctacttgtgaggctgaggcagaagaatcacttgaacctgggaggtgaaggttgctgttagcagagatcacaccactgcactccagcccgggtgacagagcaagactctgtctcaaaaataaaataaatattaaatatgctcattgagactacacttgccactcacagccgtacagtcctgccttcctccagagacaccttctgtccccctgggagtcacaccctcttccctagttgtgaatcttcagtctaggatattatatgaaaacctatttgaccagtctagggcagccaggttccctaccatgtgtctgtttttcataatcattgttaggagacacagcaccttaatcaaataaatatctgttgcacttctcacatgtaaagctctgtggtatagtttctgcccataaaggctttattgcagattgttaaaactataataatgtttcattaccagatggtaaaattaacatagaccaactttccttcttctaatgggatggaataaaattcactccagtagagtagaagagaagaaaacaggataggggaaggaacaaaaaaaaagccaggatgcatctcatccataagggtaaagcattactttgtgaaactttaactatgtgtatattcatgataagacaggctgtaaaaaatgctttccttcttgtggattgtgattttttttcaaaatgtgaagaacactgccttacagtatgtccaggaatacaaaattaaattatatgagcaatcacgtggcaaggagcaggagatgtactgaaggagagctgtgggggtccataatgagtaaacaccagggaaaggatagtccaaggacagggcctcaatgcagaaagtggtgatggggagatgaaagaaggatttgtgtgaaaagagacagtggagctgagcattaagcagattgggaggctgtgatttagtgagacaagagttagggagaggatatgctgtgtctgggagcacggtgtgaacagagctacagtcagcccttcctgtctgtgggttctggatccacgattcaaccaaccacagatggaaaatattcaaaaaataataatagcaatacagcaataaaaaatacataaatcaacagcagaggccaggcgtggtgtaactgcccagtgggttcaccttgcctgctgcctagatagaaccaatttatcaagacaggggaattgtaatggagaaagagtaattcatgcagagccagctctgcgggagaccagaggtttgttattactcaaatcagtctccctgagcattcagggatgagagtttttaaagataatttggcaggtagtggcttggggagtggggagtgctgattggtcaggttggagatggaatcatggggggtgccaagttaggtttttcttgctgtcttctgttcctcggtgcaatggcagaactggttgggccagattactggtctgagtggtgtcagctgatccatcgagtacagggtctggaaaatatctcacgcactgatcttaggttttacaatagtgatgttatccccaggagcaatttgaggaggttcagactcttggagccagaggctgcatgacctctaaattgtaatttctaatcttgtagctaatttgttagtcctgcaaagtcagactggaccccaggcaagaagggggtcttattgggaaagggctgttaccaattttctttcagagtcaagccacgaactgaattccttcctacatttagttcggcctaagcccaggaatcccacaaggacagcttaagggttagaaacaagatagagtcaatgaagtctgatttctttcactgtcataatttcctcagttataatttttgcaaaggcagtttcaattgtggctcatgcctataatgccaacactgggaagccaagacaggaggattgcttgagcccaggagtttgagaccagcctgtacaacatagggagactttaccaaaaaaaaaaaaaatttttttttttaattagcagggcatggtggtatgcacctgcggtcccacttactcaggaagcctaagtaggaggatcgcttgagctcaggaggtcgaggctagtgagccatgatcataccactgcacaccagcctgggtgacagagtgaaacactgtctcaaaaataaataaataaataaaatatatgtgtgtgtgtttgtgtgtgtgtgtgtgtgtgtgtgtgtgtgtgtgcacagagagtagcaactatttgcttggcttttacattgtattaagtattataagtaatgtagagatgatttaaagtatgtatgaggatgtgtgtgggttatatgcaaaatactacaccattttatatcagggacttgagcatccatggattttggtatccatagaggtcctggatccagtcccccaaggaggccaagggaaaaatgaactctgattccttgaattgcagtcctcctactagaatgagcctaattttgggagcttcacagttttgttggattgtcatcgttgtattttttgtttcctcccttctaagtttatctgtatttttttctgaatctcctgtttgtttaactttatcttccaacctgtttactgaatttttcttctctgttatcagatttttaatttctgagagctcttttgctctctgaatgttccatttttgtagcattctggttttcaggatgcaatatcttctcttatctccccaagaatataatgtataagattttcctgctttggatattgtctctacaagaatcccagaatctatttctcatggcccttcatactcaggcctgtcccttctgctctatggccatacccaccaaggaaagttttttagccctctgttactacttctagagacatcacaagttgctactttgtacctcttaaacactgtaccttctctctctctaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggtgagtacccctgcaggatgtggctctggtctcgggcaccagctttgcaaggtctcacttcatcagtggtaaatgcaagtgaggggctacaaggcacctgtagtgacctgtttcaatgacctgtgaacctcctgcactgtgtgaacaagcagtttattgcaggaatgtggggaaaccactctgatatcagcccagtctgtccctcacttgaaggcatccctgctcaatatctccaagttcctgcttcactcccaggtgtgggaccatatgctctattttttttttaaccctgcagtgcttattatgtctttggattggttgactaggtggcgtgtgcccacagtaagctgagctacagcacaaggcaaggccagcatcaggctggagatccccagagtcagcccctggtagctcagattctgctgggtcctgaggctcagtgagcagtggggttccagaccctgtctggcaaatgaagggtctgagaattcttgggccatcctgctcttaaaaacttggcagttcatgctggccacctctctacttttaaaatgataagcctgaagtctcatgaaaggtgtacctgttagatgtaaaccatatttaaaaatgagtttgactcgtgagaagccctctaatttgggtagcattttggaatcactgcaaaacaaaaatgggtcagaaagcaagaggaaaaaaaagagatgtgtttaatttttaggatatttctcaagctgataatttagagagctaaaaacatgtgttagccttagtaacatttactaggagctgctctgtctattgagtaaccattcttttattcctttacttacttaaaaaacttgctttaaaaaaaaaatttactaggactaaagtagtcaggctttggaagatacgttaacctgtaggaggtcaggaagaaatcttttccttcttaacactgtcttaacatttttttaaatgaaaatatgtataagaattataaaactcactaaagaaaacctttaaaataacaaaacagtattccctaattcccccattcaatacaatcaatgttgtcttttgaatgtattttttagggctttttaatgtaatcttagtgttcctataattacatatcctgcttctgttagttattatttcataattattttccactagtaccagagtcttcttaagcataattcctagctacattatattgtatcatgtgtctgtaatttacacagacatattcctgttttgaacagaatttataattctgctgtaatgaatatcttactacctatagccttttccatattttagattgatgttttaaataggcagtaattaaatactggctaggcatggtggctcacacctgtaatcccagcactttgggaggccaagatgggcaaatcacttgaggtaggagtttaagacgagcctggccaacatggcaaaaccccatctctactaaaaatacaaaaataagctgggtgtggtggcgcacacctgtaatcccatctactcagaaggctgaggcacaagaatcgcttgaacccaggaacccaggaggcagagtttgcagtaagccgagatcatgccactgcactccagcctgggcaacagagcaagactgtcagaagaaagaaagaaagagagagagagagagagagagagagaaagagagagagagagagagagaaaagagactgataatctacagtcttgatatatattgccaaatcattttttagagttgtaccactatactcctaccaacagcgtatacaaataacaggtgttcatgtatttctgtatttttaacacttgaaatgttcattgttaatttcaagaacaaaaacataccactttgaaagacgaatggaactaatgtgtcttccacagccctgagcaagctctgtctctgatccctgcctcactctgtgcttttgtgttttcaggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgtaaggagacaatccttcaggcatccatgggtggcgcttgattcccgtaccactccttgcatcacctctggcaagcattcgcgtcaaatttttatggttgctgaattaatttaagtaggaaatgctgaatcctaacagtttctcattttaatttcttcaggctgcagcacacacacatttgcattttatcagaataaatgccttggccagttgccaaattgatgggacgagcttaagctttgcttaagcttacagtgaatgtctacattagccatagcagggttctaggagactcagcaaatatcttaagtcaagccatggtctggattcgtggacacatgggaagcataaagggctgaggaatacctgatttctaccccacactccctttgaatgccagagagcagggagcatttgctagagctgggcttccatcctccttgttgttcctggatggtagtcctttgagcagagcacacatctattctcttgtcatcctggtcctgtttccaggacttcatgtggggtcattttcccttgactgtagagaatagcaggtgcaaatggttactagtttctatcccttgtgctccaaactgccctcagaaaccaagtcttctagatcattgatgactcctcacatttgttaaaacactcccatgtgacaggcaccaaaccaggctcagggaaagaccaggatcttcaccagaagtaatcataggtggtttggctccgctcaggagcaacctcatgaaaaattcacatacatataatattgcactggactgagtattggtccacttcagggacctccaaacttggctgccctgctgcaaccctgaacctgatggtgggaccattttccccggagctgtgtcaatgttctgagaatgtgagtttcaccgctgtgtgtagtcctaggccaggtgactgcagggccctccagaggacagtgaatgtaatgcagctgggagctagcaccggagcctcagctcctgtgcttgtcctgcagtcctcattcagacttcccagcttcccttcagagggtgtggagaaagcaaattaacttaacaatatcttttcctagggtggagatgcaccttgggtgcagcatttaaggaagcactcactctcacagctgtccaagtgcaggatggggactgagagtgagcgcctccttaaatcttgtgccctgggttagatgtctgcttgtcttttccattctatttcctgtgtttgggaagcagcaggtataataaaatgaacttgtattttatttgaattccagctctactgcttactagcagaatgatgcttgggaagttagccactttaagacttagcttttgcatttgttaagtgctgataatataacctcctatatatgatgtgtgtgtgtgtgcatgtaatgtaaccttataggattattgttaaatatctttcagtatttactaagatactatttatgtattacctaatgtttatgacctgaagcaggttttggcaattaccccttctgtctgttcattcttatttcataaggaatgagatagacatgattgaatcagttcacattaagacttcaagcagatggggctagtttctgatcgtttgttttaccagaccctgagtaatgagtggatataatttttttttcttttgtctttaactttttagtatgggaattttcaaacttatagaaaggtagaagcatataagatcatgaaatcatatgtgcccatcccctacctacagcaacgatcagctcaaggccaattctgtgtcatgtgtatcttcacagcattcacccagccctaccctggattatttttaggcaaattccagacattatattatttcattcataaatatttcaggtaattactgaagatttttttaaaatataatcacaataccttttttctgaaatttcaatagtacttcattaatttataatataaaatattcaatgctcagatttcccccattactttttttttttttccaacggagtctctctctgttgcccaggctggagtgcagtggtgcgatcttggctcactgcaacctctgctgcctgggttcaagcaattctcctgcctcagcctcccaagtagctgggagtacaggaacctgccactgtgcctaatatttgtagttttttagtagagacagggtttcaccatcttggccaggctggtcttgaactcctgaccttgtgatccacctgcctcggcctcccaaagtgctgggattacaggcgtgagccaccacgcctggccatcatttgttttaatattttgttagaatctggatccaagtcagattttgtagtactttctttttgttgttgttgttaagagacaaggccttgctctgttgcccaggctgcagtgcagtggtgtgatcatagctcactgcagcctcaaactcctgggctcaggtaatcctcccacctcagcctctcaagtagctggtactacagttgcacacaaccacacctggctgatggtacatttttaagcttttattaatctgtgaatttctttaccaacacaactttacattcttcctttccatctgtggatcatttgtcttcttattatctgtactggattttgctgattatatttccgtgacattttaccacatccctctgagccccgtattgcctgtaaattagtagttgaaactaaagactagatcagattcaagtttttgaagttttggtgagaatatttcctacgtggtggtgtttacttccttcaggggcccacagtgtctgattgtccctgattgagtgatgttggtgaccatagttcatcattgcctagatgtcttgttccattagaggccataaaacgataatgttctctgtttctccttcttctttaattacctgcaatatttcagtaaagagaaacttcccctcgtttactatttggcttcctttatttcatatagaaaaagccagatacatgcttacttgataccttctctttatttaccagttttcagaatgataatttcattctgtaacatcctcaaggtaaagtggtctgcatcttcgttttttgagtgtaattataaacatatgaatttaaacatatttgatacgtttcagtttgttacagatattattcttattgatgctctaattgccccactgttggccagcgggagcctcttcaagttggtttgttggtccttttgacacagctccagtagtcgttgatggctccctggcttgctggtataatgagatgttttgagcacatcttagcatttcttgccctagagctagaattagccatttctctaaggaacgctggtttcttatggtgggaaggggtatacgggtactatcaaaggcaggtcggtgaccatttccttttaattctctgaaatctaaacagctgaaagtgccaaatgtggtgtctagcctggctccatggaatttttgacacggagttctcacacagcatatgatcattcctcaactcgccacttgatgtcactgcatagtcaaatgagcattcaaaattaccctgcagtggtttgtgttatttctgattctgttgaaagcaatgttaatgagatggtagaaggcaaatgtactacttcaaatgcaaaagtactctatcaaataatgcagtgagtgcattcaatgacaaaattaattctaaaatgaaagcctggcgtccttcattcagtcttccttctttatgaccttgtgaagagatgtttacaaagggattatacatttattagcatcgttaattaccggtgcttttagatgaatagaatgctgtgaaaaaaaatagcactatcagaatatgtttagtattcacaagaggcaatagaattatcctcacacttagaccagcagcaacattccagactactgtcctttctctatgcacttaagttagagtttggccttttcagctcatttcagcaccaggttctcaatagggaccaacagcaggagaagtttgatggtcttaatgaaactttcacggtttaaatgaaatgtctagatataaaggaaaaagttggaaaccaggagtttattttcagggtaacctatgctccaacccagttcatcattcagtggccataggacctttggtatattgccagcctcactgtacctcagtttcctcatctgtaagatgggcatgagtacctagcttttatggtgttgtgaggataaaatatgataatacctgtaaatacctactcaatcctagacatgaggtagacactcagtaaatgttagcctattctcctcctcctaacttcacctccctttgagaatttgatcaagttttattagaattaacaataaaaaagtcaaagttactgcagatacacttgggttagaacctcagctccaataattatgaattttgtaacttgcagcaagttgtttaatctttctgagcctcagttttctcatctataaaataagatttctaaggcatgattgcaaaggccggtttcattgtgcatttgaaagaactttgtcagctgtcagcacctaggttgctgatgtcatttttccctctaaatgaccaggccccaatggaggccattggcagcttgggaagttccgcctagagaaagagaagtttggaagaaagagctcaactgctaaactcttagggggttcccacattaccacttaggagatttacagaccagtgtttgcccatgttcctagataattcaaccctgtttgtaaccacaggaagttgggaccaagggttttcagtcttagcaccctgctttgccccctcactttgattaaaaggggccttgtccagccgttctattgaaaatagcaccctgtccttttctgtcctcttatccagctttattttgctttgcttcacttataatcaattgcattatatatctctatctgctcatttatttattgccctctccccactagaatgcaagcttcccaagggcagggcctttggctagaatataacaagtgttcaataagaagctgttgaattggccatcacagtggctgacatctgtaattctagtactttgggaggccaaggcaggtggatcacctgagcttagcagttcgagaccagcctgggcaacataatgagaccccgtctctaaataaaaaacaaaaacaagttggtgaatggatacatgaacaaaagagcttcatccttgcctctcctgtgcttctctctctctgctctgtcccataaagatcttggtccccatcatagcttcagctgtcaccagtgtgttggtaactttccagcctaacctctgtctgtctcccctgaatgtcttgccatcccatcagactcagcatggagcctgagacaatgtgatttacccactcgttcattccttcattcaaaagatagtggatttcttgttcacttactctgtaccaggaactattttaggtgtctaacagtaaaatggacgtcatgaggtaatgtccttgcccctggaagaattcaagtgccatctggatagatgggtgacacttatgccatgtgacatttgcactaggtgggaagtttggtttgatttgacaaacatttattaaatatctctaatatttaagccacctcatgtccaaaagccttgccaatgataagattctgtgtctcagcctaattaatcaccattttctctccccctgatagctgtcagttatcccgtaagtcttttataaactcccaccaggcaagggcttcaggctgtttctctgtagatgatgcccgggtcaacacgtctcatgctgccttctctcctaagcaccagccttatatttccagctcccaggaggcatcaccacctcaagtatctcccaaatcagcatgtccaaaacacaacgcagatttccacgcaaaatcagatccctttctgtgttctctgtcttagtgatggtcccctccctcctcctacccaccctgttccaatgtcattctgactccttcacttctgcatctaattattggctcatcctggtcagctcccagctgtcccttccttcccttccatctacacaggtcttcatcatctcttgcacaaatgattgccatggtattggcttccagctctcccatttctgacccttctaaagtgtccttttatcaccacctgcctaaggcacaggactgatcacatcgcctgtctttgctcagaaactgagcctccccagaggctgctcagctctggttgggggcctcaggcccatccaaccagatgttggggtttgaacaaaagcccagttagtaatgagatgcttcatttccactaggagagggtggatcaactttgggtgccaaatgtttgaccaggcagtaaagcctagtaaaaatgccctgtgatggcactgaccaccctccacacatagcaccactcccatgtcaacctgatctcagagcgtcccacccaccaccacccaacatgcctcccaccccagacacaacatccacttccagacctttgctcatatgtccccagctcctctcaaccctccacagcctctgtttgttggaagctctgtgaggacagaaggttgtcatactattcattgccagcatcaagaagagatattgtatttccaaacaaggtcacatacacaaaaaaagtagagatgctcaataaatgcttaatatcacctctttcttaataccttcccttcatgttctaagtcagaacccatcattcgctattcctcacccccagaacattctggatgtaccttccaccttcattccagcatttccttccagccagcataatctttgcatgtgtttctctcctgaccacacttagagctctcgagggtagaaagacatctttatcatccttacagctcttatggtgtctggcttgcattttgtgctcagtgatgttcaactcaataagcacaggtccagcctggttgaatgaaacgcttattgtgtgaagcctctcttcctgttgcagtgaggctgtcagttcctggtctgatacttcttttgcctagcacagggctgcatgcatagcagaccgtacaccagtgtgtgctgatccattgatgttaaagtttcgaagttgaatggtcaagctcagagtcattcttcctccctgcatgcctgcaccagacactccctaaaaaataacacattatgattttttgcttccttggacgaaagccccgcttccctccactagccttcactattgcttgtgtcatctttcccctttctaactcttccagaccttttgagtcagctcctgttgtgtttctggaatcaggggtgtgtgtatgtttgagattcctcagttcccatggtaaccaaattctttattcagaatactgagctctgacattgggtgagataaaacactgccctggaggagagcttctttcaagatgaggcgtttatagataaagacgtattcacaggcttacaaagataatgtatagacttcacgtttctttcttttaggggctcaaagcactttatgagcatttcttaactcaccttcaagtgcgcgcaggaattcggagagcagtgggcccactgttattgtgctccatgtccagattggaagctgaggcacgaaccaatgaggcaaagtgtctgtgaacacaagcagagtcagccagagctaggctcccttcatacaccaggggattccgggtagggttcagtttctggcttgtttgtgcagttctgtgatgggagtcagtgtggttggttaaattagcagagaggagaactcatgtatctgttcccatagcccacccagtttgtttgttttccagtaaaaggattctacgatgaagcaatagggaaaattttatctgcattaccagcatttcagtctgcctgggaataaatgtaaagaattgggggttttcccggagtgaattttaggactccctgagtgatgacattctccatctcactctctgctgggtttccttctgcttctcagccccttctcactgtcctttgaccggtcctctttcttcacccaccatttagatattaggattctaaggagcaagcttctggcctgctgtttgcacaacatctctaccacatgtcacttcttaccatgattatagccagtacctacccactgggcactcccaagtttctgtcactagatccttctccttcccaaattggtatctctgactccagttctgtcccaagtctaaggagatttttacatggtcagacacacatttagataataattgttgcatgaatgtatttcacagagggcccttaatattcatatgccccccaaactaaatcatgaacacccctacagctgcccctcctgcctaatgttactcttcagcctttaatccctattctggctagcggcatcttcttctacccagaggcttaactggaagccctggagaatcctctcttccttcctctctcttacctccctccacatacaggtacctctcaaatctgcctttctcccaccttcatcatctcacacttggctgttcctgggctccggtggccccacatctctcaaccccttgccatttcccctgtccctccactgccagcagagggatccttccaaagcacaattggatcgtgccagtcctctactttaaaaccctttccaggccgggcgtggtggctcacacctgtaatcccagcactttaggaggctgaggcgggtggatcacctgaggtcaggagtttgagaccagcctggccaatacggcaaaaccccatctgtactaaaaatacaaaaattagctgggcgtgtgcctgtagtcccagctactcgggaagctaaggcaggagaatcacttgaacctgggaggcagaggttgcaatgagccgagattgcgccactgcacttcagcctgggtaatagagtgagactctgtctcaaaaaaaaaaaaaaaaaaaaaaaaaaaaaccctttcgtaggtctacctgtgcatataggatgaggttcaaactctttagcatggcattcaaggccttcgcatctggctgcagtggatccacttctcctgtttcagttcccaccactgtcccctcagatgtttattatgtgaatgagtgagtgaaacttatgtaaccacttcactcactaggtcctaagtgctgtcatctttagctctgtcaggctgaagacatcactttcattgtttagcccagaattgttcatttaaccaaggggtccaacatattcaggcactgtgttaggtgctcagtgtacatcagtgaccaaaaaataacaaaaatcctgccattgtgcagcctatattctatcagaggacacaaaccataaacaataaacttaatgagtaaattatatagtatgttaaaaggtgataagtgctgttaaaaaagaaagaaagaaaaagtaaaacataggaagaagattgggatggggttaaagaatggggtttacaaggtaacaaagcattttaagaataggcctaattgagaaagtgagaattgttcattgagccagttcataatattactatggttttttttagttgtattttgtgtttttgttttggagacaggatctcactatgttgtccaggctggaatgcagtggctattcacagatgtgatcatagcacagtgcagcctcaactcctggccttgatcagtcctcctgcctcagcctcccaagtagctgggaccacaggcatgcaccacaacactcagctacatggtatttcgttagattaccatcatgtccctcaccctggagtcagggaattaaaaggctcttctgagcaaactgccaagtaacaataatagctactgtttgttgtgagcttactacgtgacaggctctgcgctgagcagtttgcatagtcttttctcctttaatctttacagtagccttcgaagattgatgttatcactatccctattttaccagtgaaaaacctgaagatttgagaaattttagaattagcttaagacctagaaagggcagcactaggatttgagcacacactagccattttgcctctaactgatgaaggaagacatttgaggaccactcctttggagctttccaaaatcagtatttaaagagccaacattgtcccttttcctagagaacagttcagtgtcacagcacaagtagggggtgcagagagcactcaacacctgcttccacctccagcacttgattcatttcagacaaatggttctccaactaaagacatggttcataaaaaactccagtgtcttacaggctcttattgcctgaaaaaagtctttcctggatgttcattgtctgtctactaacccagtttcctctcatttgaacctcaatgaagctagagcccaactttcttcatctcccttataatctcttcaatatatttgaagaatcaagcctctgctattcaaaattggtctcagtttcatccatgttctgtagctgttgtctagacattggaacaaccaatccattacagaaaacatcctgggtgttcacatcagtgatgctgcaatccacatgctgaatgcttgtccagcatgactaaccacttgtaaaagagcaaagcatgattcagaggactccaccaaaaataatgcattatttggcctaatcttggcctggtgcaaattcagacttttgagtcatacagctcattagaaatcgggatgtacttgactctaataaaaattttagtgcaacccagatttagagtggtatatttaggctaggctacaagacaaattttggaacagaagcacatgacgtaagggagagaataataatcttgaaaagaaaggctttattgcttctctgtccccaatttctgccatcaaaagaaataccagatttaggaacagtctctttccttactagaaaaagaaggctttcatgatttgagcagaagaaaggatttatgagaagtgatttctttatttggggcatgtttaaagcttgtgtggggccctcccaagtcttccttgggtctttgcctttgttagctctgagatttttacttttttagttttggtttttggtttgttttttttttttttttttttttgacacagggtcttgtgttgcccaggctagcctagctctgtttttaaatgaagctgctacaagtcactgctgtgatgaactcagtcactagagctgctctgctgtggaaggggcattagccaccatactcactgcagctctgcccgaagtcccctgtagacttcctccttccagaggtggtgacagagcagcagaaaagaggtacagccgggcagtagagggagccagagaaaagggtgaaggcttggcctttgggaaagcaaacctgctgtccccttgggtatttcaggaaagaaagggaggctcacgtttatactcagctactgtttcaggccccgcattagagtttttcacgtccattactgcttttaacactcaaaactctagaggaaaaagaaaatatatctcctttttcagatgaggaaactgaggctcagagaggtaaaatcaacccatctaggaagtggtgactcagtccccagtcttaccactctagcatgcttgtcataataaacatggtgagtgacttttttctaaagatcccccctctctcagaggtcatgtcctttcgtaaccagcccttgctcttgaacccccaggcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacggtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaatcataagtgtaattatttccaaggttctacagtcctgaaggtaatataggtatgagtactattgatggtgtttaccattgcaggaaccctatatttagagctcccaagtccttccgaatataaacgcaaagataccaggacacacaccatccctaaactagacatttcccatgactgttatgtagcactctgtgattataagttgaggattttgtttgcagctgtggtctgcgaagggttccaggagtcacaagagcagaccaagaagaaaaatcattgcactatggtgcacagactaccctggagacaggagattttccaggaggattggtttagggggatgagatgagaagcagctggggtccagtttcattaactgaagaggataggaaggaaagaaaaggtgcagtttggcctgcagagaaggacacagatgcaaggctgtgagcaggaagccggatggcagctgagctggagcagagcccgtgagtgagcaggggaggatgaagctctcagtgggccccagggcatgtaggaggtactctgatcctcatagtgcatcagggccccacgctctcagcagccctccctacgacagctggacaggttttcagggagaaacccaccttagcacccacccacaccccatttgctgtttctataggaaacagaaaaatgagctttaatcctcaccatgaagagttcttactggacataaagtggggtttcctaaggagaggaacaagagctatatgtcatcatctttcctggagtcctttcagcagtcttctgagggatgggccatgaccatttctgaagatccagggtgaaaaccgtcagccacccagccttgactatcagacaccatgccaagcactttgcatgcactgccccacttattccatgggcaactctgtgagaaaggtactgctgttcccacacacaggtgaggaagctgaggattccacaggctcccacacttgagaagccttggagccaagacaaaagtgcagccacacaggccttattacatgtcaaggagtttaagttttgttttaagaaaactgaaaagtgcatgggcagctttgagcaggaacgtgatactgtcatgttttagaaagaaagttctgtctacagtatggaaaataaactgaaaaaaggatatgactggagacagagagaccagtcacaagactaagagaaagatgatggaggtcaaaactagatcatggcagtggggatggagagaagtagacagtttggagcaagagaagaggttaacaggacttggtggctgactggtgaatgagataaggaaaaggtttgaagaggagcagagcattgctccaaactatgccactgtggcaaattggttattttgagctgaaggcaatggagaaatggcagatacaggaagtgctgtctgccctccccttttctacctaaaagcagtatgtaaatttcccctgagaaaggtgctctcattctactaggaagaggagaacatgcttatcaccagggatggggagtcaatgccaagatgagtctgtacaaaccttattaaaattgcccttctcttccatcagtttccccgatatgtttcctagtcactttcccatcccccttccagcccaaacccctttttcctttgtcatgtctccacaatgtattgttctttgttaaaatggtatataattctcaaatctaactgctttagagttttcacttttttctgtgaagtcctccatgccacatagaaatattaacatcagataaaaatctatattttttcctattaatattttttccctgttaatctgtccgcaaaggttatttaggcctgcagagcatccaagtgaggctatctagtggacagttgaaagtgtgggtctgatgctacaaatagaagcctaacgtggagatgtgtttggacatcacaaatatctagatggagtaggtgaattatgaactctcccaaggaaaggcc

SEQ ID NO: 15357 - DNA, 32202 bp, Human
aggcgggcagatcgggaggtcaggagatcgaggccatcctggctaacacggtgaaaccccgtctctactaaaaatacaaaaaaaaaaaaaaattatccaggcttggtggcgggcgcctgtagtcccagctacttgggaggctgaggcaggagaatggcgtgaacccaggaggtggagcttgcagtgagccaagatcgcaccactgcactccagcctgggcgacagagcaagactccgtctcaaaaaaaaaaaaaaaaggtggcaagtttttataaaaagagaaaaatcattcttagtatttctttaataccctctacattgacctcactggtgcaaaaaatattagtttgctggtgaaaattcacctcgagttactaaatatctaactttcccataactaccatctgtttgtctcttgtggatctgtttgcctaatatttaaatgacccattcttccccacttttacgaaaatagcattaattcccctttcactattcacacttccttcatcgtcacagtttgaccagcggtccagggtttatgatctcaagcatggccatatatatctatttcacttaagactctggaaagagcataaaatcagatgtaactgtttcctatttcatataatagggaattccatctctaaagttatgacatttggcctttcagtgggtttttgtggtttttactatggctgtgcttagattcctttttgaacacttttccagtggttccacttgaacacaatctttgagtcacataggagaggtgacatgatagagtgtaaagccagaaagagcacgatttggatctcagctcaactgatagggatccgtagcaagatacttcacctctctgagcctcagtttcctcatctgtgcaatgggaatcgtaacgcctgcctctcaatgttgttaagattaaatatgttggccgggcgcagtggcttacgcctgtaatcccagcactttgggaggccgaggagggcagaccacctgaggccaggagttcgagaccaacatggtgaaacccctgtctctactaaaaatacaaaaattagccaggcgtgctggtgcaagcctgtaatcccagaaactcaggaggctgagatatgagaatcgcttgaacccaggaggcggaggttgcagtgcgccaagatcgcaccactgcactccagcctgggcaacagagtgaaactctgtctcaaaaaaaaaaaaaagattaaatatgtgtacagtacctgtaccatgttaggcggtcagtaaacatttgtttaactaacaactgataaggatagtaaagaagtatcagaacacccacctagttatcccaaagggcaggaagagtgctaggtaatggatatagaattccttttagagtcaaattacacgggcaaagatcagcccctccttcaattaaaaagccaggggcagggcgtaataaggaagtggttctccttctttaagcctcttttcaggctgagtcctaaacctgaagaaagtttagagcctggggctctaaactacctgagtctttccaaacgacaagccaagaagacctgttgaaagtttcctcttaagtttcgtggagagagactcaggtatagaaatatccttactgccacctgacctgaagcagaagaaatcacagacagcttccagaccaggtaacaccaggaggcaccagtcttcatcctcagcctttgcaggaggacacagcctggtctttagctgtttgccaaatgaggcagtctaattcagggagctctttactgggtttattacaaagttcttatcatgtaagtctcaggacacaaaatgacattgagaatctagtttagcggggtttccaggaaagacgaagaaaggttatttaggtttctctttcatttctcttttgctacaaagggtttgggacattcagttaagaacacattactggttgaggtatgtgacgttactcagtcttctctgcttatgtatctggggaggtatgcaatgacatgacagccattccgtggccagggacaccactgcccaagctggagaccacgaggattcagggactgaagccagcatgggaattcctggtttgagatcagagtcctgagtacctcgtgggaacttgggcactcatccgcaggaggtctagacccccagagaattccttgagtctaaggcacaggtaaatggaagacccttctctctcctctctcccctctagaaagctccctcctccctgagctccctgtccccttctttccacaatcagagcctcggaccttctgtttggtgaatatgacctgaggctctgtctagcattcagcttctattgtgggaagttaaggcactttctctcattcctcatttcacctttagtattaaagaacagtccaggcagaaggcaggaagagcctgagaggtctgaagtgagggggagaggagaggggcagaaggggaggctccggacaacagaaccaagctgagcttaggatgtgctgtgggaggctccgtggggatgagtgtcagtgcccacgagatccactcaggcctcaactgtgtgtcctgagcacatgaagtcagctcttctgctgggacagccaccaagggattctccacacccctcaccgctgggacaggcagaggcacagcgaaccaggtgtccagcgtaactggggcactgggtggtggccgcctctgtgtgtggaaacacgaggtgcttgctgcagtttcctctgtgtgcttatccgttagctgccacccaccgggagggaagtgaaatctcacctcaacaagtgagtccgcagagcgagaaccgtgcgacagtgcgtctgccaatacctggaatgtaggtgttcgttgcagtgtggccttcccagccggcctctcagcacacccggccaggcagccagtgttcccagaggacacgctggggccagacgtggaggaccccggccacctcggggagggaaagagaccaagaaaagaacctctgtagccttgcttctgagagtgcaggtttgttacaggtaaggatcaggaaggtaaacatagggcagtgaagcagggttgtgtcctctgcggccctgaattagaataagcctcacaggtctcacccaggaacggaaatctcccctccaggttctgaaccagcattcaggggccccacccagggcttctgtcaacataagcataaaacttatggtttacctttccataaaccccaaagttgggcttcttgtatagagtacaatttctgtaggaagagctgaaagcagaagggatctaacctgtgataatactcgatcgctgctgcttgaaagtaagacttagctatacactgaacaatcaagtaatttataacaaggattagaggaaacaaaaactctgtgtttgtgtgggtgggttttttttttctttatttttgtttcttaagagagtgtctccctctgccacccaggctggagtgcactggcgcgatcatagctcactgcagcctccaactcccaggctcaagcgattctcccccctcagcctcccaagtggctgggactgcaggtgcacaccaccacgcccagctaatttttttcattttttgtagagacggagccaaggctggtcttgaactcctgggcttaagcgatcctgctccctgggcctcccaaagtgctgggattacaggcgtgagccactgggtccggcatctacatttgttaaatacattaaaaccctcttaatcctttgtctccgtttgttctcttttgctccctgctctccaggctcttgtggcggaggcccccgctccctccgctgtagggtagcctccttctggggctggctcctgagcactgttctttctcctctctctcatcctctctcattcttagctttgcctgtcgactgggccaagtcacagcctttctggcctgtaagacaacaaaaatctcacattttactaaatggaaggactaagtactctgtcttgacttcagtggtttccccgatttctgatgttgctgctgaaatagcattagcaagcttgtttcttaaagaagccctctctccagtgacaatactccccccgccacacacacacacatgcacacgcacacacaaacatgcatgcacgcgcacacacacacacaattttaaagccctcgtgttatattaaaaaggtctggatgtttttaacatacatggaaatttcttcagcagcacagtgttactggtctgacgagggcgcacagcctcctacccaaggacacagttcctgaaggaccagggtgcacatctggcctgcagtgccctgagccactctgtccaaaaggaagccttgaatcaaaagcctcatgaatcctctcctgagaaattccatgtctggtctcttgctagactcagccttttccccaccaagtctgccgcacctaattctgacctcaccctgcttggtggcccgctttgcctgcttgcacgcacctcaggtctcagtgtgtctcagcaacagcttcccctcctagggtggccagagttagcaagcaagaatgcaagacagccagttatgtttgaatttcagataaataacaaatataagtgtcttttagcatataatattttatttgggacatatactaatatttattatatattagtctcatgatatttgggacatatactaaaaaattatttgccctttatctgaacttcaaatgtgaccgaatgtgtcctgtattctgaatgtgtctggcagtcctataatcattcattcagtcagtcatcagatatttgagcacctaccatgtatcaagcactattctagagagcccggatagctcagtcagtagagcatcaagcgctactctaggtgctggggaagccagccaaagtcccgccttcatatcttacagtatgtctactttgtttttatatacatgtacactatatatacttgaagatatgtacctttttctttttttctttttattatttttttttgagacggagtctgactctattactcagtgcagtggcaccatctcagctcactgcaacttctacctcctgggttcaagtgattctccagcctcagcctcccaagtagctaggattacaggcatgtgccaccatacctggctaatttttgtatttttagtagagacaaagtttcaccatgttggccaggcttgtcttgaactcctgacctcaagtgatctgcccacctcggcctcccaaagtgctaggattacaggcgtgagccaccgcgcccagcccagatatgtactttttaatggcaatgttaccacatttaatgagattatctttttaaaaaatgttttaatttttaaattttaaaaaatagggatgggatcttactttgttgcctagactggtctccaaatccaggtctcaagtgatcctcccaccttggcctcctaaggtggtgggattacaggtgtgagccacggtgccagccaagatgatcaatacttccttaatatcatctaaaacatacactgtgtttagttctctatcatctcaaagatatctacatctttatacagtatgtttgaattacgatttaataaagatccactcatgacatctaattgatgtctctttttttttaatatgtttcttttttttctttttatttatttatttatttttgagacagagtctccgtgtgtcacccaggctggagtgcaatggcgcgatccccgctcactgcaacctttgcctcccaggttcaagtgattctcctgttgcagtctcccaactcactggaattacaggcacctgccatcatgcccagctaatttttgtattttttttagagacagggtttcaccacgttggccaggctgctcttgaactcctgcctcccaaagtgctgggattacaggcgtgaacgattgtgccctgcctgatatgtttctattctttctttctttctttctttcttttttgagacggagtttcgctgttgttgcccaggctggatgcaatggcgtgatctcggctcactgcaacctccgcctcctgggttcaagtgattctcctgcctcagcctcccgagtagctgggattgcaggcatgtgccaccatgcctggctaattttgtatttttagtagagacggggtttctccatgttggtcaggctggtctcaaactcccgacctctggtgaactacccgccttggcctcccaaagtgctaggattacaggcgtgagccatcgtcccctgccggatatgtttcttatgtctcttttaagctgtagcagttctctgtcttcacctttttttggcgccatttatttgttgaagaaaccggccatttgtcttgcagaacttaccacatactgaatttggatagctgccttcttgtggtcattagtttatttctctgtcccctgtatttcctgtaaactgatcattagatccagaggcttgatcagattcggatccaatgttttcggatcaggagacacataatggttgtctcacctttagtgagaccaagattggtcattgggaacagggaagtggagctggggtgagtatagggtcaccagatgtccagtacaagcagaatggacagggctgtgctgcaggatggatgaggggagggtgggatgcccggaaaatgcatgggggagggtgggatgcccggaaaatgcatgggggagggtgggatgcccggaaaatgcatgggggagggtgggattggatggaattggggagcgggaaggggtaagtggaaaagcagtaaggaacatgaccttcgaggagacactgacgtgactccttacagagcaaacgatttgcatgtaagtgaaatgcatgtaagtgaatgtgaaattggagcagtggcgggaagaaagattgtccaagccctggaataagacaggaatgtgaagaaacagcagaggaggaggaaggattgcagtcatgacccccacttcatgccatactcctcaagcatttgcttacatccagttatgtgagggaggtttgcggggcttggaagttgtataattgtatctgtgtagttggtctggtgggttttgcaacttgccctttgctgcactgggagggccatttttgtcccctccagcatcacctgatgttgcagcatagcccgctgcatccctcccaggctcacttccatcagaacgcacctagccagggacccttgctttcctggggcctggccaaggagcagttcctcagatcaacagcttcgctatcagccaatgtgagcctcttctaagtaaaggagaggagacagtgatggaaaaaggcagcatccagcaggccctcaggggagatatttcagctcctacacctccttccaatagcagaaccagggggaaaagttagagaatatccttattctatctaacaacttggacaccgaggaacaaaaaggtggcgtgacttgcccaaggatgttgcaggttagaagctgagccagccgtggctatccatccttcagacacccaggccaatttgtctgtaccacctcacattgcctcaaaccctgtctgcagttactgtcccatttctttatcatttggtcctggtatgacaaggtacagtggaaagaaaaagaggaacatgccagccagtccccttaatattactgcagcttctttatcatcacagcagcttacatgccgaaagaccgtcttaaattaggaccagaaagggaagggaacattattaagagccatattaagacagagcctgaggccgggcatggtagctcatggctgtaatctcagcactttgggaggctgaggcaggtggatcacttgagcccaggagtttcgcaccagactgggcaacatagcgagaccttgtctctaaaagacaaaacaaaaaaattagccaggtgtggtggcatgtgcctgtgttcccagctacttgaggggctgaggtgagagaatcccttgagccggggaggttgaggctgtggtgagctatgatctgcactccagcctgggcaacagagcaaaactgagtctcaaaaaaaaaaaaaaaaagagagcctggggcctaggacaacagctgaactagaaaaaaaacatagctaccacttttgaaccaggttctgtgcaggaacttctcttgtgtatcttacacccttacaatatccctgcaagatgactattattatttacaatttgcctgcaggaagttcatgtttggagagatggagtaacctgccacaggtcacaaaactagtcactggcatggccacaatctgaatttgggactgttagactgagaagcccaagctaattcttgatacgctcactgcctgggacatttcacacggtagatctgagctttctcgcatctgagactaaaaggaaaatgtagtccttaacagacagcagaaggaaacagattattagcaaaaagaactgctttcctagcaggaaaccagagaaggagttatttcatgtaagctcaagcaaaggaaattgaacaaaatcagttctttatctatcctgttattcgtatggaaataaagaagaaatgcttgcatcctgttgttttagtgcttgtactgatctttttcaaacatgcctgtgatcacatcactctctactcaaaactttgaacagctctccattgcctccatcagtgtgtttcaaattcgtaaaaagtaaaataaaataacaggatgcttttttcagatgaaatcttacatggcataccaaatatagcaagaaaaaagaaagacagagagagaggagagagaagccgggacaagctaaagcagagggtagagggagaaggaaccgaggaagggaagggtcaggtcccaggcatttctcttccctgaattggcctccctcttttgccacctccccagcaagacctttaactccacagtccacagctcattttgaaatgtactgatcaacgtgagaaaatgcgaagcttcagcctgatagtcaaagaccaccataatctggacccaagtgctagttcacttattttccctccactattttcaagccctggctatttgcaaactgcatacgtatgctgtcccagttctctcaccactcttcaaacacattctgaattcacctataatctcccctctgcccgccctgttgtagccccaatatccacccacctgtctaactccttctagctttccaaaagctttcacttgcctctttctttgaagctcacctatccctgccttctaacctggctatctgcatctctgttagacctcttacttagttcattagttcattctctctcttttgttttttgttttttgttttttgagacggagtctcactctgtcgccaggctggagtgcggtggcgcaatctcagctcactacaacccccgactcctgggttcaagcgattcttctgccgcagcctcccaagtagccgggtctacaggcgtgcgccaccatgcctggctaatttttgtatctttagtagagacggggtttcactgtataggccaggctggtcttgaactcctgacctcatgatctgcccgccttggcctcccaaagttttgggattacaggcgtgagccaccgcacccggcagttcattttctttatgtggagttatctatggccatgtctctcttcccaccctagtaagactgtggcttttccctctctaccctccagcacaaacacaatagatgttcaataaatgtttcctgagttttcacccctgtctctcctaacctgcaaagggtaagtggccctgcatagaagggcacagtgtggactttgttgttacaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaaggtaggcatctgggatttctttctctcccgcttcctggtttttcccttctttgtgtccagagtggtacatctcttctcatgttgtaaagtggctttagagaaggcatgcgttgtgcctcagctttccaacttattagtgttcaatcataattgccctgcttttctcaagactaaaaggagttgctgcctgggcgcggtggctcacgcctgtaatcccagcactctgggaggccaaggcgggcggatcatgaggtcaggagattgagaccatcctggctaacacggtaaaaccccgtctccactaaaaaatacaaaaaattagccgggcgtgttggcgggtgcctgtagtcccagctactcgggaggctgaggcaggagaatggcgtgaacccagcaggcggagcttgcagtgagccaagatggcatcactgcactccagcttgggtgacagagtgagactccgtcaaaaaaaaaaaaatgactaaaaggaaatgatggaagttaagggtgctgggactggttttctttctccactgtctataaataagcttgtttcccaaattcctagtcctctgtaccagacaccaatataaaagaaggaggctaggcgcagtggctcatgcctgtaattccagcactttggaaggttgaggtgggcagatcataaggtcaggagttcaagactagcctggccaacatagtgaaaacccgtctctactaaagatacaaaaaattagccgggcatggtggcgcatgcttgtattcccagctactcgggaggctggggcaagagaatcgcttgaacctgggaggcggaggttgcagtgagccgagattgcatcactgcactccagcctgagctacagggtaagactttgtctcaaaaaaaaaaaaaaaaaagaacgagccctaaccaggggcttgcttgggctgcctgggccgctgctcttcctaagtcaactcattcgctcagggcctctgtgtttccatctgtacattgggtaccccactctctccacctcgtatggttgatgggaagatcagagagcaagagtaaaaggactcttgacaaagtacaaaccatcctacaaaaacaactgagaagcatttagacaaaatcttccctcagttggacaaaattaattgtacttaatgaaacattttcaccaggcactgaggctcatacctgtaatcccagcactttgggaggccaaggtgggtggatcggttgagctcaggagttcaagaccagccttagcaacatggcaaaaccctgtctctaccaaaaaatacaaaaaaattagtcagacatggtggtgcacgcctgtggtcctggctactcgggaggctgaggtgggaggatggcttgagcctgggaagtagaggttgcagtgagccaagatgatgccactgcactccagcctgggtgacagagtgagagcccatcacgtcgatactctcagcactgtgggaaaccaaggcaggaggatcacttgacaccaagagtttgagatcagcctggcatcatagcaagaccctgtctccattaaaaaattaaaataaaaaaattagcgaggcatggtggcacatgcctgttgtcccagctactatggaggctgaggtggaaggatcacttgagctcaggaggtcaaggctgcagtgagcgaagatcacatcactgcaccccagctctgggtgacataatgagactctgtctccaaaaaaaaaaaaaaaaagacagttgcccttcatgcgcacaccttggcataagcatcttcttccccttcaacaaagcccagtgcccaaagcccagattttttttttttttttaaggtgttttagatggagtcttgctctgtcgcccaggctggagtgctgtggtgtaatctcggctcactgcaagctccgcctcccaggttcaagcaattctcctgcctcagcctcctgagtagctgggatcacaggcgcgcaccaccaggcctggctaatttttgtatttttagtagagacagcgtttcaccatgttggtcaggctggcctcgaactcctgacctcgtgatctgcccaccttgggctcccgaagtgctgggattacaagtgtgagccactgcacccagccgcaaagccagattttaaaagaaaggccccctcctgctgagtttcattggcctgggtaacttgtcaataattagtcaagaggtggcagtaatgtctcagtttttaaatgtgacagtcctggcttgcttggagaatcagcccactcatagacagctttagatcactcactatgatcaaggaaactcccatttcccattagagtttcagatgtttagaacagtgggagttatggtcaggatcatctgagggaacctcatggcacagacaggatgaggaaatgggagtcccacaaaaagggcttaccaaggaaacatccaggaagtagcagagcctggactcaccagaagtccaggcctctccctagacttgtttcatttttacagcaaggcatctgctctctgaactctgcccagctaaggcaggtctagagcaagagggagcggccccctgtggtccttccctccacatctgcctccccacccctcagctgccctcacccagccatggcttcttctgccgggggtggcatctgggctctggggcaaagaacagtttggaggcacctaaataggcttttctacttggcctgtactgtggactttgccagcagacagagaaagcttttacagaccttagtcttctggtttttcctgagataaattgcattctgtatttcagtatttactggagtgtcatttgacattttttttattttctaaaatttcaagagaagcttttatttcttttttcagtagggaaagaaaacttttatgtgagattgagaattaaagattacattcaaaaacacttaggtgatgtgttaatgtgctgaatagctgaatagtacctatggctgaataatattctccataaaaaatgaaaaatgattacctcctaagaaggctttaaacacatatttacagcttatcttcccttatcacctttctcctcacgcttgcatttagtcagttaattgtgtgttttttacttgtgttacttgtgtcggttttacattgagcgtgatccaagagagcctcacattctatttctattttgccacatacaaatcaggccttgcaaatttggtttctcctgggttcttttttgtttgtttgtttgttgtttttgagacagagtcttgctctgtcacccaggctggagtgcagtggcctgatctcggctcactgcaacctctgcctcctgggttcacaccattctcctgcctcagcctcccgagtagctgggactacgggcgcccaccaccacgcccggctaattttttgtatttttagtagagacagggtttcaccgtgttagccaggatggtctcgatctcctggcctcgtgatctgtccgcctcagcctcccaaagtgctgggattacaggcgtgagccaccgtgcctggcctcacctgggttattttaactgtaagtcactatgtagccttgtacagccactgccaggcctcagtaccgggcttacatgggaactgtgagattatgtcccaagaccaaactctgttaggaagaggcctcaggatgcagagaaatggacaataacaccagttttaaagactaccaacccaggctctttcacttgtgaatcttttgtttctccatagctacgatttgctcacgtggaatgttatagttaaggtgaggttcagcgatatacagtggaacactcaaatacccatggcttaaataatatacaggtttgcttttctctcctttaaaagaggacaaaagtttggcagctcaggcatgatatgacagctccacaaagttattaagaatttctgggaatggccaggcagggtggctcatgcctataatcccagccctttgggagtctgaggtgggcagatcacttgagccaaagagtttgagaccagcctgagcaacatgacaaaaccccgtctctattaaaaaaaatacaaaaattagccaggcgccatggtgcgcgcctgcagtctcagctactcgagaggctgaaggaggagaatcacttgagcctgggaggcgcaggttgcactgagctgagatcacaccattgcactccagcttggatgacggggtgaaaaaaagaattcctgggaattctgccatccctcagctcgtggcttccacctcaaagtcaccttatattctaaaggtggctgttggggcttcacccatcatgtctacatctcaggcaagaataaaaaggaagcaaaggaagggcaaagggtgccttctttctaggtaattcagctcccttttattttattattattttttaatcttttgtaaagatggggtctgtgttacccaggctggtctcgaactcctggcctaaaatgatggccttgccttggcctcccaaaatgctgggattacgggcgtgagccaccgcacccagccttagctcccttttcgagagctttcttgaaactgcccccagcttctgacatctcattggcccttccctactgcaagggagcccagggaatatagtttgttcagctgggttcattgctgcccctcacattttagaggtctgttactaaggaagaagaagaaagtggatactgagtgggaaagagcagtccataaggaagtcacaccccaaccccctgccctttctctttaaaacaaatgcctcagaccacaggcgaaatgggaccttccgaccctgttggcctgctcttcctggcgccacgatgacccccaaaacagactccaaggaacagacagcctttctgtcttctccccaccccatccagtgttccctcgcctatcagacaggaccaagtctgacaaggatataatcttttctttttcatgttttaaaattaaaatatccaagatgggaattttaactagagctagtgcatctgtgggaacatgtttgcttatagtttctcctggacatgtctcactccatgtccacaaacccacagaaatcaataccctgctgtaaccccagcactttgggaggctgaggcaggaggatcacctgaggtcaagagttcaagaccagcctggccaacatggcaaaaccctgtctctactgaaaatatacaaaaattagctggacgtagtggcgggagccactacgtcctgtaatcccagctacacaggaggctgaggcagagagaatggcttgaacccagaaggtggaggttgcagcgagccgagatcgtgccattgcactccagcctgggcaacagagcgagactccgtctcaaaaaaaaaaaaaaaaaaaaagtcaataccctgtacacagttagccagattgagtaattttgtacctgttggtgatcttgtggccaccctgccttatgagaggaggaggggacagagcctttgggacccttcatggagcttcttaatgtgcaagatgggcacagggtgctttctggtggtagaaccgcatgctgattaccctagatgagctgcacaaggttgaaaaggcagcagaggcctgctttcctttctcatctcctgaggacatggccagggaagtttcccttggctttggaagatagcctcttgccatttctttctttgccaggggccatgggtggccagagttccagcggaggccggctgggctgcaataaggggattacaaagtggaaagtctgtttcgcttggttcttaaaaaacgaggaggaaagacattgatccttttcttcttgatctttcttctctccgtcattcgcttcttattggtttttgaaccctgtggactaaccatggaaaagatggctttatgagtcagatgtccaccagaggatggcatcatggacagagcagtatcttctgtggcctttccgtgaatggctggagggctgaagggaggacactgaagccttcagcttggaggaatccagggagagggatcaggagccacctttgcagctgcatatgatgtcaaaacctgtttctcttgtggctcagtccctcccaggccccctacttgcctctcttacctccagtgctgtacaaagcccagaagtgccctaggagtttgagcacaccaaccttctgtccaaaacgccactccattactgtcttcaagtcctgtgaattacctaatgttagtcttcaaatgttacatggtaaaacccagctgctccacacggcatccaagacagcttgtacaagcttttaaaagtttaggatttaggttgggtgtggtggtggctcatccttgtaatcctagcactttgggaggctgatgtgggaggattgcttgcgcttaggagttcaagaacaacctgggcaacatagggagaccttatctctagaaaaagaattttaataaattagccaggcgtggtgatgcacacctgtcatcccagctactcaggaggctgaggtgggacaatcgcttgagcctgagagatccaagctgcagtgagctgtgatcacaccactgcactccagcctgggtgacagagtgagactctgtctggaaaaaagtaaataaacaaataaaaggttagaacttagtgacaaatcaacagtgaaaattttaccacccagcaactcagccatgccatctgcccaccccacctcccctcttccccactcaggggcaaaggcgactggtctcttataggctacaacactcactgggccaatgccatttcaccgtcctatctcaaagtgctttattctacaattctgtatgcaaatacatgacgtaactcttttctcagcttgtaaattcttgaaggccgtaagttgtgctgactgcatccttgtttacctataagcattcattgaatgttttccagtagacatggagaggagagaagaggcagaactgtaccagcaacgggagttaggtgttcacttgataatggacttggatgatgaatctcattgccctgagagcagggatatttctttcttcagtgaccaaccccgaaatgcttgtcaaattatcgaatgtcctcctatgcatgtaggggctggctcttagaggtataaagcatgtcgagaaaaaagaataaaaataaaagcataatgagcattccttcaagtaaagagctaagcactcctttttgtgtctcttcccttgcaaaggggaaaggagaccctaattttgcaagacttcaaaaagagtgtgcagaaggccaattgtttcaaggtgacaatcattcctgcatgcacccctcccacatcccggcctctgccaggcaactttcagtcctttctgaagaatgaccctcccccagcacacatactcccaggcagtttccttctattctggcctggtcttttcattccaggcaactttgcataccaatgagccagatgaagttctgggaagggcctctcagcaccattttgtcttgtttcagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaaggtaagctttccttccctgggtggagtgtttgccaggcaggggcgcaggagcatttgtgtatttatccatcccagggctcggcaacttgacagtctccgctgcctggactgagggcttgacagccacaggctgtgggcaatgagctccagcttgagacaccagcccaaggcaagggggctgccccagcaggttgaaaaaacattcccagctctctgctaagtaagaaaggaaagtctcctacagagggagaggaggaaacacaaagcccgcattcagccttgtctgtggcggaaaatgcaatgttagatctgatcatgttaccagtgaccctgggccaatttgcaccaggtacagttggagcgtcaagccagggatttatattataacattgctttagggctttgtgaaaaagcaggggttgtcaggcaccagctatggtgcaagacatggagcagaactgagaagtagtgacaaggctgggtcagttgtcacccaaaccatagcaatagctgagactgtagatcccatcaggctggtggtaactcaaggcactgaggggagagtcaaggggagcaaagccaagtgccactggaagagaagctctgcccggcattcccccaccacagttcttgctcctggctccctccacaaactacagtggaggttgtgatgacgcagcctcattgtctgggataaatacgtgaggttcgttgtctcatgccaagggaatcgaggacatggacacacacaagaagtgagtttagcggcagaggtttaataggcaaaacaaagagaaaggagaacagctctctctcctgcgacagagaggggaacccaaatgtgacttctggcctgcgacagagtgcaccggattttatagacaggtttgaggaggtggtgtctgatttacataggatccaaagatcagttgaaccaggtgtgacgtttacatagcatgggggaagctggccaccccaccctcatcttattacgcaagtgggctttccacttgcccagcgccatgttgtctgctccctagggcacacgtggttggaaaggaaaagggaaaatgcggccgccatgttggacatgcctagtcccaggtggccttttcctattggcacagctgccaacattcactgtgcaagcttttagcttgcttgtctatgtctgcagctcaattttacaggctactctttgttagaaaagaaaatgatttggggctgcttttcattaaaaggaaaaccttcccgagaacttccttaccctcactatctgcctaaatcatttctttttaactcctctaacagtgaggccaaggtggatcttgggtttgcacctccctaaagaacaaggtgaaggttctccctccaaaggtatccgtgtctcccaaccccgatgcagagcggtagccacactaaaggggccacagctgccacagaggctcaggggaccgtgtgaagagctggaggagaggaggaggcctctgagtctgctaaaaaaaaaacagtgtgacattttattactatcccacatgggcttgggagatggaatgccacccctaaaccaagctaaagctaagatgacctcatcctctgtgcacaggagaaatacaggcagctgtgccagcaactttctctaagagagtgttaacccaatatatcgagacagatcttactcagtgtagaacttttattttggccgggagcggtggctcgtgcctgtaatcccagcactttgggaggccaaggcaggtggatcgcctgaggtcaggcgttcaagaccagcctggccaacatggtgaaaccccttctctactaaaaatacaaaaaaattagccaggcatagtggcaggtgcctatgatcccaactactggggaggctgaggcaggagaatcgcttcaactggggaggctgaggttgcagtgagccaagattacgccattgcactccagcctgggtgacaagagtgaaactccatctcaataaaaaaaaaaaaaagtagaagaagaaggtttattttgccaagcctgggcacggtggcttacgtctgtaatcccagcacttcgagaggccgaggcggacggatctcttgaggccagaagttcaagaccagcctggccaacatagcaaaaccctatctctactaaaaatacaaaaaaattagccgggtgtggtggcacacacctgtagtcccagctactcgggaggctgaggcaggagaatcacttgaacctgggaggtggaggttgcagtgagccaagatcgtgccactgcactccagcctgggtgacagagcaagactcacatactccactgcaccctgtccccccaacacacaccatacaccaaccgtggccacgttcctatccatctgcccttttagccttggccataggggaatttattaattttacttatttatatcccaccttattgtcaagacccagcatacaaagaataaattttagtcagataaaatccatcaatttgaaagatatctttgtaaaaagaaaacaaaaacaggaaaataagacggatttgggaattaggttaatttccaaaatgtaggccagcaagactatccactctcttagacatgggccacaaatttggctctatactttctagcaactaacccaaagagtgaaatataatcaaatatgagatttatggtgtccataagataaaagcaccatctgctgaggaaaaatccaaaaaccagaagaatattccccctaaatatcttcatagacagaatcctgtgctgtgaaaccgatgtcttcaacaacaagcttaaggtaactacagcgatgaatttcacagtgagagctgggggactgagcaaaggaagaaggggaaagaaggaaaggaaggggctgtaggagaaatccctagtatggtttgtgtctgggcagaagaggcgaggtaagatttacttgataagaatgaacatgcttcttgccaggcacagtggctcatgcctgtaattccagcactttgggaggccgaagtgggtggaccacctgaggtcaggagtttgagaccagcctggctaacatggtgaaacctgggtttctagtaaaaatacaaaaaaattagccaggcgtggtggcacacgcctgtaatcccagctacttgggagactgaggcatgagaatctcttgaacctgggaggcagaggttgcagtgaggcaagatcgcaccattgcactacagcttgggcaacaagagcaaaactctgtctaaaaaataaaaaataaaaaaaaaaaaaagaattagcatgcctcttcctccagcccttaccaagccacaagcattcattgtccctggaaaaatgtaagattattttttgcttctcttaaaagaaataactggaattttccccgacagatgaagaagaacaaatactagccaaaattgttgagctgctgaaatattcaggagatcagttggaaagaaaggtatggaacaccttgaactgatgcgattgatttctgtgcccatgcactagtacacgagaatggaattgtattccaggttgcaaccttattccctttctaagtcctggtttctacttagtcctaaattttatttcccttggagtcaaaattcttcatgctggtagaatctcaaaaatgagtcactttggaaaacataagtaaaccttctggagcctccttggaatttttggaaactaaaaaagaaacttgttattgcaagaaaagacaccagtaaattaaaatttgctggatggaattattaatctcattccccatgtaactgatcctcattgaagtttagactcgcatttgctttgcagcctggatatctgtgtcccacagttgctccaaagctggaatactttctggaatctttttcccctgtagttgctggactgtggcctgtttaagggctctcttagcagttcagccagggaggtgcgctagtgttactgggagaatgtatggatttcctgccatttggaagttgagacccatctttccaatcaggaacgggtgagagttgccttcaggtaaagagttggtgagcaaaccttcaacagagtcaaaagggcttctctatgcctcctgggtccataacccacagacgactgagtagtctctagaatctgtcaatcaggggctggcttgcagacatagacccttgttttgccagaatctgtggggagggagtcagaccctgggggtggggatgggaggttctgcaggaagacaaacagctcctgtctatagctttgtcaaaagtgtgcccagaggctggtgacccagagggcgaagcacctgggagatgggacagaatgagaaacagcgagaaaaccagggatattaggttaaagaaaagagaacggggtgtgtgagctttgggaccacaagtagagggtggagaggggtgcagaggaagcaagagatggaacaggatcatgatttaagggcacccctgcatttctccagagctagtgtcatggatacacaaattatgcctagtatggggtgattgatttctccttatggtaagaatgaacctccattcctggagaataggcactccaggctgcccatgagagtcaacgggtgccttgtgagagaatgatcttcctgtcacgggaagaattgcaagtaggtgccaataccagttagcatttcagcacagaactccgaggggtcctttagacaacctcaagggctctttacaactcagagtttctgtggctctcacggcaacctccttcccagcttccctaagcagggacttgtggtcattggtcagggaggtgggaaaggcggagtgggggtgctggaggtgggacgaaggccaccgatctcaggttatgaagagcgatggtttcattttcacccccacaaattaccactttcaaaaacctcactttgcctggtgctctctcttaaggagtttggacattttacattgcttatggcaaagccttggttgttatttcctttacatgcttccccagtagggagctctgctagagacacatggtaggtgtgaccttgtgctgggcgggtgccaagctcccactgcagagtgccgtgtgtgtggctgcaggggatctgcagagccgctggtcccaagagcacacacagcccgaaggcccatcctacacctccaggagaggccaaagagccaggtgcacccgagagggacaggcaggggaggggtgaggaggtgccagtggaagccctgtctttgtggcgtttgattcttttactgttctggcacagtccccacttggctgcctgctagggttttgagcctggcctcctccattgggaaactgatgaagaggagtctgttccctgttatggaggaggctggccatgcctcctgcagagtcacaacccagacggggcctggacggtgggggtgggcgtggttcagggaaaagacaggtctgccaaaatctcccaatcgcatctgactcatcccccagatatcccttttagaaacaatatttgttgaaaacccgcttggcttatcattcctctaggacagaactagaggattttcaaataaatattttgtccctgctcactcagaaatttccgttttcacatgacaagcagcatattaacagacattgcaagaatgctttaaatgaagatgatatatagctttttgatatgagccctgatttttcaaaagcagaagaggcagcattgattttgttttaaaggcgtggtagttcaaaggaggtaaagcagagagataccaggttcaagggaaggccgggaggtaaaatcaatagggtagaataatgggaaagaaatcaatgaattggagtttttttaagtgaacattgcatgcaagggagtcttccctgacctccatgctcccgtagcatcctgaaaaatgactcgcatttccaaagcacctcttctatgtccagcactataaagtgttcaactaccctatagtatagggccaagcacagtggctcacacttgtaatcccagctcctggggaggccgaggtgggaggatcgcttgaggccaggagtttgagaccagcctgggcaatatagtaagccttgtccctaaaaaacaataataataaaagtttcttaagaaaatgaaggctgggtacgggcacagtggcccacacctgtaatcccagcactttgggaggccgaggcaggtggatcacctaaggttaggagttcaagaccagccttaccaacatgatgaaaccctgtctctactaaaaatacaaaaattagccgggtgtggtggtgtgtgccagtaatcccagctacttgggaggctgagacaggagagttgcttgaacctgggaggcggaggttgcagtgagctgagatcgcgcctctgcactccagtctgggcaagagagtgagactccatctcagaaaaaaaaaaaaaaagaaagaaagaaaagaaaagaaaatgaagactgggtgcagggactcatgcctgtaatcccaacactttggggaggctgaggtgggtggatcgcttaagcccaggagtgggcaacatggcgaaactctatctctacaaaaaaatagaaaaaaattagccaggtgtggtggcatgcacctgtagtcccatctacttgggaggctgaggcaagagaatcacttgagcccaggaggcagaggttgcagtgagctgagaccacaccactgcactccagcctgggcaatgggagtgaaaccctgtcttaaaaaaaaaaaaaaagaaagaaaacaattaccctatagtatcaatactatcaccatcctagtttagagatgacaaactgaatctgagaggttaatttccccaagattgcatagctaagtaagaggtggacccaggggtttgagccaagacagtgattcctaagcttcagatcctgtcccttacactacttctagcaaaggacatcacatttttctgcaattcccactagactgtgagccctttgagtgaggacccgcatctcagtcatccatactacctgcccattataagtgctcaggaaatatttgttaaatgtcaagtgaactgactgttccattttatacatgtatttgtgctgatgaaatgaattcaccgagcagtacatgcccattctggttctgcaggacactgccttcatccccattcccttggttgacaccagcatccagggttttccacaggatggtttgatggcctgcatttgagctaaagaatgaacttctgtctgcctcgtggagccaagctactgtactgagtgcttattcttttgtacacagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggtaagcgtatcctatttaaaaacaaattttctcagaactcagaagagatgggatggattttttttttttttttaaatgaagggaacacatctatgaagcagttctcatgagtttaggacacttgagtggccagagatagatcccattgatgggaacatatttttagtgattatcttcatcatcaataaatatttactgagctctccaagggtatgcagggtatgtgtggatggagagggactggtcagatggaacaggaaatgaggagatgctgagataagaaatgtttagatagacgtaatttctgttttcacaaattttgcaggcaacggaagtctggcagggagacaagggcaggcagacagttcctcacacttgcagatacttagaggtcacggagactaagcctcatgcagagactcagggttcatggcattttgtcattgctgctttgacccagccattttgagggtgacattttgataccaaataaaaagccaacagttaaactttcatctattttcaattacctggtatcagtcaaaacagacctctttcccttttgcctcaaaccctctcccatccctcatccccagttcctcaggtctccttaagactgccatgttcaaacagctacataaggtccaccgtgtcaaaatgtactaccccacaactttaactctcaacaggcctaggcattcctaggcggacagaccttcatcccacattatccttagttctctttccactagaatggtccaggggccagcaggaggattgagtcggctctaggcatggctggagtgaccctgggacctccacacagccttggtctctttgctgatggaaggaaagtgcagctgatcttgcccaagggtctgaagtgcccgccatggtcttcagtggctgccacggtcttcagtttctgtacattgagttcctttctattttccacttttgcaccaagtttgataaccctaagtggctgatctgaacaaccaaggccattcttaagtattctaaacttaagctgccttagcttattctaaaaggaggacaggttcctcaacattattttagttctacctattcttctttccaggattccttcaccccaacaacccccttgagccctcatctgccccaaagcctctcctgacccttccagctcaaaggctgcacagtctctaatctccagcacttcatgtttgcaccataataatatacaaaagatgatcaaattcccaattgactatgtttcaagcattcattttaaaaatcattgttagtcctcttaatatattttctcagagaaattataattatcaattgggttcacaggctagctctcaaaaatctatttaacccactaatgtagctaaaataccataaatatgctattaaaaagcagtggttctacaccaaaagcacaagcaacaaaagaaagaatagatacattggattttgttttgtgcttccaagaacaccaccaccaagaatgtgaaaaaaaaaaaaaaacaacccacagaatggggaaaaatacttgcaaataaaatctctaataaaagacatatctaaatacataatgaactattataattgaacaataaaatgtcaaataacccaattttcaaatgagcaatggatttgaatagacatttctccaaagaatatatataaatggctaaaagcacatgaaaagacgcttgtttgacatcttcatttcaacagtaggaaaatgcaaatcaaagcaacattgagctctatccactacagtggctaaaatgaaaaagaaaagcattgacgtcggtgaggatgtggagaaattggaaccttttatgttgctggttggattgtaaaatggtgcagtccctttggaaaaccacttgggagttcccaaaaatgttaactatgaagttaccaattccaggggccgggcgcagtggctcacgcctgtaatcccagcactttgggaggccgaggcgggtggatcacgaggtcaggagatcgagaccatcctggctaacacggtgaaaccccgtctctactaaaaatacaaaaaaattagccgggcatggtggcaggtgcctgtagtcccagctactcaggggggctgaggtaggagaatggtgtaaacctgggaggcggagcttgcagtgagccaagatcgcgccactgcactccagcctgggagagagagcgagactctgtctcaaaaaataaaaaaaattaaaaaaaataaagttaccagttccactcctggatatatacccaagaaagctgaagacatattttcatacaaaaatttgtacatgaatgttcatagcttccattagccaaaaagtggaagcaacccaaatgtccatcaactgatgaatgatgaatggataaggaaaatgtagtatagccacacaatggaatattattccactataaaaataaagcaagtattgatacatggatgaaccttaaaaacattatgctaagtgagagaaagtcaggcaacaaggccatatactgtatgattccgtgtatatgaagtgtccagaataggcaaatgtatagatacagaaagtagactcgttgctaggagctgagggtgagagaatgggaataattgctaagggatgtgaagtttatttttggagtgatgataatgtcctaaaatcagaggcgatgtttgcataactctgtgaatatactaaaagtgaatatacgaattcactgaattagtgaattttatagcataattatatttcaatcaatcttcataaaactagcagttctaattctagtaatcaaaaagaggaaagagaaatgaatgcaattatttttttaatttggctgctggtactggagaaaaaaaacagttccaattagaaaaaaaaaaagatgaattattcagtaggaatactaaagtggatttccaaaggctttagaaattgatggcactagttctttaacatctgtagtttcaattcaaagtgtatttcttatccaagttatcataaaccttaatcttaactcttggccacagttaagtttaatttggagcatgtcagtggaaattaggagaggggagacaaagaatgtgagagggatgactaatttttccaaagggtagaaaaaaaataaaggaggatgataaagaatatttatgagctgatatgagctatggaagtgtgaaggacatgtggattggggcgtgtgctcagagtcccttaacgggaaaaaaagaagacaatgggaagtaagcctcctgggacttccattggcaccaagtgtctcgatggctctctctgctgtccttgtagtagtgtgggaggagagaaatctagtcccatgcacaagctttccagaagctcagggttcctatctcagtattccacatttcatatgagtacatctcatcttcccaactaaactgcaaatctgtaagggtgagatcatgtttttatgatggctcctttaatctcccatagctcccattcctctacataacaccatagatgttcagccagtacttgtagaacggtgaatgaatcgatcaaatgaatgaatagcaactctatctacaaggcatgccaaacaagctaccacgagattctgatttactccttggctctttgtgctctctgtggagcaccattcacatagttaccctgcagtcctgcaacctcacccattctgtagcactttgaaaggagagagttgtaaccttcatagtcattgacctttcagtacccacttttattacattttaaatacacccttgaagccctcccatcttcaaggaaagatccagcctgttagctctgggtgtgtaacgtaagaccttagctgatgtcttccttgcaggcataccaagaatgccagtcacctctccaaaccctcccccaaactaacatggtctcctgagcctcgggtcacgcctgggatagagcagagttagcagccatatgttttcacttcaacagtaaatctaacttggaattttaagaacctatttttcccctctaggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggtctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctattcacgttagtaaacagcctaaagaaactcttaggtttactgctacatccatttgtttggagaggtaactgttgtctgtgcctttttgaaaaacttccatttggtacaaaatttttactccaacaccccctcaacccttttctcagggaccacacctcttcttcccaaggtccctgggacttcctcattctttgtggtagtacaatgattggtagcaggtaaaataaatacatagaaagactactgtcaaaagagtgtcttctgattagtaagtaataagtcttctgattatcaaatgagttaatttacataaaatgctcagaacacttcttggtacttaatgttaagtcttcacttatggtccctaatgtgtgctgccctcagctaagctgccaatttcctctcctgtcaacgcagtcactgattgctttcctgagattgcggctgttcggtataaggttttttagaaacatgctcaatagtaagtgtttaagacacaaaacaatttaaaaaatactatcaaattataaggtcttacaaatttctggatatgtagtacccagcatatggcctgatgtaaaactggtgcttaataaaactttgaagaacaaacaagtcagtaagtcagacatactctcaggttcaagggaaaactggatctatctattatcaaatgcttcactagcctacccatctcaataaaatgagttattctcttttgttttcttctcccacatgaaagtcatcactgttagggatagaggagtctccattttttgtttgtttgtttgttttgttttgttttgagacagactctcgctctgtcacccaggctgcagtgcagtggcgtgatctcggctcactgcaacctccgcctcctgggttcaagcaattctcctgtctcagcctcccaggtagctgagattacaggcacccgccaccatgcccggctaattttttttttgtatttttagtagagacggggtttcaccatgttagccaggatggtctagatctcctgacctcgtgatctgcccgccttggcctcccaaagtgctgggattacaggcgtgaaccaccacacccagccaggagtctccttttagacatggagacactgaagaccacctcttcctccatccactctgatctcgccattccaaactttttgcagttccccaaaggtattatgcaacctggcacctctgagccttcataacagtatcctctctacttggagtgttcttgcatgatggcttcctttccccctgtttccactaaaacaactaactctagctcatctttccaaatttcctcagtttcctccaggactcatttgctaaccctcccttggccatcatgtggctatatttggatgccttttctcataagatgctccaaatcaccctgcatgtagacattatgcttaatatattgcaccgtaagatttggtttacccagtctttctcagtggattgtaaagtcgtttgcaaacaggtactatgcctaatttaactttatatatctagtgcctggcatagttttggcacacagttgcagaaccataccctcgtctgactgatacagcttgtaaatcagtatgactggaatatgccctaagatatgtgtacttacaacaagctctccatgtgtttccaatatcatctatggcttgtggtcaagatgaagtaactaatgagatttaatctcctgcttgaaacaactaaaaaaaaaaaaaagacactatagatgagaatgattttcaaggcattggacattaggtaatttttttttttttttgtatttttagtagagacggggtttcactgtgttagccaggatggtctcgatctcctgacctcgtgatctgcctgcctcagcctcccaaagtgctgggattacaggcgtgagccaccgcgtctggctaggagtctccttttagagaactggtccctgagagatgagactctaagtgagccctatgtttgccctagagtactgcatgcaaagagtttctaggtcatgctggagagaggggaacccacgcagagttcaccagctccctgagtagagaggatagagctaggagtccagaaagatcagagcagctgaagtttgcaagtctgataaaggatgaaagagagaggcacacaaagctccagagacctgcagatatttccccttaggtattcagatgaatactgatcaaaacatgtgcatgaagaaattacccaaggcatggggaagaaccac

SEQ ID NO: 15358 - DNA, 71119 bp, Human
ccaggttcttccctcatgacctggggattgttctctgcattgctcctgacttagtggaagtgaaaggtgtccatggcttagggttgcagaaatgactcagagctaagctacctagattcaaatccagctccaaagacaatcaccttccctgcgcctcagtttccacccctaagataggggcaataaagtacccactggaggaggctcttatgagagtgaagtgagtgaggacacaggaaaaccatggagcagggcccagtgcggagcagtaggcatctgctctgatgattgtcattgcaaaaggacccagttgggcactacaatcagcctgtcctcatttggccccaggaaccaccacttgcctagctgtgggaccctgggtaagtcactcagagtgctctgaaatttggctttgctacaagtaggactgctccctgcctcacagaactgttgtgagggctaaatgaaataatgtatgcagagcttagcaggcctggcatgtagtaaatactccggaaacattttttttaagttccagggtggttgtctacctggatgtcacctctgacctctgaaaaccacagggattgaggataggaaagcagtgctcctttctgcatccacccggtccccacctcaccttcctgagcaccaggaaaggagcctgaggaatcaataaggccagaggaggaaccctgcagagcgtggtcagctgggaaggacttgggcagtaggagcagagggggcaaaggagggcctgggttgggggtacgtggcagcatgcctgtcctcagcagacacctcccactgcccatgcttcttgtgggggtgggccagcccagcttaggttatcttggctcattgtccactagtgttttcctcagatgctccctgggagctggcagtactggagggggtggcaagtggcctcagtcggctcacagttctaggaccgggcccaggtcttggaagccccttgagctctcccccttccctgcttaggccactggaagacagaggtctccaaagaaagacaaaagctggggtctagacataccccatctggggtctgacttaaaggcctttgccagggtcacctcctgttggcatcagagaaggaaagaagtgtgtgtttgtgtgtttgtgtgtgtgtgtgtctgtctgtttgtctatgtctgcaggtggacaagtagggccgggtgtgagtggaagtggaaaggatactattctgcccatccctccttgctggccccccagccagctgctaagatccagagtctgggcagcagagtcaaccctactgcagctgggggtgttgagcatgtctggggaagagctaaaagtggcagaaaacatcctgtttgaaagcaatgctttgctgtatttaacccctgcaacacctgctccgcctacacccggtctccacagacaggagatctcagacacctgcctttgaagctgtcccaagaggccaaggctgtgggctgccatccaagcctgccccattcccagctcctgtgcggcacctcctctgccctgcctggggcagccgtcttcccgctcttagcagcaggacacatggcccagttgctctgcttcctgagctgcctacaatctggagatggagggggtagtgagagtgtgggtctccctaacgaaaaggcccttcctccctcctgacaccctgggctgtgagaggagaaggagtgcctaggcgggaggctgtttccttctgcctggggctggttgccgccaccgcttcccactgctcctgctactccctgcctcgagggagggccatcctggctgctgcccagccgccacccccacacccctgccagcgatgacatggcatgcctgctcccaacaagccacttctgtttgcagtcactgatctggggactaaagtccctggaaagagcctctcgtgcccacttccttagagactggggaggcggtcagcgctccgccttagataaaaggtttccccttcttcatttcagaagcctttgggtctgaagtgtctgtgagacctcacagaagagcacccctgggctccacttacctgccccctgctccttcaggtaggtgtttcctcatcagccgcaacttccctggctttctgttttcaaggggcggggtgggggggaggggcataagaaggtggtgggcaggggaaggaagggataccacccaggattttgcaaggtgggtcccgggccagcagagtctgcaactgagatgcatgagtgtgtggggtgcgggtgggagttcagagaagggctcaggagatggggcttgctggctccagccacgaccctggctgggctctcctgtgcgtctgatgtttcctatccagcccccatctcctctttctctttgctgccttctttagtctctgcctgtcattcctgggactttcagctctcaagccacagaggcttggacatctccacatgtggactctggtcctgggcgctggcttcttgatagcagcaaataacctcaagcagggttgggtcttctgtcagctcccctgaaatggtctcattcactgtgggcctctggctgcttgatccagcctttccagccttcacccccagcatagagacttcctgatgtcaaggcagcaccccaccccattgcaggactgccccgttgctgtgctgtggtagtatgttgttccactcgcttgcatcatagcatctccaaatgagtccatgtgatgctgaacatgtgttgactgatttaacagatattccttcctaccccccatttgatttctctgttttccacgaaatccaccggatacttgggagcctggatgacccagactctgtagcaacaccacgatgactcggagctgcagcatctcagctgacccagggttaagccacaagcatcctggacagtttcccctattaccccacaatgatattgggcctccgggatgctggccacatcttgaatgtgtgctatgttctaaaacctgcaggcatcagcttggacttgggatggtctttggggacaatgttgatagatccacaagcactttttctatttttaattgttttttaaattatgaaacgttttgtatattcagaagggcatgcaaacacagatatacaaaacatagatgtagtgttttgctaataataataagaagaagataccatatgctcactactcaaaaaatagaatactgctactatataatgcacacccctccccgatctcatctctccaaaggtttctgttaatcattcctttgttctttttttctgaacttttcttataggttcagggggtacctgtgcaggtttgttacaaaggtatattgcaagatactgaggttttgagtatgaatgaattgtctcccaggtagcgagcatagtactcaataggttgtttttcagcccctgcccctgtccacttgtattcccagtgtccattgttctcatctttatgtccatatgtacatgatgtttagttcccacttataagtgagaacatgtgctattttgttttctgtttctggctttgtttccttaggataatggtctccagctgtatccatgttgctgcaaaggaaaaaggacagtgtatgtgtgtaaaaaggacagtatacgtgtgtaaaaaggacagtatatgtgtgtgtatatatatatatatacacacacacacacatatactgtattttctttatctagtccagagttgatgggcacctgggttgattctgtgtctttgctatcgctgcaatgatctttgttctctttctgaaagtgcttctctctttatatataggtatatatttatacttgctaaactttaatgtatatgtagctgctaaaatttaatatatacattaaatatgtatttatatatttaatatatattaatatataatatatattaatatgtatttatatatttaatgtatatattatatatacattagagtttagcaagtataaatctagctgtgaaagaaattagcaatagtgtcactattactattaggatagttcaaaagtaattgcgatctttgccattatttttgatggccaaaaccacaattacttttgcaccaacctaatacattaaggtttccaggaaaagaaaagctaaatgaggttagggaatctccgaggtctgtgaccgggattccctctgtccctttgggactgatgataacatattcttgcttatctgcaccacttctttcccttggtgtgaagctctttggggaatttttagaaagtatttgttttattcatttggcagtagtggtttctagacatatcttaaggtttgggcctctctgggcctcatttgtaaaggggatgatgataatagcatctacaccatgaagtggtatgaaggtgaaataagacttaatgagctttgatattccacaccctagatcagagatcatgggcctagtcattgaaaagtagctcagagcctcccaagggcccccagaatctgcctctgtcacccaagggcaggaggaaatggtaccctggggtggagtgggttcttgtctcttgtttcctggctttctctcttatttttcttctgacatgaaggaccctttgcctagggtcaaaggggtcactgaaacctgtaatgacccttttgaggattcagataaaattgggagaactgggaggcagtagggtctgaaagcatttcagggcagtctgaggtatcccagaatcatctctgagcctgacagtagacgggatcagacgcagcagacaaagctgggggcccagttttggctaatgaaagagtcaagccagctgcttcctgagaaggccttcccaaagctgtgggctttcgttccgtctgtctcttctccttttcctcaagtatgaaatccatctctagatgataatgcctgtttagaaaaaccatctctgaaaacacaattaattgtataggactcacatgactcagaaggacattcaaaataatgttttaagtgttgttgccaaaaaaaggggggggaaatatcttgaaatgttgattgtcttggtacaggaacaccaggggcataagcctattagccctgagctttatggttgtgaggagctggggctggaatgaccagggcacctaaatcctcaattccccccaccctcaagaggaggagacctgagggtttctctccacatgtaggtgctgaggctgagggaggactctcattttcccttggagggggcgttgggcaggatagaagcccctgacctggttcaggtctgtgcctgaggcagagctagtgccagtagcatgaatgggttcatgcatatgatccttacaccctggaagtaaaacacctcttccaatgcagacagcgggggcatgcagaggtgaaccactaaacccaaattaacctgacagatgcaacatctgaaaccaggcagctgattccaagccatgctctgagccagctatgtagggcgaatcatgtatgagggctccgaaggcactgtgctcaggcctgggccctggggagatgcccacccttgctgagctccctggtggtggggggtgggggcggtgggatgaggctgggggtgggtggcaccaaggatgccagctggccctggcactgactctggctctgaccgtggcctgcttgctgttcttacagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggtgagccctcctcccaggctctccccagtggaaagggagggagaagaagcaaggtgtttccatgaagggagcccttgcatttttcacatctccttccttacaatgtccatggaacatgcggcgctcacagccacaggagcaggagggtcttggtgagtggtatcttcttttccctcctctcagctccagatgttcctctgactctcttggaaatcgctttcctgaggttgctgtgtgggtctctgtctttccattacgcctgtaacccacagcctcctacaccaacccacgtgtccatccttccagagtgaacctcctccctgttgatgatcacagcttcctcacccaagagacaggcatgtctttggggaaagcccaagaacttggtttcagagcttgccttcccatccaatccaaactgttccttggaacaagggaaatggcacctcttgtcgggtcatcacgatctgtacccatatcttcacccaaggactgtttgtcctggtctgaaagccaaccttggaacatccaggcagtgtcaggaatgtacctgcattcctgtttgatcagggccagtttctttaccaacacactccccttacatgagcccaggattacagatgtgaaaggtgtgggaaaagcactggaggttcccattcaaagccagggtgggagcgtgggaaagggatgaattggggcaggaactgggaatcatgagaaattagcatttggcatgtattggagagagagagagagaatagcctgaaagaaggcagccaaaacagatcttctgtctagcggtctagactggaggtggctatggcagggctctaaccatcaaatgaggaaagcacaaatcaagtccagaggaggatgctgaggtcggcttggttgttgtctaaaccggagtgctctcctcgccttgggggcacagtgaattcaagtccaggcgcttgtgtgggactcttactcaaggacttggggtctctctgtcaacacaagctcctgattcacctgccctctgcctcaggaatcagcaggcccagagtttcatggccttgagcaattgctgggcagtggggtttctgtgggtgctaattgcctgtttggcctggcactggctgcccgcttggcttcccggcagcctactctccagctcggggaaccagacaagcagcatcgctggctctaagtcgtgttgctgcatttgccaatccttgggcctgaggtccacacatcctgcagggtgggccttctagagccccagttgtgtgtcccaggtgacacatggaccctttcctgccaggtcctctaacttggggggctgccttgagtgctaatgagaggggaatctaacgcacacctcagcgcctgcttactaccatgaaacccatcagaaaggcatggtctggggtgctggccatggcaataatttatgggatgtccttgctcaaatggatgtccttgacatatctaggttttagttaactcaactaatggcatgcatgtattgatatccaccccctctgctacatagtgttaatctgaggattaatgagatgacatgtaaaaaagtgctttgaaaaacactttttcagtctgatgaaaaaagctgagatttttgagcctgatgggtcaccactgctgcccttcatggaaccatgctctcataaaataaacaaaagcctcgcagccagccagccagccactttcctcgtgtgtgtgtgtgtttgtgtgatttttttgtagtgatggggcctccttatgttgcccaggctggtctcaaactcctgggctcaagcgatccttccatcttggcctcccaaagttctaggattataggcatgagccaccatgtctggccttgtgtttctttcactcattccgtcaccagacttcaatctgcatttataatctggcattgggctaggagttgtcaatatggagattctcaccgaaggtcatatcttgtcagtctgcaaccaaagcatttggttatggagtctctacccccaaatccactctctcctcctaggcctcctcccccctgagattcagctctgggaaatgagaatcttaggtggcagctggttgggtggtgacacattggaggccagttcctcactggagtggctctgactgctatgcatctgtggttgctgcccttggacacaccactaggctgggaatcctcaggacaggagcatgtgaggcatctgggtggagagaggacaggtcctgtcatgccccaggctgagtgtgaaagatggcagaatgaacaaggatggtatgtttgtaatctgtgtcaccacagactgacagagtggctgtgttgcttgtgggcacatgatgccaccttaacccactcttagtccaccttgacaagagcccttagagtctgttgctggctgttggtcacaaccactgcctgcaatgcctggcactatgggctgcaggctggttttgtcttgttaccctgtcctcagtctaccttacttagatctttactgtctctgtcttgatgactaagctaggctgctacattctaaagagccaacatgtctgtcatttgcttgaggatgtggatgaaagagaatgagtggggttatctatggattgttcaagagtaatgttcagaaacttgagggaaggtcactgaagctgtcaagaaagacagctgcaaggttctgaattttgtttgatatgtacataaacaaacacacacatgcacacacacacacacacacacagtcaaccttcattattcatggattctgtatttgcaaatctgcccacttgctaaaatttaccaaaatcaatacttgcagcccctttgtggtcatttgtgaacatgtgcagagcagtgaaaaattcacatgacttggcacctatcttcccagccagggtcttcacaatctatttagtgctacattttttgcctttttttgatttttattggtgactttgctgtttaaaacagttcccaagcgtagtgctgcactgctgtctggtgttcctaagtgcaaggccgtgatgtgcctcacagggaaactatgtgtgttagacaagcttcctgaggacaacagtgctgctggctgtttgatcaatgttaataactcaaccaacaatatctattgaataagatatctttaaacagaaaactcacataagacaaggttatgtgttgatcagttgatgaaaattttgtgaccagaggcttgcagaaacctcaccctgtgtttcctccaggaacagtgtttcaatattcactaatccagtgtccacagtgactatagaccataactaccatgaataatgagaatcagctatacatacatcatttctcctcttcttccacccctgatgcctgcttctccttctttgcttcatccaaattttatttggaagttttccattttgatctggtccaaatagttgcttgagaaccctgtggtcactcatatctgtttgtgaaactctgatcccaggaagcaaggacaatgtcagtggtctgtaccttctctgtggtgggtactgcatccttgcatccttgggaacacagagatgacaggaaccaagtccttgctctcaagaagcttgcttgaccatttcctgatagttattgatagacagcattgcttgaatattgggtcactagctcttttccaagccctggagaccagtaatccaatcccatttgaccatttagtatttggtttggcttctaagatagttaactaaactgctctaggagctagttgttatcatcaaaacgagtctaagactcataatctagctgaagtgtgatgatggttagaaggttagagagggatcacagttctattgatctatgatcaggcattagaggccattgctggtcaattcctcctgcaagctatttcatgttgcttgtgcttcctgttattctggaatacagggacatcctcagagaaagatgatatttccagtgtgaatataaggttggcacaggcaggcttatagatggccagacacctcttggctatatgttaacaactaaagcataagtaagagccagaggaggaaaaacatttggaataggtctattccaaatgacatatatagtggatgatccatatatgtatatgcatgtggatgcatatggtcatggatggcttcgtccggagtctgatataaaggaaaaggtgtaatggacagagaagaaaatcagaggaacccctttgatgaagagaatgaaggtggatggtgaggtttaagagctgatcctggaaggcaagatgagaaacaggtcatcgtttgcctgcttatcttgtcttcttcctccctgttgggatgcttaaataaggactctgtgcagctacaagctaacaaagacagtgcagagaagtgcgttttcgcttcctagctccaaggttcttgaggactttgttaattatgggtcatgcggagtgcagggggcaaaaggtaggctggcgaggatccaggaagatgaggaatgttctggcattcaggaaggtcaccccactgatatttgtagctcttctagcaacctgatgtgaaaggaagcagagaaatagggcagatgtccaggaatttaaaacctaaactgcttaaaggagagaaaatagagaaaaaagggaggaacagccacacagggtattctatgggcacaagtaaatgagtgaccaagaagtcagtgttgctggagagactttgtccaggtccactttggcagctgacctccattcacagatattcaaggatgtgaatgaaagagaatgagtggggttatctatggatgttccaagagtaatgttcagaagcttgggtagaggaggccaaaatatttggagagggaaggtcactgaagctatcaagaaagacagctgcaaggataggattttacattacctttttgtcattcttttatttcttttgaaattcagcactctaatcagggctcatttgcatgactttgcactcagcacacacttgagatcttccctgtgcttgggttatacagggccagtggagagcatggtcagatgtgaccccacacttccaaagcatccttctagagactgcctgaatccctagagggatttgtcctagaggagtccttcaaacagcctctgcttcatgctcctggactttgggaaagcatgtttttgactgctgctctagcttggattgagagatggtacattcctgatgagaaccatagtatatatgaagatcagtgtattagtccatattcacactgctataaagaactacccaagactgagtaatttataaagaaaacaggtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggaggctgcagtgagccgagattgcgccactgcactccagcgtgggcgacagagagactccgtctcaaaaaaaaaaaaaaagaaagaaaacaggtttaattgactcatggttctgcatggatggggaggcctcagaaacttacaatcatggcggaaggtaaaggggaagcaaggcctgtcttacatggcagcaggagagacagagagcaagtgaagggggaagcgccacactttaaaaacatcagatcttgtgagaactcactcagtatcacaagaacagcaagggggaaatctgtccccatgatccaatcatgtcccaccaggcccctccttcgacacatggggattacaattcgagatgggatttgggtggggacacagagccaaaccatatcagtcagattccttgggagtcaaacagttcttgattctaattccagctttcagacttgctagctgtgacttaaagcaagttatttaactttcccgtgcctttttgtgtcacttgtaaaacagggataatatctacccaaaggttgtcgagagcattggagatagtatgtaaaatactgacctagaaagcttccagtggtgatagctagtatcattatccctttttagtgtcttagttttgaggacagatggtcctttcttccttttctctaccatggaacttggaaagtataactatgtgatgtgttggcagtggtctctgaaaagaggttcctaaacagaaggagttaaatatcaggtatgaagagggaagggctgggccaggggctctgagagagcttcatgtcggtcaaaggctgggtagaactggctggtgctcaacagaactggacagtggttgctgtaactagcacaggggctgtggctctagacatcaggagctacagcacatgaaacagaaatatggtttcaaactctgctgcctgcaggctcccatgctaggcacccagagagcaggcctaagacatggtgtctgcttcaggggtctcaaattcttaatgagatgtttaaaatctactttaaaatctactttcacccactctcagcactccctcccactgcctctttctgctagtttctcttctttccctttatttagggtttcctttgtccaggtcctgttcccttttcctttatttagttcttacaaccctctctgaaatgttgctcccattttacagatgtggaaactaatggatgggaaggttaagtaacttgcccaaggttgtgctttaagatttaaactcaaacatatcgatctaaccaaagactgcatttcatttttaatgtttaggtagttgtagtgggtagtggattttttaaatgtaacgtcataatatggctttttaaaaagccaacagtttaagaggatatgtaagtgaaaagtaaatcacctattcaacccaattcttagttccctacctcctccaggaagctgtcactgttgccagctcatcgtgttcgcttccagattctttatgtaaaagtgcatatgtgtgtgtgtgtatgtgtgtgtgcacacacgtcaccattctgcatcttggttttatctgctaaagaacacttcttcaagctcattcccatttcagcattcttcctctttctttttcatagtcacagagtattatatggaggttctgtgagataagaaaccagtgcctggctgggcacggtggctcatgcctgtaatcccagcactttgggaggccaaggtgggtggatcatttgaggtcaggagttcgagaccagtctggccaacatggtgaaaccccatctctattgaaaatacaaaaaattggccaggcgtggtggcacatgcctgtaattccagctactcgggaggctgaagcaagagaatcgattgaacctgggagccagaggttgcagtgagcccagatcgtgctgctgcactccagcgtgggtgacagagtgaaattccatccagaaaaaaaaaaaaaagaaagaaagagagaaaagaaggaaggaaggaaggaaagacagatagacagacagatagaaagagagaaagagaaggaaggaaggaagagagagagagagagagaggaaagaaagaaagaaagaaagaaagaaagaaagaaagaaagaaagaaagaaagaaagaaagaaagaaagaaagaaagaaagagaaagagaaagaaagagaaaagaaagaaaccagtcctctgtcatggtcatttaggttcggtctttggctcctccagacagagctgcagtaaccaccattgcgcccatggaccgatctacccacaggataaatacctggaagtggctttactgcgttaaaatgtctgtgtgtttaacatgcttcgcattgccaattgccctccaaaaaaaaaagtctgtgctcttttctacagtgctaaccatcctttaatgtttttttaaacccacctgaggagaaccccctgatgctgcctctcacatacatgtaggcccctacatcatttgatgtaggtctttttattcctttagatttgctggggtataattgacagatagacatggtctatatttcaggtgcacaactcgatgttctgctatacatatacattgtgaaatgatcaccataatcaaactagtaagcattcccagcacctcacatagctttcagatcaggagctctcgctagttcctgtatcctgagcagacgctggaatctctgtgacagtgcagtggagatggagcccagaggggatagttgaccctacgcctgggttatgcaacgtgcgtctctgctggcagaggccacctactggagaaaggcccaactgtcccaggcctgaggccctggccccaggctcttgatgcttttgtgaggtttttgtctctttctgttttgataaactggtctctggcatgagaatcggtcaatgtcctctctcacccctggctttctagaaactgcatctatatttagcttggttgccccacccctacccccccttcctgagctggggtataaatgccaaccaaccagaggatgacagggtccaggctcagagagcagctgaggcaatgggctctcatggaaacctgaagctcttgtttctcaaatccaaaccagctcacaggcaattagtattgggaggaaggcagggtagggtgtagaccttcaggacaaagcacagagccagggttgggcagtctggctgccctgactcctcgtgggcagagagtaaatgacagccacacatgtggaagtgcccttggaaggcaggagaacagggaagaacaggacctctgagccaagaggatctgtggcccagcaaacagacatgttgggccagacacacctgaaaggccagctctgggatctgagttccagagagcctctgggtctggcagttggagctggggagcaaactttctataccctgaacactgaccccacgctccagagcgtaatggtgtcctcttccttttcagtgttctcgggcttcatatgacaactcttaagcagaagcaagggcgccaaactttttttttacccccagtactttctcttttattttttatttctagagacaggatctcactttgtcacccacactgaagtgcagtggcacaatcttggttcactgcagccttgacctcaccagctcaagcgatccttccaccttagcctcccaagtagctgagaccacaggcgcatgccaccatgcctggctaattttttttaatcttttgtagatacagggtttcaccatgttggccaggttggtctcaaactcctgagcctaagctatctgcccacctcagcctcccaaagtgctgggcttacaggcgtgctcacgccactgcacccagtcccagtactttctcttaattcagctctgcactattttctcttcctattccttttttttttttttttttttttttgagatggagtctcgctctgtcccccaggctgaagtgtagtggcacgatctcagctcactgcaagctccacctcccgggttcacgccattctcctgcctcagcctcccgagtagctgggactacaggcgcccgccaacacgcccggctaatgttttgcatttttagtagagatggggtttcaccgtgttagccacaatggtctcgatctcctgacctcgcgatccgcctgtctcggcctcccaaagtgctgggattacaggtgtgagccaccgcgcccggccttctcttcctattcctagcctcattcctgttgtcaggcaaagtggggctgagtggcaatctccaaccctccctgcgtatagacatctgagatggagcttcatatttaaagtgacatgagaaaaatgagagaaagatggcgaagcagtggaatctcttttcaggcaaccctgcagctgggggggctgcccccaagtgagggtcaaaggcaggctccctggagcctggggaaggacagacggggcctctgataggccctggggcctcaagaagctctcagtcccgggcccagtctggtgagaggctttggctcacatcactgtaggtggtggctgggctaggctgacgatgtgctgtcttcttggtgcccatggccttgcaggcttaacaggaagagctctgagccagacaagacagccagtgggaggacagagcagcccctcagtgaccagagcgaaatgcccggttgttgaaaaacaaaaaaaaaaaaaaggaaatgagagtttcttctgaaatagaaacttctggtccttgagtaagtttagagaattacgggcattctgaggcctgagcatttgtggtgacggatgaagcctcaagaaccacaaggttggtgggagggacaccaatctcatgtcctggaacatacagatgtccctgtggggataattgtatctcgtttctggggaaccctaacagttcccaagatgcttccatattctcttgtccctccagaaaagcagcagtaaacaaatagaggtgaacggcaaaaggctttttgtttctacgaagatggaaaaaagcctggcgtataacttctttcttgttagctactgcagggttaggactgggcctgaggcgggctagacttggagctaaggagcccctgatagcctggtgctgctccacctcctgacaaccctggctctgcagtaggccccttgggtgatgagggttgtcacagcagggtaccagagccaaggtccaaaaccaacagcagctgcttccttgactgttgggtcattcttggcattgagccacctggggctgtttggggcatcaacttcactgagcactttaagtttctggggttgaaaacaatccaggaagctaaaggctaagccttagatccctaagacttccagacctaggagcctgcacttcttgctgaatatcctcacctgtaagtttcttaacctcagtggtcccacgtataaagggagggagttacactgacggtctcttgggccctctgtggatctaagagtctgggcctgcctgggactgccagtagagccctactctggtctcttctctatcccaggggctgagtcggtgtggtccccagctgtccatttgctagagcaagcttgacaattgatgagtgcgattcccctcaaccccatgtatgttctagtgaatgtgaacagtgagtcatgttttaccaagaatcctaactaatgcctggcccctgagcagatgacgtcagtagctcatctccaggaaggaaatggttgggcctgggctttggcttggaaggcttgggcatcttcacactcagcagttccttggaagatgctgctgctcatgcagacagtgattctgccaccatctttccccatctaactatgtcagaaaagtggggcctactcctgctggggctgggaggaggacaggactctcaggacatggatgatgaaaagcctctagggaggtgcctcagggaggtgtcctttatgcagcctcccaaagtccacgtggtgtggctggcagtgggagagaatgttcgaattaggaaaatgagcccttaaatgtgcacacttgtgcacacacacacacacacacacaacttacataggctacaagggtgccacttttctttttcttttctttcttttttttttgagacagagtctcattctgttgcctaggctagaatgcagtggcacaatctcggctcagtgaaacggccgtctcccaagttcaagtgattctcctgcctcagcctcccgagtagcggggactataggcatgtgccaccgtgcccggctaatttttgtatttttagtagagatggggtttcactatgttggtcaggctggtctcaaactcctgacctcatgatccacccacctcggcctctcaaagtgctgggattacaggcctgagccaccacacccagcctcaagggtgccacctttctagctaagaacacttcagtagttttctgggttttttttgttttgttttgttttgttttttgagacagggtcttgctctgttgcccaggctggagtgcagtggcatgatcttggcctactgcaacctctacctcctgggttcaaacgactctcctgcctcagctcccagcccccaagtagctgggactacaggcatgcaccatcatggccaactaatttttgtatttttagtagagacggagttttggcatgttggccaggctggtctcaaactccttacctcagatgatccgcccacctcagcctctcaaagtgctaggattacaggcctgagccactgtgcccagctctagttttctgttcctacagagctcctgcttcctcttcctttcaaaaaacccaaggccaggcctcaggatttccacctgcttgtctggccccttctttttctgggcaggttctgggatgtctagagctatggtttgggccttttcttccttccatgtacacatctatccctggaacaggagctattccagtcacaggtctctagaatctagaagacttcatgctgagactagcatccttacttctcatagcggctcattaaatgttattatgctggctactctggagatttcaatatttaaaaaggtttcttcggccaggcacagtggcttacgcctgtaatcccagcactttgggaggccgaggcaggcggatcatgaggtcaggagatcgagaccacagtgaaaccccgtctctactgaaaatacaaagaattagccgggtgcggtggtgggcgcctgtagtcccagctactcgggaggctgaggcaggagaacggcatgaacccaggaggtggagcttgcagtgagctgagatcgcaacactgcactccagcctgggcgacagagcgagactccatctcaaaaaaaaaagggttttttctagggaaatgcacttttgttatttcctgtttaattttttaaaatgggaaggggaacagagtactgtaaaataagtataagagtcggggcgtggctgtgcgcgatggctcacgcctgtaatcccagcactttgggaggccaaggcaggcggatcatgaggtcaggagatcgagaccatcctggctaacacggtgaaaccccatttctactaaaaatacaaaaaaaaattagccaggagtggtggcgggcgcctgtagtcccagctactctggaggctgaggcaggagaatggtgtgaacccgggaggtggagcttgcagtgagctgagtgagccactgcactccagcctgggtgacagagcaaaactccgtctcaaaaaaaaaaaaaaaaaagagtcggagtgcagtggctcacacctgtaatcccagcactgtgggaggcctaggatagaggattgcttcagcccaggagttccagactagcctgggcaacatagtgagaccccatttttacaaaaaaatcaaaaaattagccaggcatggtggtatgcacctgtaatcccagctatactggaggctgaagcaggaggattacttgaacccaggaggtccagcctgcagtgagctgagatcatgccactgcattccagcctgggctacaaagcaacaccctgtccccccaaaagaaacaaaaattaaaagaaaaaaggtaagtacaagccatgattggagctgggcaggcaatgaaaggagaagtaggaatcgtttggtgcccagcctagaggtgagagtgactggcagctggggtgggcctcatgtcttctgttggagaaatggagaccagggggcccagaagacaggtctccgtgatgacagggtgaggagccggaagttcagtgacccagggcagggtgtgtgctctctcggcaggcgaagcatgaagcggaaggcactattcacctgccccttcaacggggactgccgcatcaccaaggacaaccgacgccactgccaggcctgccggctcaaacgctgtgtggacatcggcatgatgaaggagtgtgagtgtccaggggctgggcagggtttgggcctgaagtggagtcagggaaaggccttggccactctcctgcaagtttgggcagagggtctgcctgcccttcctctgtagctgccagcatctggggccagggcctcagtgggaccagcagctggtgacagggcagctggaagtccagggtcagatgcactcagcggccctgtgcacctcttgaggatctgtgtgttggtgtcagaggccctggaagggtccctccagagtggggcctgagaggaaggagaggccggacactgccttcaagagtcccttctactcctgggtcagggtcttcctccaggatgtcattcttttttcacagctccctgttactcggacctagagggaagaatgaggttcaaggacccccaggttctatgggcttgggaagagagggctgatgtgggttaggaagggcaggagtgatggggagaattagtattcagagcatagttggcatccacgttctgtcccaccccagcctcccagcctctctggcgccttgagcagatctgagggcttgtgccagggagagaccaggaggaaagagtctgccaggggaagcactgggttctaggacgaccctctgaatccagatggagaaagaggagtgattctataggacttcctgtccctctctggggttggagaagaccaacatggcatatttacatggatattttgacccatcactgaaaacaacacttgaactttgcatcagagctctaggacagttatttggtaactagagtaggcattgaattcagtagatgctgggaggggccagcctggccctctctgggctggagcaaggccagctgggcatgggtgctctctgtacactcattcctttttctccttctcttgctcactcctgtctgccatctgcatccagacccccacccggccctaggacagaacccaggccctcctagctgtgggtctgaggaatcggagtcggagtcggggtggggatgttgctcagatgcggaccctcctggctatgggaccgtttggagtggttggggatggggagaggtcaggtaacaggaagatgtgtcagggacagaggataagtcacagaacagggcttagaggatagcaaatttctccgttaatgggaaaaaaattatctgttgttgggacacagaggcagagctgaggccctgaccctgggcttcctctttgggccttgacctaggcttctcttctgtgggtcatgactcctccctcctgatctgacggctccccagccaacactggcagccctgaaaggtgtttccagggctgtggtttctccacaccatcacagggtgcaggcctgggcacgctggtcgctcctaccctagtccctgccacgccctggctcctgtgtttatcctggagagaataagaagtggaggctggaggcccgggtgccttaagaggcttcacacacattctcagtgggccctgctcagggtgaggcgttagggtgggcaccaacaaggtgtgctcagcacagtcccatctccgcagagaagacagcctctgcaaagcagggagtccggtttctaaagctccagctaaccaagactggcacgaggttccactgcagtggttcgtaaggcactgccacaggagttcccctcaggactaagctcactgatgcccaagaggcccctctcctacctcaggaggaagaggatgtcttactgacttaaaatagaaagaacatctgagactcagagaggtaaagacctcaggtctggggtcagaaagcaagttggtggccaagctgggactagaatcagacttcatgtcccctcctacctgcctcctggtccccataaacagcgctgcatccatggtgaagagcagcaccagcctggggtaaatcagggggccctgcccaggagcaccctaccacgtggtgggaacccagcagcccagaagcgatgtccaccccatccctcagccacgcccaccccagcctaattctctcctgtggagtcctgtgtccccatcctgctgtatgcccaaggtagcttctcgccacaccaccctcctcatcccagtgcagggagcagtactcagttctagatgggctggtggagcggggatccagttaaaatagaaacgtcctgatgctttttactttcctgaagggaagactgtccaggaagagacattcccagcctcaggttagtccagcttcaggaggcctcaccagtgtgaagtcccccggcctcagaaccctgggagagctgcacatttcttatctgggctgggttttgtccccaaggcatagcatcccagagacaattgagtgtctcaatatttgtaaaaccacaggaagaaagctaaaagcccaggctcctgctgtccgagcaaggaggtgggccttccatagaagaggcacaggaagggaaaggatgaggacagaaaccctgtgtattgaccaactactgtgtgtcagatagcacatcaagcacatgcattttcttctgaaattctcacaacactccctaaatatgtaaatacttttattttttcaatagctgaggaagctcagaggaattaaaatatcatggctctcagctaataagatgatggtatcagcattcattctaatctaggtctttctgcttccaaagggcaggcttgtgggccacacccgaggcagcctctcgtggccccagtgggtcggagctcactccattgtgcatttccaggcactttcacatgctctaagagatggattgaagacagcttggtcccaccaaagactcattttctctcttttccattcttagttgactttataccctgggaacccaagaaattttataactgagttcttgctgtttgcttatactattacctgtcctgcacagaaccacacattgtggtaacttgtttgatgtttttacagatgtatgtcttttctccctggtgttagtaaagtacctggcacatagtaggtgctcaataaatgtgtggaatcaatgaatattagctcctcattatgcttctttctctctgtatatcttccacaggtctatagatcagtaagattctcccaaacctgatcatgtctgtgccgttcatttggaaacattttatgtcctcttcctgtggttgttcttagcccatccttggcatcttgaaatgttttcaaattgtttatgttgcagatcttggcttcgttaaggagagaacatgtcttgcatgggaataacttgcgcaaaattatttcacactcagcaaggagcttaaaatgaagtcaaaaaaagcttctgagcagccatgtaggttttacaaagtccacatgccaaaactcatgcactttagacgcctgatcaccagacagcccaacactctttcagaacctgtttactcttattctaggtcaatggcttcatatatcatatagtgtcttcctatatgatagtaatgacatcttaggttcaatccattgaaaaaatgataagaaatttcccatgaaattaacaagatctttaaacaaattatttcgtaaatcacagtgcatttgcatatgtgaaagactttagacttattcagtcctcaagcaatgttgccttgcagaaggctcatggattgggcctgtgtgaaactggtagatctcagcatttcttcctctgttacctccatagaagatggaggttgctatttgatgcaagtgactgggaggaatcatgttatagggttaaacttgaactttctttgtctctttaaagtgggtaatttacaagctttgtgacttaattttattttcacactcttcagatggattggaacacaatgcctgtcaaaactccatggctgaaagccaaagtccgcttataaccagatgtaatcagacacagtagaggctagtggttatgaccttccactccagaaccagactgcccaggtctaaatgctggtttcaccactgttagctgtgtgactttgagaaaggtagaaagcctctctgggcctcagctccctcatctgctaaatgggaataacaacagcacctgccttaaagggttgtcatgagggctaaatatatgagttaatatacaaaaggctctcagaatagtgccttatagatagaaaaactctttatgtgccatccagcattacgaatattttctttttattacatcaaacttgatcaccagaacttctagctcccaagagatcagaagtaagtcttaagggggagaaaggcacacatccagaggcagacaccaataagaagacaacgcatagtttaacagggaggtggacactggaagcaagaaaagcagcccaagaactccaaagcccagcacgccaagccatgcaatgcggggcagacagcctctgacaactctgaggctgtaaccttgtcctgcaatgttcagtaattattcagaatgatacctctgaatcatcagggaaaggttatatgacgttaaaagtgttccgttacaaggttttctgtcttgaaaatctttccataacaattgtttcaataaaagaggtcagctttctcagctctctggtgtgccaggtgccattcactacattgcaggagacaagcagcactagagtactcactagcctttcctgaaccaggaaaatgatttgcacacagttggtgtaatctgtgtggatgcatttgatatttggtgtcagactattgagcagacaccacggccaggtagcccctccggtctagcctttatgggggaaatataagaattgtaagacaaaggccgggcatggtagctcacgcctgtaatcccagcactttgggaggccaaggcgggcagatcacctgaggtcaggagtttgagaccagcctggccaacatggtgaaaccccatctctactaaaaatacaaaaaaattggccaggcatggtggcatgtgcctataagcccaggtactctgtagcctgaggcaggagaatcgcttagaacccgggaggtggaggttgcagtgagccgaggtggtgccactgcactccagcctggataatagagcgagagtctgtgaaagaaagaaagaaagaaagaaagaaagaaagaaagaaagaaagaaagaaagaaagaaaaagaaagaaggaaggaaggaaggaaggaaggaaggaaggaaggaaggaaggaaggaaagaaggaaggaaggaaggaaggaagggaaaggaagggagagaaaagaaagaattgtaagacatggaccctgcccttaagtaacttgtaatctagagaaagagaccttgaacttcttgggctccgtctataggtaatgaattgaaaactgtgctaaccatgagtcttacagagcagaagataattgggtgtcaatgtgtgtgggaaagactaaatatgtagcaggcataggaaatgaggctcagcagaaaaaaacaaggcttgatgcagatcagggcaatcaagaaatgcttcatggaaaaagatggctatgatgtaggcactgaagaactggtagaactcatacaggtttgggggagagaaaacccagctggacgggcacctagcacaactggaaatgcaggggcgagcatgagcaggtcatgttcccaggccagcagcaatgccagcatgcccagaacagaggctgtgtccagaagcactaagacatgaagtctgaaagttaggaagaggccaactttagtttggacgtggtcatcagtaggggccgagaaaagtatctgggcaggagaatggcatcacagaatcactggaaagttagcaaagtccagtcaggctgagctacgtgcctgtagacaccatggtgtggctggcagaaacaggtctccctaactctggtccccaggtgagcaggaaagacaagacacctaatcttgggctccccaagcgagggcttacccccattgccttccctggatgctccctgccccttcctctcccaccctgcctgacctggtagggtctgtgcagacacccactgtgggaggagagttggcagctgtttgggcaggtgagtcagtcacctgggtgtggtctactcccaggctccctgtggagggaagcaccatctcttgcagtagcgctcgctttcctgccatgcctgtggcattggctgtccactccctcccagcataggctcttcctcaccccacagcaacttctctcgtcctccccctacctgagggcctgggccaatggacctttctcaaagcctggaactcacccaccctgggcttctggttcctttctctgctcttgtgaaactccccagttctgtgggcagatgccctggcagcagcagcaccaagcaagtagctacaggccaaaggccctggtgcccactcctgccgtcagcactcagcaagccacagccaggaggtctgtttgcccagccgccgtgccaggcacctttgctcccagcatcccctccacccccacagctgccccagcacagggaggcaggcagaagcctgcaggtggtggtggggctctctatggccccacaccctgattagtggctggagagaacttctaagattagagctgcaaggcctcaccctttggggccttcaagaggacttgaaaacttccatggacagaaatgtcaaggctgtacatgctggaggaggggtggttttgcagagaaccaaagaggtctagtctttctatattccacagtcccatgtctggaaacctggatgtggagacagccacatagaggagtcctctccacatctcacttccagcgctatgagagctctggcatcctctcttcaccctgatatcttcttcaggatcatggaacatcagggtagggaagagaagagaactaacatttagtgagcatctgctctgggccaggcatgcatccagttctcaaatcagttgatcctttgaggcaggtattattacttcccccacctgcatgtcaacacacacagacacacacacacacactttatggaggaaggtacaagaaaggaaccttggaagaacttacatggtccaaatctctcattttacaaacaaaagaacaaaagcccagagagtttgcccaaggtcccacaacttgttcttgagaaccccgactccctaaagcccagatcatcccccctctcaaatcctctttttcttcttcttgcatgtgccttccttttcaccatagcaaacccaatttttcttcacacagtggagtgggagtctccgtggcaggaggacccccgagggagccccgagtgttaaagcccctcctatcttggacctttacccccaaccgcaggaggaaggtttcctggaggagctgctggccagccctcctgactccccttcccaccccacagtcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccgggtatgtctgcctgctgggaggatgagccggtccagaggagaagcactagtggagccagggcccagggagtagggacagagggcaggggacatcctgaacagaactggggtagggacggaggctgctctgcccctggcactgggaggcttcgccttcctgtagaccttcctcaaagccattcctatcagagatcagggccaaggtaggaaggcaaccccaaaatgtgggtctgagaccccatctttcccttccagcctccagttcgtgtgaatgatggtggagggagccatccttccaggcccaactccagacacactcccagcttctctggggactcctcctcctcctgctcagatcactgtatcacctcttcaggtaagcaggacttcagtcctccatagagtaagggagcgggggcgaggagtccaccgcaccctgccctggggctgctggatggaaggaggtggaaggctccctaatggaaacttacataaatactgtgcgctatgcagcgtcttcacaacagcccctctgttacagaaaggggtgacttacccaagggcccacactggggaagaggccaagctgggattccagctgtgtagcatcagcctcccgggcccatgctgtttcctctaagccaggcttcagcccatggccccctccgtggaggtgacctgcttcctttacgtgatattttaatcctgggcccttcagaaggtgaaatttggagtgggaaggtgaacgtgttggtcctattgaggtccaccttccacttgagctctggggaccactctggccctggaggacctgtcccctccagctcagctgagagtctgggaggcatcatgctttccttcctttctttttttttttttttttaaaaaaaacacatatgtatatttagaaaagaaattgtgctgtatacaatctgatgacttgcttttttttatatggcattgtttttccataccagttagtacgcatccagaatataatttttaagggctgcatagtattctggaatacaataatgtacctaatcccctaccattggatatctggattatttcctcagcattttaataagaaaacagtatacttgtagccaaatatttacacttatcggaaattttccccttacaatgaattcccaggaagtgtgactactggtcaaagagtacacacaattatttgactaatgtcaaatagctttctagagtaccttcagtaatgtgcacctcctttagcaccccagccctcataggcattgcctaatttcctgcatctttataaatactggcatcaatatttaaacatttttgtttctggtttgtaggtgaaaattatagatgttctacactgcagttctttgaccattagcaaggttgaacatttttttccatgacttgatgggtcccaaattctttcttgattgagatccataggaacagcacacagtctgcttgaggaagtctcattgctctgagtgtctctggctctttgattttactgccttatgctgctgaaagaggcagagagagtcccagagggaagcctggggctgaagggtgacctgtggagtcactgtgggattcccagctggctctgctgccagggcacaccaggtttttgcagggtctggcaggagggggcctggtccaagtatccttaaatagctccttctcttccctcatctctcccagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcaggtaagaaacttctgcaatctctggggaacagagtcagagtcctagactgagctacaagaagggttggagatcactcatccaccacttcttttttttattttttatttttttaaacggcatcttgctctgtcacgcaggctggagtgcagtggcgcgatctcggctcactgcaacctccgcctcctaggttcaagcgattctcctgcctcaacctcccaagtagctgggattacaggcaccagacaccacgcccggctaatttatttatttatttatttatttatttatttttattttttttccagacagattctcgctctgatgcccaggctggaagtgcagtggcactatcttggctcactataacctccgcctcccgggttcaagtgattctcctgcctcagcctcctaagtagctgggattacaggtgtgggccaccaagcccggctaatttttataattttagtagagacggggtttcaccacgttggccaggctgctctcgatcacctgacctcgtgatccaaccaccttggtctcccaaagtgctgggattacaggcatgagccatcgcgccctgccctaatttttttatttttagtagagacggagtttcgccatgttggccaggcttgtctcaaactcctgacctcaagtgatccacccacctcagcctcccaaagtgctgggattacgggcatgagccacagcagccagcctccattgcttctttaaaatagagattcagaccctaccctagacctgcgaaatcagaatctctggcgtaggcccagaaatctgtatttagaaagtgcagcctgtcttgcgttactctgcaggccagcactggagagctagtccatccccgcactttctggatgatggtgtggaagcccagagaggtccaatggccagccaggatcccttccaggtgttggagccagcatgtcagagccaggcctagaactcccagctcactgctgtgttcactccagctggcttgactggaatcctcatattatctctttaaattcaacgatatgattcctccacaccccaactctgagagcagaatgaagtgatagagagaagggcttggccatgtagacttgtgaaacagtctaggaatcctggagagagataggtttactggcatatatgaccctggcatccttcaccaaaatgtacatttaaagaccatttcctggctgggcacagtggcacatgcctatcccaacactttgagagactgaggtaggaggattgcttcagcccaggagttccagaccagcctgatcaacatagtgagacctcttctctacaaaaaaaaaaaattataaattagccaggtgtggttgcacatgcctgtagtcccacctactagggaggctgaggcaggagaatcacttgagcccaggaggtcaaggctacagtgatccatgatttcaccactgcactccagcctgggcaacagagcaagaccctgtctcaaaaaagaaaaaaataaagaccatttcctaaccatactgatacatttttgccaaaatatataagtataaggagttctactggagaagggatcctcctttatcaattcattcatataaatttcattcatttattcctatgtttcattgttttaacactagtactgtatataatacttatatttaaatactcatgcagtgttaattttttttttcttttttgagacggtttcgctcttttcacctaggctggagtgcaatggcgcgatctcagctcactgcaacctccgccttccaggttcaagcaattctcctgcttcagcctcccaagtagctggaactacaggagcgtgccaccatgcctggctaattttttgtattttttttgagacagagtttccctcttgttgcccaggccggagtacaatgacgcgatctcaacttactgcaacctctgcctcctgggttcaagcaattctcctgcctcagcctcctgagtagcagaaattacaggcacgcaccaccacgcctggctagttttgtatttttagtagtagagttggggtttcaccatcttggccaggctggtcttgaactactgacctcaggtgatctgccagcctcagcttcccaaagtgctgggattacaggcatgaaccacccacgcccggccaatattctttttttttttttttttaattgaggcagagtctcgctctgtcgcctaggctggagtgcagtggcatgatctcggctcactgcaagctccgcctcccgggttcacgccactctcctgcctcagtctcccgagtagctgggatgacaggcgcccgccactacgcccggctaatttttttgtatttttagtagagacagggtttcaccgtgttagccaggatggtcttgatctcctgacctcgtgatccgcctgtctcggcctcccaaagtgctgggattacaggcatgagccactgccggccaatattcttaaaacaatagagtattgacacatttaatagatgtgttgggaaatggctatatttatgtatatttgtatcttcattcttccccaaagttcatttggtatattgccataaaatacataaacaatatggttgagaaagagaagtaaatcaatctcaagcaatgttattgtctttcaagtagcagcaatagctgtatttacggcagaaggggcaaaatgcttcctagatactaatgctcagattcagtgctggaatatggggagctggaaaatgagttaacattgccggctctggatggaaacagattatgaggtgccatatattggtgtatggccctcttagctgtgtagaaaagccatgagttattgccgaaattaatgccttgccagtgagatgatggtcattcacagagctaaacccagaactttccagtttgtttctgccctgagaaaactggctctgtgttattttatgcctctcaccaacccaaataacagaaatttttcgatgctcttcccctggaattaatgtgaaaatggtgaagaagagaaaactggcagacagtgctgagacactcctactgcattgcacattttggttgtagtgataggagcgagggcccctctggcaggcaggcaagcaggagcaagcgacagatcttgtgtgagcccgggcattgctctgagcccagggtttaccctcaagaggctttctttggaactgacaacacattccgtagagcacaagttccaactccctcctccacgcttcacgttactgtttgcaaactccacatattccaaagtcttgttttgtgtaaacagctagggaaaaaacacagaagcactcggcttccatcctcatgtcaggcagcagtccttgtctacacaggcttcatccttccctgctctagtggggagtaggacagagggcccccacggccctttccagatacagtgattccaggttcagtgattccaatggtggctgagattgcatacacgggaaagctgccctaaaaagaaagttactcattaaatcggattactccaatgctgcccccttcactaaggaaccccagcctccaatttctcccatgctcaaggcccctatccattgccctcccacatgtaccctgacacaaatagcactactctcagtttctcttcccgaggttaagttgaagtctgccctcttcctttcatcatgttctcctctgtcccctagtctgtccttgcaactcatggctaaagtgaggtacatatggcaggtacaggagctgcccagccattgatgcaaaatgggttaaactgatcctgaacatgctagggttggcttctctgtcttcagtatgacttgagaagtcccagagcagaaggtatgccaatgaaaatggagcaggccttgctaagagagcttgcagggacactggtatggacgctctctgtgactggacagaggtgatgctgagcctggactggagcccaaacctaggctccaactgggcccagggtgggccagcccagtagctctctggttctgctgctttccacacttaggggttctattgttccaagacatagaagaacagtggctgcatccctggtggctttgatcttgctgcctgcaggcaggggcggagggtgtggggaaggcaggatgagacttctgtgtgggtgtgtgggggcacaggatgagtctccagtgggggcatgagaccaacgtggggcagggctggatgggctgttcttggtgtgaactgtgctacagtgtggccttggcctgctctctcctcccatctctcctcccttagcctctcagtctcaccccacaaatctccctccctgctggcactgcaaatgaaatgcatggaggaggtggcatcagcagcagcatctaaatggccaagagcagccttagatctgaggacttgggacccccaggcttcactgacaagtaaagtacacaagagaccaggccacataagctgcagccctgccctcttctgctaaatgccttcaccttcattgccatttccatacctagggaagagccctgggggttatcatgcttccttcgtgctgtgccctttctccacattcatttcttcatccatccaacaaatagctttcttacataaactgtgagggacaaaagttgttgagaagacagtccctggcatccagggatttggtgtctgatgaaagagatagacatgtaaacaattgctgcaaggagataagagccctgctacaagcctgctggaggtaccgtgggaatgcgggaggggaggggaggggccgggctctgcctgtgggggtgggaaagacgaaacagcaacacaattccagtcacatctcgggtgcccagaagcggctgcaggcgtgaagacagaggagggtgtaaatgtcacacaggtgagggagggggaacggagctgtgctggtgcctatcatcgtggaacaagctctcttatggcttcccctgtaactccacctctactcccaccacgccaccatccctggtcctggctgtgagctgtatttagaaaggccctgtatttccaggctgtgggcagtcatttggggtcgttttgggtttgtgttcctagcagcaggatgtctggatcacaaaagcagtgatcccactaaaacctctctggcctgcatccatggaagatgtgttcactgctggccatctgtttgagtggggcactgaacaaaaggctatgtataaagttattcctcccagaattacctatgatagcaaaaattggaagcaatcaaaatgttcaaaaatagataaatggaagactggctcaataacttagagtatactgttatgatgtaacatcatgcaaccctctaagaactgggctaaataattttgagtgatataggaagtaggataaagaattagtataagctccagtatgttaaatgtatactccctctctctatgtatatttgtgggtatatatatatttgcatagaaaaaagacaggaaggtgccaggcacggtggctcacacctataatcccagaactttgggaggccaaggtgggcaggactcacttgaggtcaggattcaagagcagcctggccaacatggtgaaaccccatatctactaaaaatagaaaaattagccaggtgtggtggcacatgcctgtagtcccagcttctccgcaggctgagacaggagaattgcctgaacccgggaggcagaggtttcagtgagccgagattgcaccactgcactccagcctgggtgacagagcaagactgtctcaaaaaaaaaattaaaataaataaataagaaaaaaagataggaagaaaatacgccaaaatgtgaagtgtggttatgagcaaatttaatttgtttttacatttttatgtattttccaaagatttgataatgagtatgttttacttgtataatgagtcaaaacaaaaatggggatggtgttcatttttgtgttttaaatgtggattgagcatctagagaaaagtgacaaggatggtgagatgttagacattgtgtcattagactatctgaaggaggacacggcagttttcctttttaaaaaactccattagttatggttcaaaggaagtcccatggctagtggagaagtctggttctgggtttattgagcacaaaactgtaaaccacaaatgagtgtactatcacgtggattgtagctcaatagaagaggtcattaatctcggcgctaacaaccccatggctgtgtccagaggccctgagctccctgaccctaggagagtcctgcagaggttatgtaggagccatctctaagagttcctaagaggggccctccaactctagcacgttgtgattttttttcaatacagatcctttgctggccatcctgatcatgcaagccttctcatttcccaccatctatcacccattgatacaacactctcatcagttaatatcagcttcccatctttatatataaacatgcagccattgacggggtgacagcctatctgcaggatatccaggaggaagtagacagtcaggaagagaaagggagtaaaagccagaagcaagctgatttgtgagccctgccttttcctcgccattgttcagacaagcccattcctgactcagaatagtggaactagtcattggcctctcaaatcatcaacgcatctctattgatcatcttgtgctgacggctcaatggtcagtgtgtgggcaacagtaaggtgattaagaaggaggtgctggcccccaagtaacttacaaacaagagtagaaaacaagtggccgggtgcagtggctcacgccgtaatcccagctccttggggaggctgaggcaggcagattatctgaggtcaggagttcgagaccagcctggccaacatggcgaaaccccgtctctactaaaaatacaaaaattagctgagtgtggtggcaggtgcctctaatcccagctactcaggaggctgaggtaggagaattgcttgaacctgggaggtggaggttgcagtgagccaagatctcaccactgcactccagcctgggcaacagagcaagactctgtctcaaaaaaaaaaaaaaaaaaaaaaaaaaaaaggagtagaaaacaagcatgtaaagagcagaactggaggagacgggcaaaataagagcaccagcaatgttcaaggcatcacaatgacatggccctaactgtgctaaagagtcagaaggtgcggggctccagtggaaaacacagtggattcaggaccagaaaaacaaaaatggagaattagaagggtattcctggctggagctgtagtatgctgaaaggcgtggtgatggctgggtgcagtggctcacacctgtaaccctggttctttgagaggccaagatgagaggatcacttgaggccaggaatttgagaccagcctgggccacatagtgagacaccatccctacaaaaaaaatttaaaaattagctaggcgtacacctgtaatcccagcactttgggaagcctaggcaggcagatcacaaggtcaggagatcgagaccatcctggctaacactgtgaaacctcgtctctactaaaaatacaaaaaaaaattagctggccatggtggcgggcacctgtagtcccagctactcgggaggctgaggcaggagaatggcgtgaacctgggaggcgaagcttgcagtgagccgagatcgcgccactgcactccagcctgggcgacaaagtgagactccgtctcaaaaaaaattagctaggcgtgatggtgtgcacctgtagtcccagctacttaggaggctgaggcaggaggactgcttgagcccaggagtttgaggctgcagtaagccataatcattctgttgcactccagcttgtgtgacagaacaggacactgtctctaaaaatactaataaaagaaattagctgagcatggtggcgcatgcttgtagtcttagctattcggaaggctgaggtgggagactcacttgagcccaggagtttgaggctgtagcatgctatgatcataacactgcactccagcctcagcaacagagtgagatcctgtcacaagaaaaaaaaaaggcacagtgagaacacacagcatctgaatgtggagtggcatgatgctgctagaatggaaggttggtggagtttaccatgggaaagggagttggaatgagaggttggagccaagttagggagtgtgggcctgatcctagggtgtttgagagtcagtgaagatttctgagtgcaagaggacattgacctgcagcagtggtaagaaagatgaatgagagactggagagacacaagtctgggattcctgtaagaggctattggaaaagacgctggagctctgaaccagggcactcctggtaggagtgggaataagatcacgggcttgagagacatcctagagacagagttggctgaatttactactgagaaggactggaggacagtaggagggagaggaggagaaaacttgggtgttgttgaagataccatggccctaccttttgcagaccaccatattcatgcctcaatgctgggaacttccctgggctccgtttcctgtgccccatagctctggctgcttggtctctgagtttttcttgtcttagtaactgagctacttcacttctggccttggcacatgatcacagtgttgaactgttctctctcaaggaacactcttgtcccttccagccagcctgcaagctcctcgatgaaagacccagggtgcatgttggtgcccagcaggtgtatacctgtcaaagcactaaactgatttgtgtggcttgaaggcgtttactggtaacctgacctccttccctccctcccctgcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaaggtatgcctagactccacctcctggggagtctttttcagctcccagattctggctccacccgtcctggggtttggctccaatcagatacatgggagggagttaggcaccaacagggagagaagggcgagggtcagacccatggggttggaggtgggtgggcggctcctcagctctgcccgcagtacctggccattgtctctcacagccggacacagcctggagctgattgagcccctcatcaagttccaggtgggactgaagaagctgaacttgcatgaggaggagcatgtcctgctcatggccatctgcatcgtctccccaggtatggggccaggcagggaggagctcagggacctggggagcggggagtatgaaggacaaagacctgctgagggccagctgggcaacctgaagggagacgtagcaaaaggagacacagataaggaaatacctactttgctggtttgcagagcccctgtggtgtgtggacgctgaggtgcccctcactgcccttagctctgccttgcagagtgtgcaggcgattcgtaggggggattctgaggaactagataagcagggttcctggggccacagacaggcctgcgcattcccaatactcaggctctgctcttgcgtgaactgggctcaacattcctgttatttgaggtttcttgcgggcagggtacaaaactttggagcctgagagatggttctgcctatatagtttacctgattgattttggaggcaatgtgcagtgacccttgacctcttccgctggttagaggtgagaagagggagaaaaggccgaagaggaagttattgtgaccttggggacatgatgtcggtgatgaggtccaaagaggggcggccctgcctcagcctgtgctagtggcctgtgcccagggatgctttcctggactggaggctcaaggaatggagatgggctcctctacccctgcccagccagccttctctcattcattcatccacttagcaacaatttattgagcacctattaggtaccaggcactatgctaggtactggggttcagcagcaaatgggacacaggctcctctcccatgaagcttaggaggaaacattaaacaaatgttatttaattattaattcctaacaaggcaagagttttaaaaataaagtaagtgatgctacagaagggtagaatagaaggagggaagctgacgtggtctgggctacagaggtagagtgttgccaggaatggccttttggaggaagaccttttaagctgttatccaaaggatcagtaagagtctggcaaagatagcagagcagagttccaagcagagggagcacagatgtgaaggctggtggccagagagcatggcgcatcgggacgctgagggatggacagagcatggacagggagcaaggccaggcagggacagggccaggtgcgcccatggaaggacctaggtctggatcctaaatgcacggagaagtcactggagggctttggggccaggcagtggtatcaccggtcagcagtcatagaggggtggcctagggggtgctgccgttgagtgtctgtgtgggtggggggtggtgggattgagccagtgaggggcccagctgagagctcctgtgccttcttctctatccccgtgcccacagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctccccctgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattcaggaaaactgacagaggagggcgtgactcacccaagcatatataactagctagaagtgggccaggacaggcccggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaatttgccttatccttataaggaccttatgggagatgaatcattattacccccatttgacagaaaggatagcttgagcaatgccacactagcaagggatgggatttgaaccttcagcagctaggttcagaagccacaaattaactgctacattgtcctgcttcctattgagttgggggacctgacagacgactgatggtcttgctagctctctcctagagaggagataaaagaggttcccattcctaaagcaggccctgagccaggaaaattagaggtgctggaccaaactgtgctctactcccaggaagtgtgcagtcaatatatgacacctacgtgagaccctcaaaaatgaaaaccaaacagctactggcaaaactgtgtctgccattagagatggcggctgtgccagtgacctggaggattacaaatgactgctgtgcagaaacaggactcctaaggggcccaacttatgccgatgcactccattctgcttcccaaggaagtggggtttatgatgaagggtagcattgctaggcacagtaaacaagaacacagcattgtgatctgaaaataaggaaatcatgccagctaatgtattgattgaggataagttggcctggggatgtgattcactctaatttttcagaaacatctgaaaatatttcaaaccaaaggctaaaatgtgtttcagtgggatgagatggacttaggggaattggggttagaacttgagggttattttgtgaaacatgaagggacttagagaaaggaaatcaacagctgcataaatgggcatgtctctggctggagaaatgtggagaatggagttctgatacactgttagaaggatcttatgtagcatttttatagctgacctagaagaacacaaaatttccaaggctgtgttataatgcgcttttccaggtaaaccaagaggaatataccccaggaaggttgcataattaggatcaagtgttttcaagttttcatattccaagctttggttctatgcctacactgttcaatccagtagccactagctacatgtgagtatttaaatgaaataaaggtaaacatctagcttgtcaaccgcacaagccacagttccagtatttgataacctcagggctaccgtaagagacagtgcaaatacacaacattttcttccttttttctttcttctttctttcttttttctttcttttttcttcttttttttttttgagacagagtcttgctctgtcacccaggctggagtgcagtggcacaatctcggctcactgcaacctctgcctcccagtttcaaaccattctcctgcctcagcctcatgagtagctgggattacaggcacctgacaccatgcctggctaagttttgtatttttagtagagacagggtttcaccatgttgtccaggctggtcttgaactcctgacctcaagttatctgcccgcctcagcctcccaaagtgctgggattacaagcgtgacattttcatcatcgcagaatagtctatggggcagcactggtctacacaatgcattcttatctggtactaattgtgaatgactccatgaggatgctggcgtcatgtgcttctgttgatctgtagggcagaatggccactaacttgacatcatatggaagtgctatagggaacatcctccccttacaatgggctatgccacacctggggtagttcgaatgagtctgcttcttaaaagagacataaagcaaaaacactgcacagaccatggggttgataggctcaaagcatcatgtggtataaatagctcactggtgtgctaggagtattgattcctttagccctggagcaagcaaacagggcctgccaggagtgaccacagcccttcaatttccccagcttctaccaggctccttgcaggctgcctgtgcagtgcaggtcggtctgcctgccccatggtccctgcagatgacaagaaggatggatgctgtctgacacctccagcatggccaaggagatggctcatcatgctgacatcctataggcaactagtcctcattgtgggcagggagcccgtgaggctgatggggagtctgtgctcctcaagacccagaagcacagcagggtgtggagcctgtggctggcagggggaatctgagagctcgctgctccagacagctgctccgaatctctgtatgcacgcatgtgatatatgatatacgggatggtgttgcaagttgggttccagggacgtagactctgaaatgcaggttgaagtgcagggagcttgttagggagcagtctcaggattatcagccctggtggaagggaaagaagtagaattagcagtgggagaagttgggctgcaaagcagtctcagtgaaggtctcaatcaacccgtgtggggatctctgaagctgggatggccctttggattgccccaagatgaagtgagggagacacttctatattcctgcatcaggtagtcattggacgcaggctgttccctgaagagcatgtgatttcattgacatgacctcagctaggcggctcttttcagcctgtggcccataggacatgtccataaggggtgttttcttcacattctatacaacctggtgagcacttctggagtgagctgctctggcttggggagacgctggaagagttccaggccctctcctgtggctctatccaaggagagtgctgactccaaaggagggggttcccagcctcccctcagttatggattagctgggttatttttcctaaatcatcttgagtttcaccacgaggtggtgctactgccctacagggatagctttgagccacttgcctggccccccgcccccaaagccccaatcacatcccccttccaccctttctctatctccatgatatgagtgagattcagcaaggctctgagtctctgctactgagggcattctggtggtgcttacctctcctcatgccagcgacatggggttagggatctgctctctggcttctcctcccaggcaacagggagtatctgaccctctcacacctcacccaagggcctcccagggtcttgtgccccgggcctctgagcatagtccgtgctgacagtgagcgaggctgcaggttccctctgaggtccagccaagttatgtagtccttccaatgtttctaaccagccacaccaccgagctcagtgctggggatatggcgatgaacaagacagtcgccacccccaagaaaagcactgtgcagtgggagaagacagccctacagacagatgagtactaggcatgccaagtggaagctgcaaagtgttaacaagttaaaagtaacagttaacaagtaaactgctgtctcccaggcctggctctgccatttgctatttgtatgaccctgggcaagttacttaatgtttttgagcctcagtttcttcacagaatggtaacaataatagtacctacctcatagatttgctgttgttgtgatataatctgtgtaaagcatttataacagtacctggcacgtagttatcaatcataagtgttggccaacatcactattgggttgctgagatggccaaataagtttttatcaaggaggtgacattgctcccacattccgacctccgatccctgatgggccctctagattcactccaggctgattttttggggcgcctcttccggatctcagcttcttggtgctagggactcctgctccatgatatctaccagaactgagagaaggtgtcattgtaccacctggccaccagggggcaggtgtgccacttaataaaccaaattggccccagccgaaagctgcctggggagaaaagtgtgggaaagaggtgggaagataggaatataaatctgaaatgcatggaactctagtgactactgtccccaacttctttcagtcatgttctttatttgtcaatgtcaatccttcaacaatcaccaacacctggacttcactacatgcgtatttactgacctataattaatgtcagtattctctggcaaggggtggcttatgcccagagaaaagggaatcaagacaagtttcaagaatcgggtttgatcgattcatttatccccatgtttgttggaaccctgcttctctgatgaggtataaaccccaccatgatctcttcagtgtcatttgtctttgttccagacattgaaacttaaccgaccaccgtgtctgggtacgtgcagttctctgaacgtgcagctctgtggcttgcctctaaaccagagtttctcaagcatttgggtcctggcatccttttactctcttaaaaagaaggaccccaaagaacttttgtgtgtgtgggttagattcatcaatatgtaccattagaaattaaaacagacatttttaaagtgtattctttaaatgtggcaataatgaatctattaaaagttagaacaaataacacatttttttctttaaaataaccagtttccaaagtaaaactaatttaatgacaagacagtattgtttcacagttttgcaaatctctttaatgtctggtttagtagaaggcagccagattctcatattggcttctgcattcaacctgttatgatatcatgtgtcaagaagcctccggaaaactccactgtacacttgtgagaaaatgagagtcaaaaaggctaataatgtccctgctagaaaatgaaatgcaaacagacttatgcaaatttaaacaccttcctttcaacttcagaacctgtgaagttaattccatgtggcttcagaaacttcatactaactcctctccctaaagtgtctgccacatccccctcattctgtacttggctaattcgtgtgtgtgtgtgtgtgtgtgtgtgtgtgtgtgtgtgtgtatgtgtgaaagagaaggacagaaagagagagagatggtctctctgtggcctaggccggagtgcatgatcatagctcactgcagactcaaactcctgggctcaagcaatcctctcatctcagcctcctgagcagctgggaccaccggcacactcagctaatttttttgtgttttgtaaagacgaggtctctctatgttgcctaggctagtcctgaactcctgacttgaagcaaaccccctcccttcctcccaagccttggcctctcaaagtgctggggttacaggtgtgagccaccgtgcctggccaccaatttgtttttgactaaatgcagaatgtagcatttgtccctctttatatttatctgattttattatcccacactggcctgctcgaatgttttgaatcctcattttgtcatccagtattctcaccatccctcctgctcttgcatcttccaaaagctaggtctgcagaccatattcagagttgactgagacagagccaaagactgtgtcctcttgcaggttaacattagctcatgaaccagaagctctttggttcagttgttcaagacctcaccgataaggaagggaagcgggtgggtaatgagagactgagcctcaggtgaggggagtcattggaaagactcaggtaccacaggaatgcggggaacttgtcaatgctgccacagcccctccctcctcaggactcaacagcctcactccaagtctgaacagactctttaagaattagacagatctgagccaagggtcacagatccagggttatttgatctaggggatgcacaaggggtggatcaagtatcaaatttcaagctgggttgttctgcaaattgtctgagctggactctgggaaggaaggcatggcctcctagatactggttgctgagaggaggaaggcaggaagaagctcccgtgagctcctgggggtagtgggcagagctccccttagacctccagaccttggtggtgaaaggagaagtcacacatagcctggtcgacagcccttatttagctccgtagggcctccccgctgcactcttcacttgcactcagaagcctactgggcctctggaaaggcccatgccaccctgacccaatcccaaatcctggctggacatggtggctcatgcctgtaatcccaacactttgggaggccggggagggaggattacttgaggccaggatttcaagaccagcctgggcaacatagagaggcggcatctctacaaacaaattttaaaaataaattagctgggcctggtggcatgtgcctgtagtcctagctacctggggggccaaggtgggaggactgcctgagctccggaggttgagtctgcaatgagccatgatcgcaccactgcactctagcctgggcaatagagcgagagcctatgtcaaaaaacaacaaaaacaaaagaatcctgcagacacctgtgaacatctgtggcagccggcatggggctagggccaaagtgagggcaggtgccccaactttgtcaactcctgactactatttccccatttgcctactaggctggccagatagatcaagcggcctatcaggaagggcttggtcccctaagccactggcccagcctggcaaggactgtgagccccaggttaagcgtgtaggggaaatgctcctggtatcctttctgcttcctccacttccccaagccccactgatttacatgtctttccctctcctacccaggagcccccggagagggacagggaggggattgtggaggccctgggtgataaagtagggatgggggagaagtgataaagggggtgggggagaagccagctgcacttcctccctgatagggaccccaccccaagaggctcctgcctctgctgtgttcacaggaaggactggaggtggtagaggagtggatggggagggcggtgggcaggatatcagtggcttctgcaatcctttgccttggaagatgacagttcattattttgtccttcggttgttcattcatcagcaaatacttaccacactcctcctaccaccgctggcagagctctgggctgggagggccaaggaggcagattgagctcagtagctctgctggtctcccctccaccccactcttcagccttgagggaggcaatgagtgaataagagatgaactttaacagcaggtcattggaatcctgatagtgtctcttactgactgtgtaaccttgtgggaaatgtgtgagctctctgatcttcagctttctcatctgtgaatgaccatgtagagctggtaaagataacggaaggaaggctcgcagcacgccgcagggcctggccttgtctagggcagcaatgaagagcagcagaagtggcatctagcaggagcaggatttgaaccctggcagtcccctgagtcgctgtggaactgctggctatttgtctgtcttctgtaaagcaaagagagtaatggtacttacttcctaggtgttgtgaagaccacatgagctactatgtagtatttagaattgcgcttggcatggagttcggtgctcggtaaatgttagcctttattactgtaattttcatcatcctctggggaccctctcctctaaagagataacgtctaacctgatatcgtcttccttataagcagctcctccaacacattccaagtcagggatagacggggtagaagcagggattcacaggtggacccctcttgtgaaaggccaagctggccctcaacccagctcctaggatggcagacgcacgcctggcccggcccatggtgccaacaactccgcttactcccccagctccacggtgttgtgctggtgggtagtgcggaagacctgaggtctgccccattatctcctcctgcaaagcctcctccacccgttaacccccaaccgagattatagagcctcaactgtctccaactgctctgattcagggataaggctggaccttcgagcccatcagccccacagtgttgaggggaggctgcctggttccctgggagctggcgagctggggaagttggaccacggcagaggctggggacacccccctgcccacctgcctgcctgctctggtgttgcctccagaacttgaggaaaaaagtgatcctcctctggggagaggccttcctgggttcactaaggctcttttctcccatctctgtctttcctgtctacctcgctggctccaggctgcttctactgtttctacttctctctcaggctgctcttccccccacccccagagcctcgaagctgcacacctgtctcctcacatcagataacccgaccacagcagctcctgtcaccccagccaggctcccagcagccccccagctccctcgcccatcgccctcttcctctcctgccacccccaccttctagctccctgacacacctacacagccctggggagggactgggaggggaaccccaaagccttactgggtaatgagggtgtgagaagacagctcttcctactccccaacatacacgcgtgcgcgcgcacgcgcgcgcgcgcacacacacacacacacacacacacacacacggtggaaactctatacccctgtgcctagtcagaaacagtgacggggagggacccagggaccaggcctcgaggtatgaggaaaatccatcctgcccaagtgagggggttggggagtcacagaaaggggcagcttctggggctgagggttccactgcctcctgtttttaggcaaagagtttccagggcttcatctccaagtcctaaggctagaggcccccagcagggccctcctctggtggagctgggctggggaggtgggtgggtgccatgtggacctgccccagccccttcccactgttcctcaagaggccaagtggggaggaggttggggggtggttgtgggggcagcggcgctgagtttgggatgctggggctcagggagactgggtaagagctgggcaggacaccgtgggaaggggagtggtgggacctaggagggaggggaacaaagaccagggtgcctgggagctggaggttttaatacctcttgacaacaaatgaatcataggcaaattctgtggaaatgatggcgtaaagaaagatgtgttatttcaaggccccagtgtgttgttgtgggaagagagtggaacggggaggagcaggaggcctaatggcgcctgtaggtgggggcccgggtagagttcctgggggcgccgtgaaggtgatggcccctgcatctcatgtcaccttcagggggtgatgtgaaacagcaggtggccgaccacagcccgccaacccccaccccaaagcagagaggccctcatacccgctgagctcacctcactgtgatgctctgttcctcctgcagtcagccctgtcctctgggggctgtccccacaggcgcctgccatggcctgctcctcagcagtagtagaggagactatggagctccaggagcctcccatatatgggagggaatctgcagtgagcacctggccatcacccctcacggtgggctttttcctatcaggagaatgctgagttgatacccacagtgaccgcacctgccttgcggtcggagctcagtctattaagttgccagataaatgcatttgtggcctctggaaggttgtcagggcccttgctatagctgagacccaaatctcagcttctggtcaaccctcattcccgctctccgcaatgttaagactcattaaatgagaccaaaaccatatatacccattccaccctacataatcattacctatgacacatatttcctcttcaccttctcctccatgcctatatgttttttaatacagttgcaatcatggggtatgtaccaatctctattctcttgtgatgctgtgttgcatataaacatcttcctaacagcttcatagttttctattaagtggaaatatagtatcataatttacctccacaattttccaatcataagtgttcaaattgtctctaattttctatattataggcagtgtgatgggggacatcattaggcacatactccgctcctcctcccccaattttgactatagaaatctagtttaggatacactgggtggggttattgagccaaagggtaacagcacattatagctcttactatatattgccaaactgatttcaaaagaggttacgccattaccgacagcacacacacttcaccgagctctcgctaatgtttcaaaaaggcacctacctttgtctcattttaattggcattactttgaggacgatcaggttgaacatacccctacctctgcttgtgagttgtgtttcctctgtaccaggagagtctgtttctgggctttgaactttagtctccactgttctagtgcttcttaacagtttgtgtgagctctctttataagaatgattttagggccgggtgcggtggctcatacctgtaatcccagcactttgggaggccgaggcaggcagattgcctgaggtcagaccagcctggccaacatggtgaaaccctgtctctactaaaaatatagaaattagccgggcttggtggcgggtgcctgtagtcccagctactcgggaggctgaggcaggagaatcacttgaacctgggagtcggaggttgcagtgagccctgatcatgccattgcactccagcctgggccacagagcaagacttcatctcaaacaaaaacaaacaacaacaaaaaaatgattttaaagcattgtcaactgcaaccgtgtgcgagtctctccttcttgatattctctcccacttgggattccgatgcacttcctcttgcttcattgaaatctgtgactgctcccggcctgctccagcttccactcctcgcccatctgaagtctttgttttctcaggtttctgtatttagccatcttccctgccctccccttctctcctctcttctcccctgctcttgtggtgtcattcattcctacaatttcctctctcactgatgacctccaaattcttccctgagctccagataccaactgtccactcaacaaccccccttgctcatcccaccaacacctcaaactccacctgtgcaaagctccattctgcattttcctccaaatttgcttctcctcccatattccttaactcagctactcaaatacctttgggtttggagtcgcttttggaagaggaaagaggaaggtggaggctaatgcgcctgaagaggtaatcggattctatcaaccttctgctcagagaaggagcactgggaagggcaggagaaggccagttgtcagggaagatgctgctctatgcctcaatttccttgcctgcctggacactaaaacggatccaggtctagagatagatgcttgaaacccaaagggagtggtcaccctcctagagcaaattaacccttaacactggcctcaccagctttttccttcacctcttgagcctcttccccaataagagactggaagggatgaagaagaggtaaagctataagtctaaacttgtgctgtccatacagtagccagtggccacatgtggctactaagcacttgaaatgtggccagtcagaattgaaatgtgctgttagtataaaatatacactggctttcaaacacttagtatggaaaaaaaatgtaaaagatttcattagtaattttttattttgattgcataccaaaataatgttttagatttactatattaggttacataaatatactactaaaatgaatttcacctgtttatttttcctttttttgatgtggctaatagaaaataagttacatatgtggctcacattccgtttctattggacagcgcttatctagaccctcccagcaggtgaagtgtggggctccaggctcgggagacaagggcagtacatgacagacacaggtgcaggccctactacaggtgtgggccagccagagctccaaccagatgtctccagacagacactgaaggacagattctcagtggccagcctcactcaggcgaagcaaagccaggcaacatttcctggataattccttcagtctttgacttcatgagggtctctggactgaggcttagctctcctgagcttgtccctgtagatgccccattattctggaaaaacactcacccaggaccacccagacctttggatcccctcaccttgatagttcattggaagatttttctatcactccacctgggccaggtcctggatctctttccagaagcccagaggtgtccttcctcctgtctagagccctccctcccacgcactctgtcttaggcttagctcaccacaggctgggaggggatgagagatggaggtgtgctcaacttgacctcgaacttccatgtacactacctgggtcacaggcacattttgagctccatttctaatgcctatagaagggaacaggaggggacgaggggtggcagatatactccattgggctgcccttctctgtctcattctccttttcctgtgccccggctgcgccatttgagggcactgaagctggggcccagtctgcgtgggtctgcccctccctctccttgcctagatgactccacctctcccaggtcctggctgggatcccgaaggccccaggcaagtgggggaaggggagccactcccactttcccagaagctgctgctgcctcttcctgttttgctaaaactctggctctggactcaagcaaagagggggaagtcaccagcctcctgccccccgccccaaaaggtcaaccttgcccccctggtcctcttatttatagcccccactacccaccacccccccaccccccggccccaggccctggctaaggagctggatgtctcctccctcaaatagcagctgtggccattgccccagggatacagccagatgggcagatcactcccagatgtgcagtgtttcgggaggggaggccaggccctttctgcagtccctgtggtactccccgcagcctggtcctggttcccctcaacttcaagacaacacttgaggatttcaggaggatcaggaaggttgcacctattttcccatttctgtagcctggccaagctaccctgtataccctagaaaggtcagcttgggcgataggccctactggattcatttgcataaatcagctcagtgctcactttgagacctcaaattatagaggaaaacaggcttagggagacagaagagacaggacactgtctctcttctattactgatgtgagcattggagctctgtccctaacagcccaatgtgtgccaggcactgtagttaagtacttcatgtcccaatctcatcggtcctcgcaaaaccctaatatagcaggcacttcataccctaatctgcagatgggaaaccaagactcctcaaggttaaataatatacgtaaggtcaagcagtggggaagcaacaagctccagcccaagcagctcgacaccaaatccttgctcttaaccacagtacaacacctcctcactctgtccattcttctgggtacttttaaatgatctctttttttctttctttcgttttgaggtggagtctcactctgtcacccgggctggaatgcagtagcacgatctcagctcactgcaaactctgccttctggattcaagcaattctcctgcctcagcctccggagtagctgagattacaggtgcctgccaccacgcctggctaatttttgtgtttttagtagagacggggttttgccatgttggccgggctggtcttgaactcctgacctcaggtaatctgcccacttcagcctcccaaaatgctgggtttacaggtgtgagccaccacgcaggcctaaatgatctcttaaaagctcagtgcagggggccaggcatggtggctcacacctgtaatcccagcactttgggaggccgagacaggtggatcacctgaggtcaggacttcaagaccagcctggctaacatggtgaaaccctgtttctactaaaaatacaaaaaaattagccaggtgtggtggtgtgtgcctgtaatcccagctactcgggaggctgaggcaggagaatcgcttgaacccggaaggcagtagttgcagtgagccgagattgcatcattgcactccagcttgggcaacaagagccaaactctgtctaaaaaaaaaaaaaaatgctcagtgcagggaaccctggagcccaggactcagggcctgcccaagggagatgtctgcacattgtctctgcctcctctgccttcccacccctagccatttagaccaagctggagtgagggatctgttgaggcagagatttctagaatcactgttctgggtttcctcagaccccaagcacaaaggagagcaggtgagggcagaactattgccccaacccacattgatcccaggatccattaggtgtctcccagcttggaactctggtgactctgaatcctccctctcctttgcagcatatgttattcgagtccctcatccaaccgttttctccactccaggttctgttcttagattgtatcctgctccccaggaggtgatgaattcctcactgtggcttttttttttttttttgcctctgtgcctgagagtctgacacggtgcctggcaaagagtagatgctcaacaaatgtgtgttgatgaagaggagtataatggtgatcatcatgggtggagtttttcaaggtctcagccagggcaccctcgctcacctcccagcttagccaccctcagctcattgctctctttcctgcctctagtctcctgactcacaggtgcataatccaaactcaccctaaaagacactcctggggaaagagaggtgagtgtcttcaggccaagaccttctcaggggtctctcctggagattctggagtcagaggtatgtgcttccaaagaagaagcattgagatttgtagtaaagtgggaacctgttgaccagccaatatagcccctggggcaactggagggttgtgttggggcatatggcaaggccgaagctgaagcctgccagtgggaggaccacagcatccctgcaggggcccagtggagcaagtaatggtgagctggctgcagaaaggcattttgcaactcagacgaatttcttctcactcatgattagagtatggcccagtggctgcctccctgaccataatctctgctggcacaggcatctctgggctgggcagcccaggctgtggaaggagcgctgacctggaaaccctggggcttgagttctctgcctgccctggccctgattaaccgtgtcatctctggcaatttacgtcctcctcatgtcctccgtttcctcatctgtaaaaggaatggtttggattagaccagggagtcccaaacttaaccacaccttagaattacctgtggtgctgcaggttcctgggtactatccaaccttctcaaagagtctgatggggtcggggatgggactcaggaatctttttttcacaggttctttcaagtggtttttatttacttatttattttttgagtcagagtcttgctctgtcgcccaggctggagtgcagtggtgcactacaaccttgacctcctgggttcaagcaattctcctgcctcagcctcctgggtaactgagattaccggcatgtgccaccacacctggctaatttttgtatttttagtagagacggggtttccccatgctggccaggctggtctcaaactcctgacctcagatgatccacctgccttggcctcccaaagtgctgggattacaggcatgagccactgcgcccagcctacgtggttttgataaagtgttaggtttaggggatcctagagactagataatcttataaaacacttgcagcttttgggagcaaatattctcgtaaatggaatgggtacatcgtgaggttttgctgctgaggggttttatcagagagcaggtgatgggtagtttattttatcattatcattatcattattattattttgctgctggcattattgttatagaaggatgtggcacctgcccatctgtgtgtttctgccatgaacaaggttctggcctaagcggggcctcgcttacctcagggttgggagtgaagctgggagaggagggtagggagggaagggctttccctggtgggtggggcctcttggcaaggggaccctgctttccctctctcctgggtggagtttggctccacaggctttggcaccaaactctggggctgagagcgtctctccccacccatattcctcccccactttcacatcttagccactcagtcctggggactgcccccttctactcttcctttcccgacttcctccccaggcccctccaatcctgccaacctcattcctgagcctggctaatctgtttgccaccctctgcttccttgcctcgcccttgcacatgccattctccctacctggaatgtcaccccctcttctctccccactctgattcacatctctgggctctttcaaaacccagtttgaccgacacttgccagcttcatggaggccgtgttctgtcccgatgtgctccggtcttccctctttgcgacgcactcatttgcgcttggaataatagaatcagaaaactgctttagactcagaaaaataaatatagatgatctaaagcagccccctcatttgacagatgagaaaactgaggcccagggtggttgcgacttggccaagatcacacagtgagattttttaaatagttggctttgcaagaggctttcaagtattttatgtgtttgttttgtttcctcaacgctctgtgaccaatagaagggcaggtgctttgtttttgtttttgtttttaatgttcttatctccacactcttgttgtgttgtgtatccaggagctaaagtacgcaattgtaatatttgttatgccatcaggaaaataattctaaaactcacagtggtacaaatcttttcatgtattattcatctgatttcaggccagccctgtgaggtaagtagccaagatattgctatttacaaagcaggaaactgagacttagaaaggtgtgacccaggaagttaatggcagagctgggcctaaaactcaagttccctgactcccagcccaggctcctgatccccacaatgtctcctttctagctctctcctgatgctcctggctggggacctggcatagtcaagggggtgaccgttgccgtcttttcattcatggtaccttctttgtcttgggcttgaggagactgtctggcttcctgcccctccccatcctgtcccagtgctttctccttgtgtcccctgccacatagttggcacatagacacatacatgtatattcagaactgcaggtgtctagggcaacagaccacaggggaaaccacatcacctttgttgactctgtagggagatgggggtaaggggaagggaccagcttagttctctccacctgccccagtccccacagtcatctaccctcccaacctgagaccctggtacttatagccacactgtagcctcttcttgatctagccatccaattctggcccagaaggatttggcacctcttctctcagatcctgacatcctagataggggtctgcctgcctgtaccccaaagtcacacccccaaccctactcagaatacttatacggttcccctgattctgctggtgcagtgcaacagagaaaggtgggaaacagggatgagaccacatggctggggtcagaaacttggcatctggaatgagatgtacagggacctcaaggaagcaggctacactggaacaggagaccctggcaatgcgtccttcattattttgacctgctaggaaattgcacaggctctgaatcagacatacttgggattaagtaacttactggctctgtggccttgggcagatcattttgtctttctgagttttactttgctcatggaaacaatggggataataatgagatttaagtgaaagggctttgaacagcgtgcgatatgtagaacatgctcaataaatcctaaattatctttccttccttctttttcttccactccttccttccctctctccttccctctctccttccctccctccttcctttccttccttccttcctttttttccttttcttccttcctttcttctttccttcctttctcccttcttcctttttttccttttcttccttcctttcttctttccttcccgtacttcttatatctcttatgtctggtcccatgaaaccctttatttggagttggggacctaatctcccttactaatctgcaagtcccaaaccctgagaattggcatttgattccagatccagaaactgaaatgcaagatccaaactaacccaatacaatgagtgtccactgagatctcactgaactgaggccttggggaaggagcactttctggttggctttgtgcgaagtgtgtgaggataagtgcaggctggcggaggaattgtggctatggcccccacatctagaaggttgggaacggagggtatcagaaagtttggataattttctggggctttaaatcctggcacaaagtaggcacccaataatatttgttgaatgaatgaatggccctgtcacttactagttgtgcaactttgatcaggtttcttaaccataaaggccatgctttactcatgagcataacaaggattattgttaagaataaatgatctaatgtttgtccaggggatagcaaggactgctacgcagtaaatggtaaacagtagctaactaaggaaagaaggagaggaaaaggagaagagaaggtcaagtaggcccagagtcccaaagggaagcagattggggtgccctcaggctttgtgctggccggagactctagggaaggctcaggaagccaaggcacgtcttttggggccagtctcttctgctaggtgttcagctgagaaagctatgagaggcctggactcaagagctttttaaaaaaaggctccccacggtaaccaggctagaagagagagaggtagcttgcatttctctgtctcatgtctctaaggttcttggaggctttctaatttatcctggtaggggacatgtgacttagaaactggcttaggactctgccatgaggcggggtctggtaagtaaatctggcaggggaaggagagacacagtccagctttcccagatgcaggttgcacatgctgtctttttctctgactatatgttggaggcagtgagtcctggtgtgtagaaagccacatgttgggcactgtgtggacagacaggcagggagatagcctcttaattcagatcactcaaaactcagtgatgagtttaaaaagagaaagaagactcacaaataaatgtatgcacaatgcacatggtagaaatgagcataaaagggcctggctttactacagaaatagctacagaaaagctacggatatgtgtgtgttgggggttgggatcaattgtggagctagacaagggagatagcaggcatgtcgctgggggtctgcagtaaccaagcagtttttctggagtctgtggacaccaaagaggcatttggaaggaggatgatctggcttggaattgagggctggggatgacatacctaaggtggaacagcatgtgtcttggagagtcagcatgggtagttatggggtgaaagaatgtactgtaggtgtccagctggagaagggttcttgaaagtcatgaacatctgtcccaattcaacaaataactcacatcaagtttgaattctgtgcaagacactacaagaaatgcacccatgaccaaggcagtagctggactcagggatatccactcttgaatgctcttggaaggaagagagttgagacaagtagactaggtgggcgaaggtcaatgtataaagaccacacagttcagggaagaattcctcttggctatgggaatccgggaaagcctcccggagaaagtggtatgccactttctttttcttccagtccttccttccttccttccttccttccctccctccctccctcccactagatagggagtgggtcttgaggattggaaagatttcaacagaaggagaaaggggctgggaggacatttcttttggaggcagcatgatgagcgaaggcaagggagtgtggaagcgtgaggacaggatgggaagcagctagcagcccagtctggcagaaataatgatagtaataatagtgactaacactactgagccctaagtaccaggaggcactgggcagggatgtgtatggagtgtggtgccaggttgtaggaggacttgaatgccaggaaaggcttttgggagggtaagttaacaagcgcagaggggttggatctgcctgccgaaggagaactgggacaaggaaaggggctgaagtaagaagtcccacgctgaatatgccggtagcaacagatagtgagtcccgagctgtgcctgagggaagggaatagaatctatggtttgaagttcaccgccagcatggccaagccctcctaggccactgtgggctcttgcttccaatcagacatgactccacctctggggctgcctcaatttttccttctctggattcttggggtttcttaggattgcgggagatagaatggggtcaggggaagctgctccttggtttacaatggtggcgcctcacgctgcagagagcccagtgttcctgcgtggtggacctctccccttcctaggagcagctccagattgctggaggcagacacggctgaccggctagcccaggaagcacaatggcgaggtccttagcccctgacccctgaatctgaccttctctccagctaaaagcggagggagaggcagggagggccactgcctaaagccggccctgagctgagtttattagctgagggagggctggaggcggctgcattccgactcacagactggaacatttctgtgatccgctgtaatgcactgggggacactgggcacattgctgaagtttgactcatagggaccgggagggggaaagaggggggttgtggagggagaggaatgggaggaagagaggaagaggagaggagggaaggaagtcccttgagaaatttctttaaaaaaagaaaactttcaaaatctgcaccacccccacaccctttttcttttaataggaacaggctggacccttccgttcccctcagcaggcatggtgtgtgtgtgggggtgccagtgggggagggctgggcagtgattcaaatcagatcctggaactttcctgaggcaagtcgtgcttatgtgtgtgtgtgtgtggtggggggtgtccgtctgggattccttgtatgggacatgggacaccacgcgtgtcccactgtgcccgcgtgtggctgcgtgcttgtgggctgtacgggtatgtagtgtgtgcacgggggtccaccccgaagccccagtgtgtgctgtgtaaatgattctgccccttgtaaacatggatgcgtgctcgtgtacgttgtgtatgcgagggtgcgtgcgcccaggtagctgggtttccgggaattgtgcacggctcggagcgcctcgcggcggctggggctcggagccgcggccggcgttccgggttcggcgctgcctccccggcagtgcgccgcgccccgccgcgatctggccgcgcgcggtgtctgcggcccgcctgtgcgccgcgcggtgcagtgtctgccggggtggtgtgtcccagggccgcgagcgcctgccccctccctcccctcccccttggcccgctctcagactcagataaagcatttccttccattgtcatcctacccggccggccgggctgccagggccctccccctcccggccccctcccttcctctcgccgtctcacagtcgctctgcagcctccggcgactggggggatgtgaggccggcgccccagccccccgccccgccatgagccccccgctctgagggccccggcccctggatgcacagccccggcgctggtgagtactgggcggccgccccccgccccgccctgcgcgcggcacccagcgtcgcccgcccaggctcggcctccggccctggccccggctccggctccggctccggctcgggctcccgccagccccgcgggcccagcccggcttgcgccccccgaccgcgcctgtcccgcccggctccgcggggctctggcaggctccgggtcggagctggttccgggggccggagggctcgggcctcccgcggggcgcccacatccgcccgccccggggcagctacaggcccaagggagggagttggaggccccggccgccggtgtgcgggccccacgtcccatcacccctgttcccgggggaggacgagccgagggaccggggagggagggacggccgcggtggcccggcgagggggcggtgctccggggcggaaggtttggaagcgcgagggcaaagggcaggacccactgagttggggctgggctttgtggggctggacatcagcgcccccatcccgtggagccgggcagggccctactcagatccttcggcggggaaagaggtcccttggaggggtctctggctgggaggtttctctgagcattgccccccatccttgctcacccatcagggtgaagagacacctgtgccctggtgagctgtggaggtcaatgccggcagcggcgcgggaagcggggcgccgcaggctgtgtgaggggtgggggacaggatgtgcaccccccaggcctggggtctgttggtgttggggagtgtgagagcaggcggcaaatttggcggatgggctgggttcccacgaccagagtttctaggcctgtgggccaggagagagccctctggggcccgcaggccacccagtgccccacccccattgcttcccgctgtggctgcccgtttgggtctgacctccccagccacggctgctcctcactccttctccccgctggctgtcttgcgcacccaaaggcctccccctgcatctggacactggctgtctcgctgccaacgctccctgcccactcccctaggcaacatctgcctgaggcccagctctgcctgccgctttctagggtgagaatggggcatcggccctcagcggccctgctgggagctcaagatcaacttctcagcctgttccctggacttgcatctggacctgtgggaccttcctcaggacccctattcagctatagggctggcaggagactgtgactcaggtccctgccctccaatgagacgctttggcggccctttccccctcccaggactccataggctgctaggctgccgctacccatgggttattaagtcattttcttcttctctgcagtcatttctgagggaaactaaggcacagagtagtcccagtgagtggtacccagcccagtgaacctagactggaaccaggtcttggacctattgggactggtcctctgcctttagtcccctgatgtccctccttgcccagcagggccaggctcagaggcaagctcagagctgcctcctgatgttgcacctggaatggtcctggtgcagtgttctccagaggcctctgtgtcccttattcggcgggtgtctctgtggccaccgggtcttacagtgggttttggggcagggaagtttgcatgtctaagctgttcactccactttgacactgaagttcagtttccccatcagtaaaatggggagaaaattccaagcacacttctcagagcagagcagaagaggttgactatggagaggagaatgaaggtactgtgctattatccaccccctccagtttgcttagggataatggacctcagctttagtccttggtggcctcttggcatggaagctggaactttctcaattctgatataaaacccttgagcaagagagaaactcatgtgtgatggggtagggagtggggaccctctggtagctgtgggcaagcatgcccaaggacttggaagacagaagcctgtggaaccccatctcctctttgccttctttctcctggcctttcattaagggctggtaattttgaagtcggcaggggcctgagagaaggtgagctaatgcaaggcccagggtcacacagccagggaatggcaggcggagggggccagaaccaggccttctcactctgccagtgcccattctgctggcccaccctccacagcttggctctccctggcctgccctcagttagacttcggactgaggcctccagtggggtgtggggtattgctggaagcagggcctgaataaagtctggggctagcgggagggcatctgtcctcccggaggctcccaggactgtgcatttgtgtgtgttggatttgttcactagatggggcacttcctttggggcaggaagctttgatttcctgtggtgatggtgaggaggggttggtaaggattaggagtggggggctcagctctgggccatcctcgatgttgttgtttggaaccacggaggggcagagtttctgcttaagactgcttctcccagctctggggaggcaggaaggagagccttggtgaggaggcccaggccaaggctggagaaggaggctgtgagagcagtgagctgggggtgggcaacacagcaggaagcccggtcagcaggtgaccctgccgggtattgtgtttccttgtaatattttccccctgtttctgtggtaaccttccctggaggccccaggccttagggctacaggaaggtgcccccagacagccctttccttagaggcctgagtattaggaggagtccccagatctagccacctccctaacccttttggctccctaggatcaggggcctgggaatctaggcgagtggcctgagtgagcatggactcgcgggctgggggaaggccctttggcgtcttctggggggaagggagagggaaagaggggagctggacgcccggaagggccctgagcaacttgagtcgctggcctagcctcttgtttcctcccaacccatccccactgccctcctccagtctccctcctcctacaagggagaggtgggtagcatgctgcctggggcaaggggcaggggtgggggtggcagaggtgggagggatgttttcatcagcagagcatagctcctttggtcctggaccagttcccagaggcaaaataaattcaggacagcgtctgtttagtgtgggtctgcatgagatgtgtgtgagcacacactgggtgcgtggtgggtatctgtgtgtgtacccctccccccagaccctgtgtatgctgatgtggtggttccgggcaatttgtgatctatgtggtggttctgtgttgggtgttttgggaatatgcacacataaaagacagatgtgcatcatctgtatggtgcacaccttttcaggttatggccctgtgtggggtaaacatgtccatatgtatggacatgttttttgggggtatatatctgggcaggagtggctttttaatagaagtccagatgctggcttgtaaaacaccatctcatttgggattctcaaatgcgggttcctggaccatttgcttcagagtcacctggggaatgtgttaaagataaagatcctgggccgggcgcggtgacttacgcctgtaatcccagcactttgggaggccgaggcaggtggatcacctgaggtcaggagttcaagaccagcctggccaatgcggcgaaaccctgtctctactaaaaatacaaaaaattagccaggtgtggcgtgcgcgcctgtaatcccagctactcgggaggctgaggcaggagaattgcttaaacccgggaggcagaggttgcggtgagccaagatcacgccattgcactccagcctgggtgacagcaagactctgtaaaaaaaaaaaaaaaaaaaaaatcctggctggacgcggtggctttgggaggctgaaacaggcagatcacttgaaggcaggagttcgagacgagcctggctaacagggcaaaaccccatctctactaaaaatacaaatttagccaggcatggtggcgcaggcctgtagtcccagctatttgggaggctgaggcagaagaattgcttgagcccaggaggtggaggttgcagtgagccgagattgcgccacctcactccagcctgggcaatagagtgagactgtctcaaaattaaaaacattcagatcatcaggcccattccagattgactagtcagaatctgaggggtggggcctgggaatccagattttaacaggtgcttcaggtgatcctggggcaaggctgtgtttgaggaccactgccctgggtcaacctcttcattttttcttttgaggaaatagacccacagaaggtatgtagtttctctaaggtgacagggccattaagaggaagaaccaagagaaaactcaaggcttctaagacctgtccaggactttgtgctcacccatgtaccccctgtgtgtgtgtgtgcatgtgtgctcataactacactttgtgatgacgtggacccgattgggctggtgctaattggggctgatctttcctctggggtcctggctttcttgttttctgaccttgttcttcttgctacattctgctgcctcctttttggagaaatcctggaactgttgagtgtcatccctaaaggtcaatgttggcaaccagggaaccatgttgctgagccagtcactcagcaattcatccattcactggatcctagctgagccttgcaatgttctaggcactgggtacagatatgcagtgaacacacaggcacaacatctgacctcagggaacttccactctcgtggagaagacaaacagaacaagtaggcaagtaaaggaatgagtatgtgtgactagttacacactgtgataagccctaagaaggaaatgaactgggcatggcaataaagaataacaaggtgggacttcctttgatagggtggccaggggaggactgcctaagaaggtgacattgatgccgtctcccacctccccaggttggaagtgagccatcagagcctctggagccgtgcttgtgaactccctggatgcaggtggaggccctgggctgaccaatggctaagggttggagctgaattgccagcctctcacttggcatggaagatggcagtctcctccccttaagcagccccaaaggttggcagaggggagagcagaagggggagctgcacaaggccaagatcaaggccactcccttgcttggggagcaccctttttcttccatggggctgagtccagggccctgtggccatactgaatgttgagaaggaggcagcatctccccaggagctctcctgtttcaccttcctcccacctccttcccttctccgccatctccccagttggggaactactgtgccaagtcccttccctctggtctagcctgctgcctctgtggccactttactttacttggctcaggaatcaccaaagagagggggtcaaggcctagaggggacctgggccctggaagagaggacagaaccagaaaggaaggctggggttgggaccagagaggacagggctcaagggaggatggaggctgggacaggagaggcacacgggaaaaacctgagcccagatggccctttggctgggctctccagagtctctcctgggcccttggaatctgctgcccaaactgggggagactctgagaccagagggccagatggggctgattcaagacacgggctctacatcagctgggaggaaatgcccctgtctggtccacctgcagctctacgcttcacccctctcaggaggttaactttcacatcagcaacttgggtgtcaggttccggctctaggccagcaggcctcagcccctctcacctccaacctcttctcccaggaaggtttttctggggacccagagcttcaggctgcaggaaggtgttgcctggcccttgccttagattattgagtgtcaaaggagccctgactccaggtccgcttttccccctgcacactgccaaggctgccttccaccctgggcctctctggaggctgctcagtgctcttcccgactcccaggccttcccgcccaagctccacagcccccacagcaggatggggagggga

SEQ ID NO: 15359 - DNA, 27491 bp, Human
  misc_feature (1)...(27491): n = A,T,C or G
gagaagggctggatttggcctacaggctgttgtatgctgacccctgatctagtccaaccctcttatcagtgcgtacgaaactattaaaatgccacataaagcaggccgagcatggtggtttatgcctgttatcccagcactttgggaggcaaggtgggcggatcacctgaagtcaggagttcaagaccagcttgaccgacatggtgaaaacccgtctcaattaaaaatacaaaaattagccgggtgtggtggtgcatgtctgtaatcccagctactcgggaggctgaggcaggagaatcacttgaacctgggaggcagtgatccagtttagacaacatgtggttagaggaagtccaaaagaaggtttccttgacctgtggtaatcagtgaaggtttaataagggtacaactatcactggtcttaaatgatggaatgggatgtgaatctgtggaaagggccagggtagccacctggacaagggatgcagtgtgcccaggcacaaaagtgggaagagcaaagtaatgttcaggtgacaatggagcagagaatctataggaccaacagttgaagctatatgcaagggctaaattgtagaagcttcgaatgccaacccaacaagttgggaccttatttgttagtactgattatatgtagtacgttcattaatctctgtctgttaacacaatgcatgtttgtgaatgtatgtcttcatatatgtctcattgcattattttattatttgtgtggatttgggtgtttatgtgacttatgtctctataggcagctaccctgagttctccaaatgcagggtagaagcaagcacaagctgcccgtaaaacttgggttcctgtgaatgaatacacatctccactgaagcctagggacctatgaccttcctatgaaggtttattttgtgtgtctaatagagtgaagaaaggaacacaagcacagggaaaccagctattgtagtaagcagttcaggtggaaaatggcaatgaggatagaaaggaggggatggataaaggaagataataagaagggagaataataggatttagttactgttttgaatctgagaggaagggaggagataaatttaaaataacaggttttagcctgaaaaactgggagagtgataattctactggcattttatggatacaaaaatacgtcctcttgtgtgttcctttgagagaggtgatccctaaagaataaaatatgaaggtgttcccatgtcgtatgtacacatctgtgtatatacggcagtgactttgtgttaattttctcatttcatagcatgtagtaatgtgaggggcaagacccaaagaccaaggatcaagagatgctcaggaggctgacatcctgagagggaagagccatagaaagcccctgaccattcttgagactgacaccattaatttgcctaactctgatgtgcctttatagcctcagactccagtttcaactccatatcacctaaccccattccaatagcacaattccataacacccaaccctaatcttaattataatccaacctacccttgctcttctacttctactttgctgattgtcatcagtgccctaaacctcatctgattccagccctctgcaataacctatcccttcattgaaaagggagggatcgttgaggctaactcaactttttctcctccctttctcatttctattcagtcaacttctcttttccctgaccttagtttattccccaaataggttccaattggggtgggagggatcagggaggaattaggaccttagtagtcttgggcttgattacatgacatttcagcttgtcagtctacaagggtgtggctttcctctggaagaagtccaaagctctcaggctgcaaagctcagacttggtatagtgggagagcctgactgaggtggctctagccagtctaattgccgttcctttagctagtggcatcttgattcctgctgtgtcttaactgaccattgtcttaaattctagagtggatcatgacccatgaagagcaccatgcagccaaaaccctggggattggcaaagccattgctgtcttaacctctggtggagatgcccaaggtaaggaggaggggacaaaaaacatggctggtgggacttttggaatttactgactcccttagcctatacaatagaattattcttctgtaggttcacgggaattttgggctttgctaaaaatttctgtgaggcctaagtcctcaagtgcatttgaattttatttgccatgcgtttatttacccacatcttcataaaacttatttccaagtttctttgaagacagggggctcttttggtctttgggaacctaaaagagtggtgttttctcaagcagcattggaaagaaactaaagagataaagttattgagaaggcagtaagtggattaacttcatgtactttggtaatggtggggatgggaggagacccagaattagtatatggtgggtcccaactaggtcttcaggtattaactctgatgtctggagagttcctgcactgaccaaggtcagtcaggcactcggttttctctggcctttcctcctcttccctttcatcaccccttgaacaaataggaacagcagcagttaatcaatacagatccggtatgaggtggaggggcagaaaacagagccagcaaaaacccttttctaggttgaatttaagaaacctgggagtcacgaaaattaggtatataggaaacacggagtgggagtaagagggtattgatttttttaaaaaaaactttttctcctttgatcttctgatatattctgatacattgaaaagaggtagaatttctttgaaaaggatacatgacatggagacaattagaaagagagaaggaaagcgatttcagctaggctcccctcctctgcaccactgttcctaggcttttttagactttgcgctaaggacccactttgtatagagccctgtcttgtatgttttgaagaagttgaattcctttaggaatttatagtttaatgaggaaactagaattcttacataaggcacataaataaaaataagcaagtgtgcattaaccaagtggaatctacttacataatgaaatgatagcctctgattgaattaatcagtgaaaacttcatggagaaggtagatttcaagacactgaactctttatttaagtaaggtgcttagaacagtagcaggcacatcgtaaatactcaatacatgtgatcattaattaaaaatgaattagtgagtatctactgtgtcaatcaggatgatgatgaggttcaccagtgatacatcagtgaaaaagtctgacgcaatctttgttcttatgatacttattagtatattagtaaagctagactttttaaactaatatttattataattgtgatataggttatgaatcagaaagtgctagaatgaagaaactgaggaaggagggtacggaggtctgagtttaggaatagtgaccagattaggaatgcagagccctagttgagtttgcagaaaccacagatctggcttttattgcatctgtcttctctgctggcagagtaccatgccaatactgaattctttaacatgtacttgagcattgatcctgaaaccttggtagaatgatctgtggacccagattgtcagattaggggaagaaagaagaaagcctgctaaacaaaccaagtgagatgcacagagttataaaatgaagaagagctttttagagagggaaagagagaaagaaaggtcagactaggatttaacttgggtctcagagcagcagagcccttccaccttctgatcctgagcagtgagaccctcttattctagtgaagaccataactcactgctgtaagaaaaagaccctgttttatggaggcagggactatagataagctgatttctgaaggacccagctgataggcacagtgtagccagggaaatagcccacctgcaaatccccataacatcacagccacatgtcactagggattgagagtgatagaaactgaaattctatggaggcaaggaggcaaaacagaaaactcaaaatagagctgagaggtcctagctgaaggagaagctcaaattcagaagtcgcctgcccagagctgagtttgatggactctagttctcccggggagaaaacatagaaatgttttgttttgttttttttcccttagggcttgtgggccacatgggaaagtgagattgagctgtgtaaaatccatagaggtcacagctttgtcattctccaaattcagcaaagctaatcatctcttgaggtagaaaaatggccaggaatcagacatcctgagctcaaaaacaaagaactctgggatgctgggctgatgccgtaccaaatcctaattccctttccagcctaggaatggcttcagccgccaaaactatgctacctttagccttatgacatcggcatattctacccctggaaaggacctcagtcagtcatctgctctggccctctgtctccagatagccagccattacaaatgtatgtttatctttttgatttttttttttaagagatgggacgggatcggccaggtgcagtggctcacacctgtaatcccaggactttgggaggccgaggcgggcagatcacccgaggttgggagttcgagaccagcctgaccaacatggagaaaccccgtctctactaaaaatacaaaattagctgggcgtggtggtgcatgcctgtaatcccagccacttgggaggctgaggcaggagaatcgcttgaacccgggaggcagaggttgcggtgagtcgagatcacaccattgcactccagcctgggcaacaagagtgaaactctgtctcaaaaaaaaaaaaaaaaaaagatgggaagggatctttttatgttgcccaggctggtcttgaactcctggctcaagcaatcctcttgcctcagcctctcaagtagctgagaccacaggccatgtgccaccacacctggccttttctatttttaaaggttcgcacgaacagagatccttttacctctctggcttgctattctaaggtttataatttttacttatgatatccattaggaagtgcaattcatctctaacaaatgtttattcctcatatatttttaaaaatcttatgaaagttaaggcagaaataaattatttagtatcagctttaaagtcatgctcaagtcatttattagattttttttctgtctagtctcatagagacccattacccacagttcttctttctaaaacctcttcccaatatgccgtaattggagactccaaactacgtgcttatgatgttctccagaacccctcctgactacacccagaatacctactggatggtgcctgtaatcttatccttcgtcttgcttctaataagtcagacaactgccatggagggttatttagggcaacatggaacagccaaggagactctggccaggactggcttggggccagactaagctagtcaggttggctaggagagctcaaagaattaccggggctccttaatataaactatttgtataccccaaagtttgtgatttttagggaactaggggtttgaggcataggtaccaggtacatgaagagcatcctaaagtttggtttctaggaaaacactcagatattcaagttggagacaggatgaatgacttctggaagttggtagagttgaggtaagaagaaggcagagggagaagagaatttccttattgtgagattttttttgtatgcccaacagatttggatagtccctgcccaccatctgttgtttgcttttgtactgaaaacgttcggagtcacttgtctctcttaaccctgggtataccaacaggattgcattaagttagagtttttacaggaccatttactcagcttgggaacaggaaacaatgttccaacctatacatttcagaacaattttttcccttatttcctgaaattacaaattcatactccagaactccaggtatccagaagagaatcccataggccttgtgaaagactggaaaacaaactttagtttcatatctattctgatcttattgagctaactttattcatctttcctaaagcattgaaggctttgtgttgacttttgaccttgttcctttcacacacataggctattcctcaagctactgagaagcccctctcttcacagattttttggttttgatgccttcaacttaaggttgtgaacttaggcttctagacttcatggggctttgccttagtgatgtcataagtaagctttgacatcagtgctcaccaatggcttcttgttgacaagcccaaactttcaggccttaccttagatcagttatcagaagcatttggcactgttccaacttcttgaaactgtccacttttggcttctaagacattgctaaatcctggttcttttgtatttcttgctgccccttattagtttttatcatggaaccccccttccccttcctgttccttcaatgttggttttcctcagggttgcattccttgcccctttcccttataattctgcatattctcttgagatagtctcttctgtgttcacatggatactccacaagaacttcaaacagcatatccaaatatgaatgtatcacccccactgccacctgcccaaaccaaaacctgcctctgctgagtcagtggaccacgcttttaccctttgtctaaatcaatcacgggacattttctccttctctgacccttgaaatgtaatcacattgccaactggatataagtcctgttgcttctgtttcctagatgtcttctgtccagtattttgttttgtcccaaatgctactcttccagttcaggccttccacatttcttttctaggatgccaggtagcctcctaaccctagaaatccctctctcaagctgtctttcacactgctgccagagttatctttctgagatacagatcgcatcatgtccctctgctctctaaattcttcagggattctttgttgtatgcaacttttctttttggaggggccacagacccctttaagaatcaaatgaaagctgtggaccttctcccgaaagaaatgtccatgcctgcagaacttttcatacagttttgtggggttcctggattccctgaaacccatcacccatggatccctgattaaaccctggcctgtagaagacaagtcaaacttctcatggcacataggtgcctgcccacctgtagagcttcatctctcaccatttcctagtttatattttattctttataatactaaattacttaaggttattttttgaccctcacctttatttgtgctattccctctgccaagaatactctccctcaaattatccacctgacagaaaaattttaaaggaaattgtcctttaggtcccatgacaaatgctgtcttttctgtataaccttctctgacttccttctggcaggcttagatactctttgtccctgtttcgactgtactttgtctctctctctctctctctctttttttcgagagatggggtctcactgtgttgcccagactacacttaactcctgggctcaagtgatcctcctgtctcagcctcccaagtagctgggactatagggatgcaccattgtacttggctcatgtcttttatagggaccaatagaccatattgtaattctccacatgtcttgaagaccattaccaagtcctttatcttggtattcccagactctgtggtggtcattgctgtacccccagtgcctagcatagtgcctgaaacatgataggtgttcagttagtatttgttcagtgaacaaatggaccttcaattcaatttggagctaatagccatgtaataccaacctgcaaaaaaaagaaacattttgattttttttattccattctattcctgatagccttggattattcaaaagtttgtgatggttttttagtttggtgctgcagatttttccgattactagctctcttagtgcttgttggtatattacatttctccaggcagggttaaggacaacatgaacagattttagattaaaacaaaaatatgtactagaatgtctaagagagactggctaaaatggtttacaagaagttgacccttcatggctcttaagattccctgtgcatcaccatgtgctccttgtcacattacatggtaggaaaggaatgtctcccatctctcaccaataaggccatgcttagcagaggatcagtgcattgttcctaatatgaaacacacatatgggacacctgctgtgtgttttatgttgggacgggttggctttttcacagtgctcctggaagagagttcttttcactgagcagctactaggagagggataatatcatctgtgaaaaagggaaaaggattgcctctctattttagtcctaagtttttgttctgttttgttttaattttctttctttttttttttttttttttttttttttttttttacagatggagtcttgctatgttgcccaggctggtctcaaactcctaggctcaagcagtcttcccagcttgacctcccaaagtactgagattacaggcatgagctaccgtgtccagccctagttctaagtttttcttccagtagaagcagagagagaatgatttacagtatactttttgagttccccataaacatcttatatacagggccacaggaagagactagcaaatatttgttgactaattgaggaaatgccaggagaacgcagtgagagaatagagtccccaccaattcttcctgcacacttggtcacagcctcttctggcagtgtgataactagtaaatcacaactgtgtggcacacattggaacatagaccaactcaagtgacacaaaaaaggggggtgtgtgtgtgtagactgagagaatcagctgtctggtaacagatatactgtgaacttgtgaataaactgtgacttgccaggttactgaaccatatagagtcatgtctttgtcctgaaatgccaactaaaagctgatgtctcgattcagtgcagaaagcaaggaaaaacctagtacagccattgacattagtaggacaagccatagaggctaataatgttaacttaggcatctgagaacttgaattctaatctgaactttctaaaagtactagctttgtgccccttgacctttttgagtttcagtttccaaatctttaaaatggagacaattccaggattgttaacagcattaaataagatgatgtttgacaagctcttggcagtgtctagcccacaatacacattcaagaaaatgtgttattcttgttgttattgtttcccagatggtcctatcaaggaaaggtcttgggaaaggcaggattttgggggggcttgaggagcaatgaatgcagattatctgaagctccagtaacattgactgcagtaattgggagtggggaggccagaagactttgatgagaggattattctagattcagagaaaagactaaataaagtactgattcgttatctttagccaaatgtaatatctctggattccagggcgccttttcttaggagcaacctctccgtgacttcttttgtccctcctttcaggtatgaatgctgctgtcagggctgtggttcgagttggtatcttcaccggtgcccgtgtcttctttgtccatgaggttggttctgtactttgttcttcatcattctttctctgtcttcttctaaatctgccttctatccccttcccacattctgtgtccttacctcccagttagttacattgctgtgtttgattttccttgactccgtagcttcatgagtcactctttcctacttgactccaatagtgatggtgggacctgagcatctacaaactgggtcttcatgttgcctgttcaatttaaaggaaaaagtaactctcagtcctccttttatctccctcaaaacagagaaagaaatggaaatgggtagtatttacagcaaatttagtatatccagaggaagagccccaggagaaaagagacttgctgcatttctgtagtttgcataactttctgaggttctcaaatcttcttttgcacccttctcccagtaccctctcatgcttcacccactcttctttttataaggtccacctgctttcttgtatcagattttataatcttttagagcaagtcgcgtttctttccttccctcccaccaacttccccttctccttttctccatggttatcaagaccatctgttatcattggccccctaggaagcaggttggaggagataggatgagccaaaaataagaattaagattaactattaggaaggatatccacatcccagtatttcaaaaatgggagaaagtagaagagagtattgcaaaagttgatgcctccttctttggactgtgttaaatatgatagtctcacgagcatccaggactcactaatgggaggaggtggcttgactctcagagaatctcttcccagggatcctgtcttaatcttgggaatttatagagaagcctaacgggctgaacaggtataatgtgtcacacagggttatcaaggcctggtggatggtggagatcacatcaaggaagccacctgggagagcgtttcgatgatgcttcagctggtatgttccagagaactccctgtcccatatttgctctgtccttgtttcatcccactctgttttgggctcatggtctcctaaattccctgtcatgtggtttcatgggaaggaattcagtgacaagagagggaccctatttgccctttactcttagcatttgaaaataccaccctggtttcctggggcagggagagggtggaggagtgatcacaggatgctttgctctttatggaaaggtcataaacaagactatggggactgacacataagcagatcttactctagggtcacagggaaggtctggccctgaaaataaccttaccagaggactggagccagagccagaagtggagctgaaatctgccagtcctcatgtgatggagatgaggtgacctgaaaccagaccacttaaaggacgaaggaactgagacagcctttcggagtctcaaaaaaatcctaagagtatcctgaggatttccacagtcctttatgctacttgctccatgttgttttaggcttctcatgtgtatccactgtgggctagcccacagtgagtgagagaaatacaatcatttgctggtttactgaaaatttgtaaattacatttgtatcccccttttttcagctcagttccctaaaaatccatgggcaaaaatttaatatgcagtgtctagtgaaggctctacctaggtgctaagtaatggtgcctgccataaagtggtctgagaatgagccagaattctccaccagtatcccaaagtcatggctgcccaggagtacatatgatatgaaaacctaagtatacttacctctctcaggtaagtatactttctctcagggatagaaagccttaatttcccagggacttatagatacctctcttggggtatctataaggctttctttacctagagctatttttcctgtgaatacctggatattgcagcttctgctgctagcaccatggattgcaaggagctaaggggaaaggattggcagtacctgggtacagttagaaatctcagtgcagagagaggaaaaatactacaaaacacattgggatgaactcctaataataatttggacacaatccagtaatgtcaggccattagggagaatttctaaagactgaagtcactgcttctaagatgtgaaagttggagattatttgagaagccaacatacatgtatgtattcacttgttctctttaggatagtcatggatgacaaagccttcaatgaaaggagttcttagcagtcttctcagatgtgtagcaaaatatgggaatgaccctatgatgcctcagccagcatcatttccctttcctttggaagggacagatcactcttaaggatgtcaaggaactttctagggagtcacacagttatgttaggccatcacagcattggaataggggatatctcagcatgttgagccctgtctctggggagctgacttctacctcttccaaagggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagagagttttcacatcagtattgcttatttgtgtcggtacgtgcacgcgtgtacacacacacatcgcccccgccctgcttttacctcccattggagaaaaatgttacccagacacaaataggcagtctttgccctcctttttctggtattgtctacaattccttttggctagagtttctctctctctagatatctcctctttaggcatgccaggtgcctcacccagtggctcctggtttgcttctcattgtcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagaggtaaggggacttgggaggtaggcagtgtaagaagatggcagctaggacaggctaaagggctagaagctcctgaagactaaagcgtttgagctatggtgactataatggccagttttctggggctagaacactatttttaacgaaaaattatctagagcactgaaattgcactgttcccttaatgatatatgatttgtcttttgccactgtctggcccactgtccaaatatgcagctctgaggtctttcatatcattggggtaaatggttattcttcagactgggcaaatctagggagcccagacatgagctacgctttccaaccatatcatagaaagtataggtgctgctatgaccacgacagctcagagataaggggacctggggggaggcaatgtaggatgggaggatagaagggtaacagtttaccccagggtaatcctaaaggattccagttagtccaattctcccttcacttcttatcctttcctttccttcccttccctgacccggttcctccctggaacagagcctctgtttagacactttttactgctgtgttttctcaggcctaggaaggataccttgtggctaaagtatttcccctaggtcttcctggtctcaggaagcctgctagaaggcctggcagcatacatgtatctcccagagagggtaattggcctagatgtgggtggtggcttgatcttggccatagggtcacttggactgtgtcatatgtctatctcttgcagccaccagaggacatttgtgttagaagtaatgggccgccactgtgggtaagatcctcattctgacccatttattccgtggacctagcgatagccctttccttttccccagagagtccagtgaggtctctcagtagcagcagatctggaggtgcacatgctccttgtggtgtggttccctttccggcctccatcccctctgttacatccccacacatgcatgtgtgtacgtgctcaggcacgtgcttggtgtaaagagtgggtagtgctctgaggctggaagccactgtggcaggtgaacataaatggaaggtatccgttagagacagaatctcattgaggggccccggtgctcttacccttgccccacgaataaaatggaggctctccagaccttttatcaactatgaggactaggagaacttgttgggtatgggtgaggctatttgtagagtacaacttctagcaggatgcttctgactctcatctcagatacctggcccttgtcacctctctgtcctgtggggccgactgggtttttattcctgaatgtccaccagatgacgactgggaggaacacctttgtcgccgactcagcgaggtacttgcactttattttgcccttaagaaatccctcaccctgttccactgatgatctctttcccacccatcagcttcattccatggaccattttaccctttgttctcaaccagacaaggacccgtggttctcgtctcaacatcatcattgtggctgagggtgcaattgacaagaatggaaaaccaatcacctcagaagacatcaagaatgttcgtatgaatgaagccagagaggccttagaatccatagcccattcccttctggcttctgagtctcctgacattgcttctccccttggtccttctgcacatctctccctggttccctgcccctgattgcctcccacaaagaaccattacaagacaagaggctgagctgtccatggtttacccaagtctctgcttgttttcttcctttgactctgcgtaaccctctctctgtccctctgttggtcccttcagctggtggttaagcgtctgggatatgacacccgggttactgtcttggggcatgtgcagaggggtgggacgccatcagcctttgacagaattctggtaagtcactgggctgtgtggccctcatgccttgaaaccctcaaccttgtagtcctgccccctcagggctgcacttcaccagacagggacttacatcactggtcgcattgcctctccaccagcctttgggctgcagtggccactgacccattcccatacacttgagggttctcttctgttacaaaaatggtgagagactacgccttcctaatggtgaggaacaatatctttttgttttgttttgtttcatatatttttaatacgaattttgagataattgtagattcacatgcagttgtacagaataatacagaggtagtcccacataccctttgcccagtttctttcaatggtaacatcttgcttaactatagtacaatatcatcaccaggatattgacattgatatagtcaagctacagaacatttctgttaccacaggatatctcatgttgtccttttatagccacgtgtactttacccccacccatccctcctcattattattattattattattttttgagacgcaccattgcactcgctcccaggctggagtgcaatggtgcgaccttggctcactgcacgctctgcctcccgggttcacaccattctcctgcctcagcctcccaagtagctgggactacaggcgcctggaccacgcccggctaatattttgtatttttagtagagacagggtttcaccgtgttagccaggatggtcttgatctcctgaccttgtgatccacccgcctcggcctcccaaaatgccgggattacaggcgtgagccactgcgcctggccctccctcctcattcttaacctctggcaaccactaatctgtctctttgtctgtaatttttaatcttatgtatattatataaatggaattgcataatatgcaaccctttaggattggcttttttttccactcagcataattctctagatgtttatcaaaggtgttgtttgtttctatagtttgctgttttttgcagagcagtactccatggagtggacgtattacagcttgtttaatcattcaaacatttgagttttcaatttttggctattagggataaagcgactatgaacatttgtgtacagctttttgtgtgaacttaaattttcatttctgcagagtaattgcccaggagttcaattgggttgtatggtagttttttgtttcttaaaaaaattttttttcaaagatactgcccaactgtttccagaatagctgtaccattccatcagcaatttatgaaccacctgttttgtttgcatccttaccagcatttgggggtcgtcaccttttttttttttttttttttttttactattctgataggtatatagtggtatttcttttttctttctttctttttttttgagatggagtctctctctgttgcccaggctggagtgcagtggcatggtctcagctcactgcaacctctgccccctgggttcaagggattctccggcctcagcctcctgagtagctgggattgcaggtgcctgccaccatgcccagctaattttttaaatttttagtagagatggggctttcaccatgttggccaggcaggtcttgaactcctgaccttgtgatctgcctgcctcggcctcccaaaacattgggattactggcgtaagctactgggcccagcctttttttttttcttttttttttttaagagatggagtcttgctctatcacccaggctagagtgcagtggtgcaatctcggctcactgcagtctccatctcctgggttcaagggattcttctacctcagcctcctgagtagctaggattacaggcacatgccaccgtgcctggctaactttttgtatttttagtagagacggggttccaccatgctagccaggctggtcttgaactcctgacctcaggtgatccgcctgccttggcctccaaaaatgctggaattacaggcatgtaattccaaccttagacactcagtttaaaccctcttatcctatcttcactggaagagcaaagcaatctcctaccttgttttgtcaataagaagggaatattattaagccccagtaatcctgttgattaccatagtgggcatgtttctctagaagtaagtagaatctttggggttccgatggcaagaatacagagtcatcaagctttagatgaaatctgtttggggaggtaaagcccagtaagttctttgctgcagttcttaattgtgagactcagtcttgtgatttggaaaagggctcgagtatcctgactctctaggctgagccaagatggggcagcctgagccagactgtctttgttctctgggctcctgcagggcagcaggatgggtgtggaagcagtgatggcacttttggaggggaccccagataccccagcctgtgtagtgagcctctctggtaaccaggctgtgcgcctgcccctcatggaatgtgtccaggtggtaagtactgatcctaaacccctttcttaacactctcaagcccctgccttggagctcaaggggcatgagactatgtctaaggccactggtataggagcaggtggaaaggcaagatggtatagtaagagacatgtggggaaagaacacagtgggctttgcataggagctcttaactaagcttcagtgttcccatctgtaaaatgttcctaaggaaggtgggagattctacatcctccttagtaatgaaacccagtatctcataatatacaacctcaaacctttttatcttgtctttattggaagaataatgctatattcctcctaactttattaagaacaggagaatattattaaattctagctgggtagcttttgtctctatgatttctatcttgaacatgtttctctgaaccaacacgaggttactaatgctaacgttgagggttattgtaaggattggagataagctatattagcatgtgatacagtacctagcaaatgttgagtgctcaggaaatggtggcctttattatgaaggaatcactcctttgataccacagagcgaacgtggcggctgagagcgagaactaggctgtgtggcctggttctgagggctggtctaaatactccccatctcccggcctccttctctctgagactcaggagtcccagttacctgcagccttgcttggaaatgtatctgtaaaagctccaaagtgaaggcactgccccacagagctgaaatcagtagttgagaagcacacagcaggaatcagtccttcctaactgggttacctgtaggatcttcatttactcatgactttagaggctgctttaaggccggggacctgggtgtggaatggaagatactatttatctgtgagcattcttccactctgcccatacttctaataaacagagcatagtgccaggcacggtggctcacgcctataatcccagcactttgggaggccgaggcaggcagatcacaaggtcaggagattgagaccatcctggctaacatggtgaaaaataccaaaaaaattagccgggtgtggttgcacacgcctataatcccagctacttgggaggctgaggcagaagaattgcttgaacccgggaggcagggggttgcagtgagccaagatcacgccactgcactccagcctgggcgacagagcgagactccgtctcaaaaaaaaaataaaataaacagagcatagaatcagttcttttcttttgctgctcattacttagacaactcaggaaaaacaaaaatacttccatgaaagtttgggggcataggaaaggtggggtgtagaatggacaggatctagtcacaatcccagagatgggcagagttcgactgtgggatggagttccagctgtgcagaatcctgaccctggagttgaaactgtcgctgtgctcccccctcagaccaaagatgtgaccaaggccatggatgagaagaaatttgacgaagccctgaagctgagaggccggtgaggagatgacgggaagctcactagctacagaaatcagaggcgtgaacgaagccaaagatctccatggctccaggcccaaaacatgagcttctgctgcttccttttctgattctctctgcagcaagttcctgcccaagaaaattagttgtgaggtgactgggaggctcagttcatctcaggggtgtggtccctggcatcaaccttttataatctgttatttctatatgtgagccccagcaagatgataagttcctctaggcaagggacagtctcttgtgctgagcatagtgcctgaagaagagtactgagggagtgtttgatgaactagtggcccttttgcagcccctgccctgtccctgctctgccccagttctgtcctcagaggtttgccctatggaacttccctctgggagcaacacttcagaccaggatctccatggctgctggctgtggggaatggcctgaagacacctctctctatttgtacttcctacaggagcttcatgaacaactgggaggtgtacaagcttctagctcatgtcagacccccggtatctaaggtactggcaagttgacttgccctctccccttttccttctccctcccccagtctctcttcataaatgctaccacagtccatacaacataagccttgccaacttctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggaaagagggcttatgtactttttctctgggaaaatatgggaataatcacatctaagtgtatctaagccacttcttccactggagtagtggttctcaatattaagtatatatcagaattgtttgggttgcttattaaacatgcaaactcctgggcccctctctcagaggagattcatatctgggtagaggccaggaatatgcaggtttaacaggctcccccagtggattctgatgcaggtgatccaaggaacacacttgggaagtgctgctctggaaggtctctcattcattgtataataatgatatctgagatgggggacagcagctttatttattgatctgtgatcaagaattttgcttccatgtatgtggtagccagctgtgctggcattccttgggagaggggtgtgtgttgtgttgtcttaggcagatatcctgatccctggatgacaagggcttagagcccttgccctcctttactaacctcctccctgttcccctgctgggtttctgtcctcatttttccctgcttcctcctgtatagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcaggtatggggactattctgggacctaggagcagtcatggggaagataagtgtagcaagaatgacctgtccattctcttggcttcctctgttcctcactacctctctctcctctctcagggtccaggcagaagtagatatttaatactagggcagtaggaacagcaggaattactgcagtgaaccattgcaaacaacatgtcttatttaattctctgtcccaaagctcagcacagtgcctggcataggtagatgcttaatatttgtgaatgagcagtaagggtagaagaagttgagtgcgtggggaaaagctaatacctggtgtaccttttccaaccaagggggatccaggggtagggttagaactcaagcagtggcaccagtcccacacaggcctcctagtgctttagccttgtgcagagctctgtggcttatccccacagatagaggaagctggctggagctatgttgggggctggactggccaaggtggctctaaacttgggactaaaaggtaagtagcactgcagaggcacctcctcccagtcacctcttaaagttgcccttggatgtgggttcattatgccatggtctgcttcaaccaccctgttgtctgggtcctccaccctcaacctcacagttgctgccatgagggcagacatgcccatctcaacatctttagcagctctggcaacttagagctccagtatgtatccttggataggactgagagggtgggctagggagggcggcacaggtcaagaaattaaaaataaagtgcctctaactctagcttttctccccctcaattttcctgtctcttccccaaattccaattccccttcccctccccgccatcactgatcaactaggactctacccaagaagagctttgaacagatcagtgccaatataactaagtttaacattcagggccttgtcatcattgggggctttgaggtgagtgcctgccaccatttcttcctctctccctcctacctcctctccctctccccaatcctgcccttgtgctctcttcttcttaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacagtgagagcctatcaccacttcccatcccttttggccaggattataatccttaaactgagtgtggtcccaaacagtgagctactctttatatcaagcaaatgggaatgtttgaaaatgattcttcagctgggcatggtggctcacacttctaatcccagcactttgggaggccaaggcaggcagatcacttggggtcaggagttcaagagcagcctggccaacatggtgaaaccccatctctactaaaaatacaaaaactagctgggtgtggtggtaggcgcctgtaatcccagctacttgggaggctgaggcaggaaaattgcttgaacctgggaggcggaggttgcagtgagcagagatcgtgccactttactccagcctgggtgacaaagtgttcagtttcctcacctagaaatgcaccagtaccctgaataccaaatgttttgtttgtttttttttttctttctgagatcatgcagtctaattttctgagcagtagaaaggataggtacagctttcttcccaggagagacgttctgcagtgaggttggcaaatatgcctgttaccctaaatgcaagaacttgatgagctctaagggccctgctagcctatggagaatatagttccagggtttaattaatggcaaagattaaagagtgataagaatcaggcccctgatcatgtctttctaactataacccattgtccttgcagacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggtagctggccacccagagcctgctagatagctctcccctgtctccagactgtttccacagtgatctgaactatgagagctcaagttgaggaccgagctgattggtctgtagaatcctgtgaagaccagaaagagcactatgcaggcattctctggtgtcacctcatatgcatgaccgcagctactgttgttggaatgctgattttgagtcaggcgacctggtgctaagccctttatgggcatttttgcattttatcttcacaatagacatgcaaagaagatactatctccatataacatagaaagtttagagaggttaaaaaacttttctaaactcctaagtgagcagatggtttaagtggttgagaaagtcagtgatctttttactacatcatgtctccccttcagatttcccttgctgtcattctgcttttgagagagatactctctcaaaacagagatataaagtgtcaacactgacactgtgaccacaagtcagccctctgaggcaaggggaaccagaaaggcttggaaagggagattggagagggtgaggggctgaacactgacagttactgcagctgtctgtagtgctccctcttccagttctgtctcatttggagtcattgtttaaatttcagtccacactgagcttcttacaggaattaggcacagttcaggcccaggattgtaaacaactctcttccatgtgtctcttccttcctggagaggtgtggtgtggaagatgatttatacccaaccttatccattcccagttaggcttaggatttactctttcattttcaggcaaatgttgaacatctggtgcaaaagatgaaaacaactgtgaaaaggggcttggtgttaaggtacctcatccatggtttgttcctaagtgaagaagaaaaataagctttggctcaaacccatagaatggccattgttgggacaccctgaggaatctgtagatataaagggagggggccagcctatcccttgaatccttggaggagataaaaattgaaaggaaagaacaaaggcagaaatgggggatgggaagccaaccacagagtcacaggcttttggtctccacctggcaggaatgaaaagtgcaatgagaactataccactgacttcattttcaacctgtactctgaggaggggaagggcatcttcgacagcaggaagaatgtgcttggtcacatgcagcaggtagggaagacaccgtagtcatgcccttcatcagacagccatacctgccaacagccatacctgccaacagccactgaggcttccactggccttttccagtcttctggaggagcctgtcagtgccatcatagagcatgggcctgcagtctcttacagtcatagaatcaaaacatctttatcctggaaatgactttagagattatatggtctatccttttcaaaagccctcatgggagggcttttcaaccttggcagctttgccttttggggctggatgataatttgtcatgggtggctgttctatgcactgtaggacagttgcacagcatccctggtctctacccactagatgccagtagcacctccctctcactcccaattgtaacaaaaatgtctccaaacattcccactttcccacctgcttcctcttaattcaaaggaaatctgtatgatgttttatattaattctgaggtgctaccaagggcagccagattgggccacaaaaaaaacacttttatgtcatcattgacagtgatcaacaaaagctgctgggctgaagaggggcaggcagctgacccattggccaataaaactaaaacaggatctggcagctgtggagctaaaagaggggattgtggggccaatcatctttaattagttgttattatatctgatacatggccaaatttgctgggccagcttgccttggatcctggcactgcctcagggcaccctttcatagtttgacttctggattcctgttttgggctgtaagcctggggcccatctttctttttttctctgtgtgtctagatatctctgccacttcattagagtccttccctctgtaatttttatgtttctttctccagggtgggagcccaaccccatttgataggaattttgccactaagatgggcgccaaggctatgaactggatgtctgggaaaatcaaagagagttaccgtaatggtaggtggggtgagagcgagtgccctctatagaggctggttccccagtatagaagctgactgcccatccctcattgcagggcggatctttgccaatactccagattcgggctgtgttctggggatgcgtaagagggctctggtcttccaaccagtggctgagctgaaggaccagacagattttgagtgagtacatctgcttcctggagtggttcttttccctggtagtttcaagctctactgtcctcaacctgttcactgtctttaattcttttttttttttaaggagtaacacctgtattcttacccatttcagatgtgatgcacatgtcctaaatctaacctcttctgtctaacttcttcctataaacctttggtagaagttgattggggtgctaaaagattatatcatcatctacctcattcctctgtaggcatcgaatccccaaggaacagtggtggctgaaactgaggcccatcctcaaaatcctagccaagtacgagattgacttggacacttcagaccatgcccacctggagcacatcacccggaagcggtccggggaagcggccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtgcttttgcttctcctgttatcatcttcctaagtggaatgtaatactgtcagccccatgtatcagacacttgtctgatgaagcagtaaagacgttaagggtatcacagggggtggaggaagggattatctctagtacactacttgctggctgtctgaaaaattgtcactgccaaactctaaaaacagttctaaatagtgactgagaaggtttgttgctggagtcagggaataaggcagccaaatactctttgcacagttctttagtgggaagagaaattaacaataaatatcaagcactgtggtaggcatttcatcattgaatcctcatagtagcttttggagggcaatggtgacagcctgacttcagaaaggaggacactggagctcaaggtgattgattacataatgtctccttcaatattattcaagtagaactcaaactcagttctgacttcaaacctcatcctcattccccattcctgcttccttatcatgccatatcaaatccccagagccataaggcctatgaaaacaaagtgaaagggaaggttcaggcattcattcagaacattttaaatgctaattgccattgatttataggttctctgtctctttcctgtctttaatcttagagctgtttcctcaagaaaatgaagagggaaggatggctcagggaaagttaatcagagggaaaatgtcactctgtaaagagtaaaaaatttaggatgatgatacgatctgggaaaaaaaggcatagtgaagaccacttaaaaacaaacaaaaaaaacctatgaaggtgcatgctatttccccagagctaaaaagataagtgaaattgtgtttgaactcttaagtggaggtgaagcagaatttattagccaccaaccacataagtgattatgaagtaactgagaaacaggtaacattttttcccacatggacaaaactttctctttctagaatattaagtatctatgatgagaaatgaagtagcatctcaagcagtttataaatctaccagaatattagaatcacctgggacctttgaacgtactcatgcccaggtctactttattcatttatttttttgtagagatggggacttcaactcctggtctcaaatgatcctcccacctcggcctcctaaagtgtgaggattacaggcgtgagccactgtggccagccctactaggtctgctttggaccaattaaatcaatctctgggggtggagcctgggctttagtatttttaaaaattttcctaggtggttctaattaataactaggattgagaaccactgactaacacagtggaatctcattcctggctatatttgaagcactgaagcccccagtcctaccccagaaaattccaaagaattggtatgaggtgaaatcttggcaccagtgtttttaaaaagcttccttagtgattttatgtgcagctggagttgagaacataaaagcagtaattccaaatttggggtgggagaaggtataaaggaaggggaagctcttcagatactctgcccaagccctcctgttcactccagcaatgcccagaatcactgctgctaatgggagaaaggttgggatggaaagttacatagaacagccaggcagtaaacgaagaactttttctaaggggggttggagaaaagtaggaaaagtagaaattgccaaacttgcttttagaactatttattctttttttttaagtgatgttttttaaacaccagcatcaataggacagaagaagacatctgttttccaattagctgtgtcagtagattccattcattgtttgtagttcccaatcagctttaaaaaaaaaagtttttcaaatttgcatacaagtcatctaaaatcaataacaacttgatctaatttagaaaaatgaaagagtatcgttcactaaagcagatctcttttgggtagatggaccatcacaaaaggagctcttacatgcttttcccactcccatcccaagtccaccctccc

SEQ ID NO: 15360 - DNA, 18070 bp, Human
ttttatctttcctattttaattgttaaaatatttttctcaggcataatttttttaaatctcatccttatcatttcttcttttcttcttttaaaagaaagatgattgttgtctctttggatcttttagttttctgatttttttttttttttttttttgatggagtcttgctctgttgccaggctggagttggagtgtagtggcgcgatcttgactcactgcaacctctgcctcccgggtttaagtgattctcctgcctcagcctcctgagtagctggggactacaggcgtgcgccaccatgcctggctaatttttgtatttttagtaaaagcgaggtttcaccatgttggccaggatggtctcggtctcttgaccttgtgatccacccaccttggtctcccaaagtgctgggattacaggcataagccaccgcacccagcctctgatttttatcttttatcttctttttatatccttagtttgtttataaataggcagaagaaaatctagttatagagacagatccaaaaagttttatttatgaattggtcatagatggagaaggaaaaaaataattagtgttgaaacccactattttaaccagaacaacaaatgagtttaaaagaatgcaacttagtgagataggaaaaactgggggaggagtatgtgtaagagaaaataataatttcttcttctatcactaccatgtaataaaataaagagcatttttaacatcaaaaaagacataaacccagatatttttaaatgaatacttttgattttctgaaaaattcactagatggtctttttttctttttcattttgtggtgaattaatgaaaacttctggcattaaggaacacttgcggtagataatggaaggatttatatttcaggaaaactcactctggtacctgtatagagaatagactggaaaagattgaagacaaaagcccaattaggactagtaataggaagctgtggaggtagattacaatttggatactgtgaggaagaaagatatctaccaaacggttaataaggaggctggaggttgaggaaattgtgcctaatgcactagagtgttctcagtaatcaaaagtagcatttgctgggagtgatgtggttgaatttttttttgaagaaaaaatgataatgtgttgagttaaaaatggaatctagctgttttaatagacatacttaatccttctgagcttcagagagggagtcttgcctagccaacctgttcttagtattatgttttatttagcatggctttggaagccacaaaactctataggtctagttgaaataaaataaaatagtagtaacttgtatcagacatatattaaatattgccttcatcaatgagatcatgagtttcttaaaagcaagagtcccattttcttcttcctacagaggtggcctattgtttagtgaaaagagcccacgccttggagacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctgtgagtgctgggagcgaggcgggttaggcaggccgccggctagtcgggctgggcggggacgtggcaggacccggcgagcagggaaggcgtgggtgccggccgggggtcggcaatctctccagctcccctgagctcggggaggcacggagcctcttctttgggcacagtgttgtcgcttgggattgtcctgtgcagcactcggggaggtcacttgttaaaagtacgcacgttcccgagctccaccccaggagaaggtggttaactagttctggggtggcggccccgaatctctatttaaacagacaaactcaagcatactgcctctgcccttttctatacaactgttgcttgccgttacgaaattttaaacttattacttattttgcataaattagttaggtgagaaacccatgaagtgacccactgaattataagtgcatctttacgtgagctacttcacaccattgcataattttcctggtttttgcaaaaagagagaggttgaagtgccaggggttagggatctaccttatttatactttttaataatcctactggaccaattctagaattctcacttggttgggaaactgcagacttggacaaggtcgtttttagtagagctcaagtttccagaactcctgtcttttgctgcactgttgttgggcatttaaaactaaatgtatttttctcttttgtccttatacaacccagcgtgccattaacgtgatgtgaagccatatgatggctcactaattggacatagcactgcttggagttctgataacagccacgtcagcaaggaaactatggtttggggctgcacgtggcattttggaatggcctgtgtttcgcatgctagtaccctgatgaatgaaatttgaagtctgacttgtgattacgttgagccagagtttgttctcattttagaagttgaaatctcatctggactagtaataggaaggtgatgtttttcaaatgttctgaactggaaagcttgagactatactgttactggttatctcgcttctgaagatcctcagatactattggattgcataactaataacctggtattttaccaggcttagctataattaatttcgcaggcttttgttgcggggttgtaatgttttgcttctttttgtacccttcccccttttattttaattcagggttatactggcgaatatggcatatggatcttattcagtctgctgttttgtatagtgtgatgaccctagtaagcacatatttggtagcctttgcatacaagaatgtgaaatttgttctcaagcacaagtaagtatgtttttcaagtgaaagtacgtactacatgttatatttttatatgtcttcttaaagatcatttgtgtgtgttggttttaataagcattaatttgagatatatatattaataaacattttgggggaaaggaacattgatgctaggaagaattattaactaactgaagtagagacaatgatcattctgacacggctacagaagcagattttgagggtggaattagaacacttaaacacaggccttaatatgaggttcatcagagaaacaaacccaccaagtaagttaacatttcagaagctaaatgtaattccttatggagagaattgttctgggctcttcacgtactatttttggaagttaaagaaatgatctttttgtcattattattttttgagacaaggtctagttcttgcccagtctgcagtgcagtggcatgattatggttcactgcagcctcaaccttcccaggctcaagggatcctcccacctcagcctcccaagtagctgggcctacaggtgcaggctaccatgcccagctaatttttttgtagagacaggccatgttgaccaggctggtctttttattttattgcttttttttttttttaactctctgtcattttcaatgctaattacgtttgttttcatacaagtgtataaaatgtaaaggattaacatagtctaagatcacacatactgtaaaatacagcttttagagaagaaaactcaagcctcaccacaataaacttataccttaattataagcaattaaatattctagtttcatagaggttaaaatgcaggatcacgtagacttaggaaagatggtaacatttattatttctcagcgtcatggtcctcattgtctcattggaagtggtataaattgtttaattgacgccctttgatgttgctttcatgtacactgtgatacttgggtagggatagcaggattatttccctccttccttgatggggtcatctaggtgctgtattgctttgaaagtaatttcttaaaaggcaattggaatttcactgagacttagtacgaacatactttgtatgtgcattatcttttcatccatagttctcactctagtttggatgctgtttttacttgtattgctgtaacaacctccatctggtcttttaaaacaagtttagggcccgccctgccatgcactgtatgaagcacattgccctatgtaatccttatagcatccatatgaggtgcaggtattttccttgttttatccaatgaagagtatgtatttctccttatgtgacatcatttttatcatgtcattctcataacaactcatcatggcttttttttttttttttgagacagactctcactctgttgcccaagttagagcgcagtggcccaatcttggcttactgcaacctctgcctcctgggctcaagtgatcctcccacatcagcctcccaaatagctgggactacaggcacgcactactaccacgcctggctaatttttgtatattttgtagagatggagttttgccatgttgcccaggctggtcttgaacttctgggctcaagtgatccgtctgcctcggtctcccaaagttctaggattataggcgtgagctgccgtgtccagccatggcctgttttttttaaatgtattaaagccaaattcttctagacccctggaatgcaagtcatctgcttccttcctatgagtctggcctcatctttcagaattaggctttaacccttctgactcagccctcacatcatcctttgaatatgtcttgtgccctaccctatttaggattaacttacttcctttccattcttacctgtgttttatttctagacctaggaatcttttccagagaaatccttcctgattttgatcatttctttgctttattgtccctgtgttagactctttcggggaatgaggaatagaaacatgttgagatgatctcagttaacaggggtttattttaagaaatgtcccaaaatggcctcagtgactgaagtggccttagcagtttcctccctactgttctggacacaaacgagctcaggttttcgtggctgctgttctgatggaccagcagataaattgggttatctttgttatctttctgcttggcagcccctcaaccagctgctattccaggattcagctcatgtgggcctccactgtatgggactgtttcctgtgaggcatggccatctgtgtatcgggaagccctcacaagtgggcatctggtatgacccatcctttgtaatactcttggaactcagtccctttgagactcgtcattctttacttattcttcataacatttttcattcatctctttagaatcaaagtcatgttctttttaccttttcctttctactttaggcttcttgaagacacccgccatattttatactccttaaaacagttaatggtacatttagttcagtaaaatttcaatgacttactgacttaatagactcagaatggaggttttttttttaagtcatagttttggctttatattaaatatgctactgactttgaaatgcctacagatttgcaagatggttaaggttcaaagatccagcaagatgctgagtgtgggtagctgttggcagtagaaggaagatggcttcagcgttgacagtctgggttccagtgccagctctgccactcttaaatgtgtggccgtgggcataattttacctatgtagacttcagattcctcagctataaactggggatgctagtggaatttcagagggtggtgaggattcattatgatcatacatgttaagcatagagtctggcacataataaatgtttatgtgcagggttgaagaggttggggctaagagagcccttagaagttgtttttgttttttaacgtggcataatttaaaccatgtttgcaaagatgtttttattttaagaaatcaggtagtgtctttttttatttttaattttggaagtgttctgacatactgatgtgaaagagtaaaggaagaaaaatacaattgattttatgggttatcttagttgactaagtgctaggtcactagcgtgacctctattttgttttagagtgttcagcactgagtgaggtttattttctgagagctctaagacagaggggagggcttcctcctcttgagttgcagtaaacctgcagtgtggttgttatgcccctggtaggtgaggataaaattctagacctagaagagaaattgcttagttatctggtgtaatgtcttcatgaggatttatcatgtggacaatcggttgactgttcgtcctaaagacacatagtgacaaccaactcttttgaaaatgcagtagtttattcctgtgtgctaacaacttgatagttggggtgtgtgtatatattttttatattaagctaagaaaggtttctgcagtaaactgtgtccatttcttttcagttggtcttttgtggaaaaaaaagttgtctgatgttaagttcaagaaacacatttatttatttttaatttttcttatttttcctgttctcacaatctgttctcatgaagaaacatatttagtgcctggtctgctaaagaggttcagagagaagaatctctgcctttggagctgagtgtatccgaagtgcaagaagcatatgaaaaaagatagtttttatataatgaaatgaatcaaatgaagttggatcttcggagtaaaaagttcattttagtgtcctaaagtgtctcttaaaaagacagctctctgcccccttagcagccttttactttaggtttcagaattgatttcctcttaattgtgtgtgttttgttttgtttttttttagaactattttttcctctttccagttaccaatttgtgtggggtaacaaggtttaaaaagtaactttgtaaaccttttaaaaaatacattatttgaaactgactaaacgttttctttttattaataacaatgtcaattctaactcagttcttgagtgagagagctaaagatggagacaggtaaaaaaataggtaaaatcagttgcaatttgtgcttaacttgtatcccagacacccttgtagttgaagatcaagattgaaaactcctgccttgaatgacctggggctttctgtccatcacacccagcttaaattgtcctttggagtaaagttaaaataattactttaagatattacagctgttatttccacttcgtttaagcctagttttcgctcctgttatgtacttggaattgaaataatacatcatttactaatgccttatgaaatttattagttgaacagttagatgataggttaaaacaaaatgtagttaaaatgattcttaactaaattgtgttaatagcatttgactttattaaccacattaattcctaaactgtggaaaattcttctttttaaggggaaatcaaaacacgtcactaataaaccacatcttggacatttctcgaacttctcttttggctagtgcagtgtaataaacttggaactttctgctcagcttcttttcttgaaatgtgaaatatcattctgttgccagtacaaaatatgagtacggtgtgtttctgagagagtgtgatgttcacctctgtagcatatggaaactttttctttttttctttttcttccagagtagcacagaagagggaggatgctgtttccaaagaagtgactcgaaaactttctgaagctgataatagaaagatgtctcggaaggagaaagatgaaaggtttgactcctgtttaaagtatggccatcataaaagggggtactttgaagaaaattttttgatttttgcttaaagaatttggattttggaattgtctgaggtaaattttggaattgtagtagtagtagtaatggaaatagtaatagctgacttttagagtttttattacaaccagatacttttatctgtgctgtacaatagttgatttattcctctaaagagtcctgtgaagtaggtactatttttatctcctttttatacctgaggcaacaaaggtacagaaagcttgagtaacttgcccagggtcctgaattagtacatggtagatccatgataagaacacaggcagtttaacttgagagcttgtacttgtaactgtctgctggaattgaggaggcaacagagctttgtacagagcaggctttgtctgttaataggtgcacaaccttgaacatatcgcctaacccctctgggtctgaagggtttatgtgttagcatgtctatgtggtggtatttctgttcctgagcttcccgagggatatcccataattagttatctgtattggttgggaaaaagaaaataactgggtttttctcctgttgcccaattctgtgccacgtttgttaacccctagtcccaattttttctgccggctgctcttagaaggcttattggacaatcttaacatctgagtagcagaagtccctgagtaaacttgtgctgaagaattgccacatagtttaatagttgtggatctgctggttttcatggatcttttgtttcagtatcaagaagatgctttgttggaacatattttttaccccactttgctccagaactttgtgtgaacttccattgttaaagtgcatataatatattttctgtatttaatacggttttcttaaaatgcatataaaacaagtaacacacttttaaaggaccagaaaccatttaaaaggaggaaaaggtggatgagcaagtaccttagagttagttacagcaactgagcactgaacttagttgtgggtttccaggtgtcaggggaagcatctgaggtcacatagctttcattgtctgacgagaagcagcatgcaagtccttctgaaaagaaactttcctggcactggatcttggaaatactttatcaagtggatccttatttaagggacactgagtaacttaatgaacaatgtcttctatagtggttttggaaaggtaccaaaacattattaaaatgattatcttctatggctcctttataaaactgaaggcacagtattatgacaatggaggcctttctgcatggagcagctttaatgaggtcgggctgcatagctttccaattgcttgttttttgcatagggatcaaggttagaaaatctaggtaactgttttagaaaaaactttttgttgtatttttcattacagtggtgtttcttaaactagggtatgcatagttacctaaatttcaaaatgtttgttacagcttttaaaggttttcagtgattaattatgtcagggatagtaaatgggtttcctctgcccactgcagtcttgggcagatttggtctggcacttgttcttgatcctgggttatgtctcggaatctttctcagtttagtgttcaggtagtcactactagtgactcagttgaaattgggaatgaaacctttgccatttgctggattaggtatttcaaagtggggtgaggtggaggtttcatggatatatataagtgcagagtgtcagaacattataaaatttctcttcttttcattggtagaaatttggctgtttttatttccaccataaaagccatacgggatacagtttgtactgtattgattgaccttgataactgggaccagagcctctcattaagatctagcttgtttctctctgaaagaattccaggagatttgatgtaagaagaaggcttatcagcatttctttgcttagatgtgtatctctcaaagctctgtctacattcatttggaatatatactccatgccgcttaaaagtactttaaaatgttcatttatccaaggatggaaataagcagaggagaatgtgagattcattaacattcattccagagtgggagtgtggtttcttcttgatttacaggtgatctatcatttaacagttgcttggtctcaacatttctcttgtaggaagctcttcctgaaaacatccttaagatattgagaagtgctctcccaaaccacgttccctactaggaagaaaatgtcttctactaggcagaaccgttggcaatgagggcatttgggggtcctaaatttaaaacagaaacaaaaacaggatatgggtggactcagtaaaagttctaaaggctgtcaggcagtcctgactttatacactgatgtaactaacacgtggtcatattgggatctagggaaatctaaaggattgggccacttctttcattaaaagctttttgaaaatggttcttgtattagtcgattttcacagtgctataaagatactaccagagactgggtaatttataaagaaaagtttaattgactcacagttctgcatgactggggatgcctcaaaaaacttacaatcatggtggaaggtaaagaagcaagtgccttctacacaaggtggcaggagagtgagtgagcacaggggaaagtgccatttttaaaccatcagattttgtgacaactccctcactgtcacgagagtggcatgggggaaaccacacccatgatccagtcacctcccaccaggtccctccctcaacatgtggggattacaattcaagatgagatttgggtggggacacagagccaaaccatatcacttcttatttagggcttgacagaaaagaagttaaggagaagcactgtgatgcaagtgagataattttatcatctagagtaaagtcagcctaataacctacgtaagcaacctgacttcactgggtctcatgccggagtcttaaaaatggaggcagttgtcctgagtgttcattctagtgttaaaccatgttgagactatgcatcttactaggctggtatcattgatcagtgttagaatgacatgtttcctggaactccaactcttgtgttttaaaaatttacatttaaacttctatgaaattagaaggtgttttatagttgatggctgcacttaatgtccttcccttcctccaaacttacagtaaatggaagagttattaagtcgatggtgtctgtagaattgaggaaatatggcatctgttagagactacagatttcttaagatgagcataagatgttaattagccttcatttagctcctttccggcaaaacttgttttctttggattagtatacttaatgaatataatgtgtcagttaccaatgacttacttaaagtgctgtccttagggttgaggggatgtgtcatctgactccagagtaggtttatctttttgggagacaaagtgtctacaaagtggccttcaacctttttgataatgacctacagtaaaaaatatgtattttaccttttgaccagataaactcacacgtggacacatgcacatgtttcataaaacgataattatcctactctgtgcgatgtgctgctgatgtttttctattctttcctatttcatttttttaaaatgctggtctcaactcaattaatttctatgggcattcgatccacttgattgagttcacatcccactaatgggtcacaacctacccttttaaaaactgctttacaaagttaattaaccaacaagaatgaaggctcccttattcacaggcatcctataacttccttttgcatgtgtgaaggggtaaaagaaaagatggatgaaataccagtaaattaataagataaactatcagaacaagtaaaatagaataaaaagtagaaggattttacaggcattaaaaagtcctcctaatgattaagcgctctttttttgtttgaattaataaagatggctaacaatagcctacttctgtgagaccacaggtaatttttgtcattgggattgtcttctgaaggtgtgatattgaagtctgaaatccgtaggctgtagaaagcctcaagcccaaggtatagccaaggaaactccacaggctgctaatcatggagtttgagttttaggtaagggccaagagaaagatatttgacttagctgctgatgaaaccgtgcgggttgccattaatgagtcctttcttccataaccctggttgcctgggaaaaatggtaacataaccagcatgatgttttcttcactatcatagagtgacatattttttttcagtggaagaaaggggacaattctgactaaatctaatattacaaacacattcttaccctagaacactcaaggaaaaacttgttttatgatgaactagagccatatggtacttaaaagtttttttaaatcatatttataagcttgtttgacttgtttctgtgtctctagaatcttgtggaagaagaatgaagttgctgattatgaagctacaacattttccatcttctataacaacactctgttcctggtcgtggtcattgttgcttccttcttcatattgaagaacttcaaccccacagtgtatccttttcaaggttgattatcttttttagaagtcaagaaacagtagttcattttggttttgacttgtctggatattttagtggaaagaaaaactgctctgggagtcagtccattaaatagtgctgactttagataactttctggacatttaaaataacagctattggtttaagattcttttaagtttatgaattatgactgtatgataaagtattacaaagtagtctatgggaatctgtgtccttgcctccttaaaaaaaagctccaaagagccaaagcaaacctgtcatttttgatagcttctgaaataataagcccctgtacctgttatttttgggctctgggggttgggtggatggccaatgcagttaaataggttcattccagtgtatcttaatagtgtttcaagctgctgttaagttgagcttttgggcaagaatcagtcttctcttattaatttattaaagatgttatccaggaatgtgcagccaagattttaacaattggtgattatgatgtaataaaatatcagataccctccaacgtgtaccttctgggaatgctggagtgatttgctgaaaattgtagagttctgaggctaggagtagcttcgaacttttagaacctccttgctgttgcaagccaactgcagcaaaacactgatttgcagggaagacttatttttccattgctcttaggggaagaaaaggaaaacaaatctcttttctctccatgttctttgatcagctcttcgtgaaggttaaatggaattcagattattctttgtgatcatgtgttctaggtttctgtctaaagtgttttttttaaattggaacacatttcctgtgaatgttttccatttttttttggtcttctgtcttgcaaattgtgtttgcagacaatggggctgcacatcattatgattacaccaagtgtcaggaaggaagcagtacattccaaagagatgggctctttattttctcgaaaaaccaatttggagttactcatttttccataacattaaatttcttacaggaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcacatatcactgtaaggtacagttagggtaacactttagaggtttattatttttaaaaaacttttcttgaactcctggccaacatggtgaaaccccgtctctactaaaaataccaaaattagccaggcgtgatggtgggcgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttgatgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagagtctcgctctgtcacccaggctggagtacagtggctctatcttggctcactgcgagctccgcctcccaggttcacgccattctcctgcctcagcctgccaagtagctgggactacaggcgcccgccaccacacccggctaatttttttgtatttttagtagagacggggtttcaccctgttagccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaatttgtattttccctacacttctttataagaatcctatgatgaagtacgtaatctttattatattattttacattaaccatcttttttttcaaattgttttattttttattttactttaagttctgggatacatgtgctgaccatgcaggtttggtacatatgtatacatgtaaccatcattttaatatctcacacatgtaaatgcacatctttgtagttaccaatcaaatgtatgtgaggcaatgaaaggcattgagcagttacagtaaagggcagacatcaggcctctgccagtatgtacctgctgtgccttcctgcctgccctatttctttgttttcagtgtgcatgccagtcactgctgcttctggagacaggatggaaggatacatgtatgtgtacatttatggagaaaaccaatttatagatgtatcagagctctaagggattctctttcacttccttgggactcccaagcagaggaattaatagattaggagggtcttttggggggttggtttaaattttcagggcgatagaggctaacttctcgttggccttcatgaattttcaatatatcatcttttcgctgacttatccctgtttgatttctgagtttggattaataactatgttttttaacttcaacattctcacaaacaatttctgcataaaacttcttctttaaagcttaaaaagaaaaaaaaatctacctaatggagcactgaactagaacacaaaatacttgggttctaggcctggttctgccatcaactagcagtgtgtgagtttgggcaagttttttcatcatctatccaggcctgctttgctcgtttgtcaaagagggatggctttgcagatggctaagtttccttcaggctctgacatctgcctcatgactttggcactcttgtcatgaagatgaagtgacagttcttttaaagtgggaagccagacacagggtttctagtttgcctgagatttccatatagggatggctggtacccaggttaccttttggaatgatagattctctgccagggaattctttttggaagagaaaagaaaa

SEQ ID NO: 15361 - DNA, 17132 bp, Human
  misc_feature (1)...(17132): n = A,T,C or G
aatctacctactgttctatatttttatttgttaaatctgccaatcctaaacccaacaaacctaaataattacttataaggggtttgtggccaatttataaacattttatactttatttaatatgccctattttcttttaaaagttcttcaattgtctgaactaacaaaaaagctacttttaaaaaatactaaatcatttgaattctaataaagtaaacaaacaaaacattgatgataacctaaagtgtttataaatgttccagaactgtattcagacaaaggtttcaacgtaaagtcatgaacctgaatcaaaccctaccaagtgcacattttataagagagttacaagattttctatatagttggcccagcagctctcattaagtccatgaaataccgcatattccatcttaaaacacacaaaaagagtataccatggctctgagtctcttaaacatttctacactttaattctaaatcttttttctggttggaagatgcccattcaccaagaaagacaattaaccattccctagagctcctttttttttgtttttgtattttattgagatggaatctcactctgttgcccaggctggagtgcagtggtgcaatcttggctcactgcagcctctgcctcccaagttcaagccattctcctgcctcagcctcccaagtagctgggattataggcgcccaccaccacgcctggctaatttttgtatttttagtagagacagggtttcaccatgttggccaggctggccttgaactcctgacctcaagtgatccacccacctcagcctcccaaagtgctggggctacaggagtgagccactgcgcccggcccagagccacctttaccagagattcaaccaggcctgaggtcttaggttgcagacaacagggagattcattgcagcacgaactcaggaaaccatttccttccatgtactatttggggttatcttatagaattcctggcatgcttggccagtatgctgcctggatgtatgttggggatatatgtataattttccctgtggctgtggccacagacccatcaccataagaggggttggtccacagatcccgatgctggcttggagttattcttattccctacccttttcacagaattgtctttgccaaagtccattaatataccttgattggattttgcttttttttttaatttttttttgctttacagatcttcatagtttcctgcccatatctctaaaagtcattttgcttgagttgatatcctacagttcttacaagacctttctctcccagggtcacacaactctcgccaatattaaattaatatcagcttcaatcacgggtctctccatgggtttcacgggctatttgctcgcagagtccagggacattttcctcatccattccatcagatccccaattgctttctctggcaacacactcctagtatttgtacggtaaagctgcctaaaaaaattaagtaattcaaactactcttgaccttactttacaccaccagggcaattagagtcacagtctgggtgtgtctgaggacagcaggccgccaaatcccagtgatttagagaaaaccgagcagaatttcccatgcctcctgcctcattgtcccccagcagaaggttccgtcaccccaggtgccctctagggtggaccacttccgagttcatccactgtcaggaaaaggcacatggcatgcaaccgcaagaccgatgactagatgtcagagctggctcccggttgggatatgagtgactttgtggaggatggcgcctaaatgaggcatgccaatttctgcaccagggtgacgaacataagggctccttaaaggctagcccaatgtatctgtatttccttggggattaaaacccatgatcttcagttcctcagagaactgaaagttgcaaggagaaatccagtaattcctgttatctgcaggctttataagtcagtggagcctgcggaagtggccagaatccagcactccaagcactgctgtcttctcacagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtgagcccctttcctgggaggaggatcccagacacccctcacaccctctctcctgtctgcagactttaagagactcaaggaacttaaagttggcccttagggggaatgtagaagctggcttggaacaataaccacttcaactctctgtacctcctgccgtcatcttaaaacaggggtgataacaatggttccctccagggttgctggggggactacaggagttggcaaatggaaagctcttaatgtagtatctggctcattatacgttccagataagggttagccattatgatttttattgctatttattgaatgcctgtatcaggcactataagcacatggtttcacttcataatctttatgaagagggactattactccccatgtagaggtgatgaacaaagaaagatgaagtaaccttatacagctactccttttcaccagcaaagcccagctcctttctctctctttccttttcttctttctttcttttctttctttctctctttctttctttctttctttttctttcttcctttttctttcttctttctgtcttttctttcttcttcctttctctttttctttgtttctttcttcctttcccttccttacttttttccttccttccttctctctcccatcctcatcatccctccctctctttgtctttctttcttcttctcctccttccttcctctctccctctcctctacttccccactccttccactttcgcttacgctttccttgggtgatatacccaatgtctggggacactgcttgctttctctggagtcaattgactccctttatcctacaggttaattaatttttgatgctggcaacttaaccctttcccgggactctggaaaggtacttattaccttaggaaacctgagacaccatggtgtggtaggggggccaggagccctgggtccagattccacctaccagacttgtgagcttgggaggccctgcccctccctgaaccaccagctcccctagtaaaatggcgaccacatccaaataccacctgtagcactggctggtgaagagaactcagggtgcctgaggcacccagcagagcctgcagcaaggtgggtatccatgagccagagccgctgctgttgctgtcactgggaaggaggattggagtgaggactggcaggctctgttcttccttggacgagcctctcagacccaggtggccctgccctttgggaggtaaccaaggccttctagatggtgttgtttagccaggatagcaatgccaagcctgtgggagccatgacaagattgttcaatgggaaaccctgacatgcaaggcaatgattttccccacttcacacatggcccgtggagcctgggtagccactgagttcccatctccttcctcactgatgaaacccggctgtctttttgttccttggtgagtccatcatgggggcttgaactctgcatctcccctgagcagctgtgtcctgcagagcatgtccgaagtccttgtcaaggctgcctcaccctccccatcctaccaagaggccatccccaaaacactgcaagagctaccctacagggcactcacagtcacccgagaatgccaggcattcagaataggattatccctagcgcccattgaccaagcacctcctataggtgctaatttttgtatttttagtagaggcgggtttcaccatgttggccaggctggtctcgaactcctgacctcaggtgatctgcccatcttggcctcccaaagtgctggtattacaggcgtaagccaccgtgcccggctgggactgtattttaacagttcaacatggtgggctttgtagtcacgcagacctaagttcaaatcctgactctaccacctatcctggctgtatgactttaagctagtcactcaaccactctgagcttggtttctgcctatgtttaatgggctaataagcatagttaccccacagggttgttgtaaggctcggagtaggtttgcagtaaatgtcagcttttataattattatcattataattatacctctttatttctaatccagtctgttatctttgcttactaagggcttaataaatatttattattattattgtaattattcaagcaaagccaagaggcaggatattgtggggaggtcatgagcaaggggctctgggcttgaattacataggttcaaattctgcctccgccattttctagtagggtgattgggagtgtaatttactcaactttctctgagtctcacgctcctctttaaaatgtacataacaaaagcacctacctacctcagggagtccttcatttagttcagagaagaaattattttaataagcactcagtgcaatacttaaaaacagtaagtgtccaataaaaggttttatttatctgtggtaaatgacctcaaacccctgggaattctctttcttgcaggtcatcaaacgctgtgacatcatactcgtgatggaaatcaaggacagcaacaacaggatctgccccatactgatggagaagctgaacaggtaacatggggaagggtgggccctctagggctcaaggtcaagtgcaagggcatctgaaaacccctgggaactgaaagtaatgtgagatcccgcacttgaccaccagttcacacagccagtgttgcccaggagtccagctcccttagccacggtcctgagaactttcaaccagttgattttactgtgataaaatagaataggggaaatagatgaggggtctggacacagaaagaaatgaaaaaagcagatgaggctgagctaaaaagtacagttatgaagaaaatgttggagaaaagagaaaagattagaaaccaatagtagaagaaagataataaaattacaacatgctcacacacaggaatattatgcagctgttaaaagtcatgctggtggccaggtgtggtggcacgtgcctatagtctcacctacctgggaggctgaggtgggaggatcgcttgagcccatgaggtttaggctatagtgagccatgatcacaccactgcactccagcctgggccacagagcaagaccctatctcttaaaaaaaaaatcatgcttgctacagaataagttagagctaaatattccagcacggaataatggccacaatatattgaaaaaaagcaagttgagaattgcaggtaaaatagcccatttgagtcatcatgttacatgaataagggtgtgtttgtgtttccatgtgcatagagatgaaagactggaaggatgctctccaaactattaatagtggttacttctggtggggggggggggggtgtgatcagagagctgtggtgaaaggggttagtgaaggagtgaggggcacttgcttcttattttagtactttttaaatctgagactctgttgcccaggctggtatgcagcagcaagatctcggctcactgcaacctttgcctcctgggttcaagtgattctcctgcctcagcctcccaagtagctgggattacagtcacacacccactatgcctagctaatttttgtatttttagtggagtcggggttttgctatgttgcccaggctggccttaaattcctgacctcaagtgatctgcccctctcagcctcccaaagtgctgggattacaggtgtgagccgctgcacctggccatctcagcaagaaacacttaatagggacttttgaacaaaagccatgtctgggtcttgggcaggagcaagatgagatggtagatcctggtgccatcatcccccaggctctgggcttatccatcatagggaaggcatgtgtaggacaattgtagggacaggcaagaatccatgtcagtctgcctaagggcttcccttatagtaagggaactgagtgggggacctgcctgagtcacccagccaggaagtggccaagcctacctttgaacttgcgtcacatctgatctcatagccagtgctctattctttgtcatctcagccttccttggagtgtccccagtcaggtttatgggagactgaggggacaggtttgtgggggactgaggggacaggtaggctccagtcatctcctccacagtcagtctggggcgagtcttttcaccaccagtggtcttggcacaccccaacctatctagactgtcgcggactccaagcagagccaagcctgtttgtctctttatcccccacaagccaggatgggccttagtcactttgcaactgagtcaccacaagcagtttgctaactcaggacttggcaggctatgttcaaaatagggccagtctccccaaagtggaagcccggcagaacctactgttcacactcctggggccccaggggctaagtctgccttagcatactgcatctgaagtcccaggaatttctgtaaggtctaagttggcccctaaataccccttctgctttttttccaactgaatctgagaatatgctgcagctttagacatgccctagatctttttgtgagcagatagagtgaaattatgttaggctctgcccagagtggagttatcagcaggtttggtaaacacacagaaagagtccgctttccctggtgcaggtgaggggcaaggtcaatgggacttcatggctgtatccccagcacccaggatataaacaacagtgaattgaaatcgtggtcccaaagcttgtaaaaaaatgcctgatggctttcagaggagagaatattcctgcttatcataaatgctcaggagtggttcgtggacacggacaggtggcctgatgacatttattccaccagaaagcatgagctgcagctgcagccatgggcatgagcggggtcaggggctgattctggccaagattgtcttctagggtctcagtggcctcccacaggtacaggccaaagcatgcgggttttggggtgagttggatctaggttcaaatcccagctttgggcttgcaaaccatagaaagggggtaatgataacactctcctcataaggcaagaaataatggctgtaaagatcgtggcagatgccacattccagccaatcaatggtggctcctctcattggactcaaaggttatgatgaacagtggcccttccacatgatgccattgggcgtatggaggcagattggaaagaaaggaacatgtacagtaggggaatgtttactcttcaagatgcagtgttaaatctttgttttctagaaattcaaggagaggcataacgtacaactatgtgattagctctcggcttggaagaaacacatataaagaacaatatgcctttctctacaagtaagtatcacctatgctccctggaacatggccaccaataaatcgtgaattgaatcaaaatgcatgtcttttcttcaaaaccaaattttgatttctaaccaattctcagtgttcatcaaaataattgctgtcaaaactaggggcctatgcaaagtattgactcttcaagctgaaaacacaaggggtctccaaacacctaatttgttggttggctccatggttggcaggccaggtgttctttactcctcatagtcaagtcctggcccagggctggaaagctgaggttctcagcacagctgattcctgaacttcgtattcttttcctcttcctgctagtaatttcttaagtctgaacattaacttttgggtgccacagataactagtatggctcagatcttcagctcccagattcgcaacagctccctggctgttgagaagagttgacttagccttgttctcaggaaaacgatcctgtgcttgagcctgctctggcttctgagaaagccatgggaacctacatctctgcttcatgaaagtagtaagaaaagggctgactcagctgggaggacttccttttccttcttatagggaaaagctggtgtctgtgaagaggagttatcactaccatgactatcaggatggagacgcagatgtgttttccagggagccctttgtggtctggttccaatctccccacactggtaagacccacacaggcctttctgtctgggacctccccaacggcccatgaatgcgcagcagccttgagcatgagcccattaaggaggcattaggctggatgtgacagtgcattgcttctaatacttcaatgtagacgatgcagttcagtgtgatggcaccaggcttgcttctcagaatgccatgactcaagacttccccagcccagaacccactttctggaagcaatggtagtccactctctttggagagtttaggctcatggaaattgttttctgcaattccttggtacctgtcaagtacaactcttccttcctttttaaaaatcctggctgggtgcggtggcgcatggctgtaatcccagcactttgggaggctgaggcaggtggatcacctgaggtcaggaacttgagaccagactggccaacatggtgaaaccccgtctctactaaaaatacaaaaattagctgggcatggtggtgcgcacctgtaatcccagctactcgggaggctgaggtaggagaatcacttgaaccagggaggcagaggttgcagtgagccgagatcgtaccactgcactccagcttgggcgatagagtgagactcttgtctcaaaaaaaaaaaaaaaatcctaagcaatggcttaggtgaacccctagcctagaggctcactctccctccagtcactgcatcgcagactcctccacaggccgcagcgggtgaggaaatccaaatggattgctccctgaactctaacaacagtacttgtactggcccctgattaagtgccagcctcctgtaatccttgcaatgactacaaggtagggagtaggattatctccactttacatttcaggaaactgaggtttaaaaaggcatggagtcacccagctactgaaatggacaggccagggttgtaacccaggccaccacctcaggagctcatgttcttttttttttcttctgtttttgagatagggccttgctctgtcatccagtctggaatgcagtggcatgatcttggctcactgcaacctccacctcctgggctcaagcaatcttcgcacctcagcctcgcaagtagctcagactataggcatgcaccaccacactcagctaattttaaaatttttaaatagcgagataggtctcgctatgttgcctaggctgttcttgaacccctgagctcaagccatctgcctgccttggcttcccaaagtgctgggattacaggtgtaagccactgtgcccagccagtggttaacatgcagtgttatgcaatgctcgatggagtcaagaatcaaatattttttcagtacctactatgtaccaggctctgttgagggcactggacaagacagaggaggtgacattgggctgtgacctgaagaagtcagccatacagagggctggagaaagggcattccacatggagggcacagtgagcacaaaagctcagaagtgggaaggaagctggaatatttagggggaccaaaaagaggatggaggagtgcagtggaggcctgaggaggagagctggcaatgaggacacgtggggccctggatgcagcctgctgggctgagttctggctcctctctgtgtgacttgagcagtgaccgccccacagcccgtgtctgttgaggtaagagtgggaatccaggctgagaatgaggggaagtcccaggaggagctgctcagaaggcgacagctgctgttagcaggtgggccaggaacggcttctgaggctcgcgcacattgccacactcaggctctcagtcctccaacggtgggggaaggttttcagacacttcacaaaagtctttcgtgaagaccatgctaatttttaaatagctttttggaacttttgttcttaattacaaaggagtataaactgacaagcctcatttttttttttttagacagagttctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagccaggcatgatggtgcatgcctgtaatcccagttacttgggaggctgaggcaggagaatcgcttgaacctgggaggcagaggttgcagtgagccgaaattgtgccattgcactccagcctgggggccacaagaacgaaactccgtctcaaaaaaaaaaaaaggaaacctttaaaaaaaagaagaaaatacaaccataaatatatgcaatttttcctgtcaattaaaaaaagaaagaagagggataaaatacatcagaaacaaaagaaaatacagatttgccacacacacaaaaaggggaaaataaaagcactcacaatgccagcatggaacacagttgttataagtaaaatgtttatttagaaacagaatgcttgttccctggtactgcaaggaaaaatcaacattcagataaaaagttttctcagcaagccaattttactttctgcagaaagggtgctccttgcagatggaacaatggcgagagcacacctgaataaaggagggaagcaatttttatcctttactcagcttgtccctgctactgtgtcctgtctctctattggctggagccagaccacacaatctaagctaacccgactggctaataatttaaacctttcttaaataggtaaaggcaagggagaacaaaggaaaagaggaagttgcttatgccaaatagggaaggggcaaaggctgtgagctggaatgtgcctgcgagctggaatgtccagcacaaatatcttggttaaggtacaaggacatagaatgtactatgtgcctgtgagcatgtctaacagctacataggatagagcttaacaaagagttattagcacaaagcaaggaggcttgaaggaagttagtctttaaaggaaactattatttctaacacttatgatttattctttaataagaagggaaactttgaagaggaaacttttttactttctacaacagtctaccagctttctcttagccatgaagggcaactgggagaaatgagtctttcgtgtactaaaaataggcagcctaatgaccccaagatcattaaaatctcggccactggctggaccctctgggaactggggacccagataatgcagcctgtgccttctggaggggacagccggtttccctccagcagtgtttatgagaccttgacaggggaagtgtgtgacccccgcctctttcctgtttctcagctgtcaaagacttcgtgattatccccctgcacaccaccccagagacatccgttaaggagatcgatgagttggttgaggtctacacggacgtgaaacaccgctggaaggcggaggtgaggactgctgtgtcagacgaattcccatctagcaggggcaggctctggtccctgagtgggatgagtacctctccagggagggggaggaggaagggcatgtgcaggctaccaccacttacagcattctttaaggcctttcttcagccctaagtatcccttttgctaaatctgcctgggtaccctgcatgtgggccttgggaattgccacactttcccattaataacagatgccaacatttactgagtgaatagctagtgccaggcactgtgctgagacttgacatggacaagtttatttaatcctcccaataatcccttgaggtagctacagtacctttctcattcccactttgcaattgagaagtgtaaggcatagagcagtcaggattgtttcagttgcaagggacagaatcttaacatggctcatgaaaaaaaggagcaattgattggtttgtgtaactgaaatgtccaggagtacttcaggcatagctggatccagggctcagacaaggtaatcagagcttgatttgtctcttcctttctatctcctggttgccctttcctctgtgtggctccattctcaggttggctccatccctgggatggcaggacagccaccagcagcctccagaccaaaataaattttctttcccacaaggcaacaaatagtgtgggactgagtctcattggctctgactgggtcaggtgtccatccctgaaccaatcattgtgatcagggtgttgagctactctgattgactaaatctgtgtccaccccagctccaccccaaactcagtttgaggtggaggagggatgggtggtctcccaaaggaacttggggtgctgttttcacagaagggggcacatatttgccatccctataggctcagttctttccacttttggaagagaccacttgtggctgtgaggggctgtgaaagctcttggtaaatatggaagtgcacccaagggttcttcttctgtatttctcttttctcgtttcggaatgtgactcctgtgatcccccttcctcctcttgagttctgctgctcaaatgcaaaatgaatcaaataaagtgtgaacatagtccatcagagctggggcatggaaaagaccaggggtgtgtttcattgcttattaataaataggtcaaaagaaagattcattctttccaaaaattatgaaatcattcacttattaaacaagaatgtattgagcatctattgagtgttgggctgtggggaggcatcagtggcctaaaagtgaacaagaggggaaactgcttcagtgaagcagactgggatgtgattctttttttttttttttcttgagatgaaatctcgctcttgtccccaggctggagtgcaatggtgcaatctcggctcactgcaacctccacctcccgggttcaagtgattctcctgcctcccgagtagctgggattacaggcatgtgccaccacgcctggctaatttttatatttttaatagaaatggggtttcaccatgttggccaggctggtcttgaatgcctgacctcaggtgatccacccgcctcggcttcccaaagtgctgggattacaggcgtgagccacggcgcctggctgggatgtgattcttgacttcaccatttgaacctcccagtcctgtggcctagagcaggtcacttaatctctcaatcctgtttctatagaagttagtgggctcttgtacctcctattgtttattgctgccaggtgtaaatttaaaaacacctagtgctaggcctggcacatagtgaatgttcagcaaatcatgtctatattagcagaagctggtgatcactgaggttaaggatgacactctgtcctcaactgaacccatcaatcacggggaaaattgtgatcaccaaggtcaaaataaaatgttcttgaagaaaactctgaagtcagcaatgccccaccaaacaatagcacaaacaaggaaatctggcacttcctctggattgtggaatgttgaaaattctgttccaagagccttgcagggaaaaatatttccaagataggaagtttctcttggtggccttgggtgggggtggacagctcactcaatggtcccctcccctgaagatgcctcccacctcctcaagggactgaattttcacagaaataagtttccaacttcaaaacaataggagagaaagagtgatgccagggttgtcaatacaccacccaaattcacttttcctgcttgaaagcaaaaggcgttgattcattcgtatatttacaccctacagtagtttgagccagggacaaaagatgtgagggaatagattcactgaaattttttttatccacacctgactctgcatgctgaattatggaaatgtggcgactaagaacagcaaacattctccttcctgttaagaacatcctccctggtacgcactcgcctgtcatcgactcatcaaaactgtgactcaattttaaacaacaaaaagaaatttttaaagaccttatattcatttgctagagctgccataacaaagtaccatactgaagactgggaagtttaaacaatagaaagtgagttcgtcaccgttctggaggctggagtcccagaacaaggtgtgccagcagggctggtgtcttttgggggcctctctccttggtttgtagacggccatcttcttccagtgtctttacatggtctttgctccacttttctgtgtcctaatttcccctttttacaagaacgccagtcatattggattagagcccatccatatgacctcattttaccttaattccctcttgaaaggttctatctccaaatacagtcgcattctaaggtgctgggggttagaacttcaacataggaatttggccggggcgggagcagggggtagacaagattcagcccataacagaccctgttgtttactgggcctgggacgcagagtctttgctagagtccagtgtgaaagcattctgcagcagcacccaccaggtgacagttccaaatcttgtcttttagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggtaggaggccctgcagggtgctgctggctcaccacagtgcttggtgtgcactaggaaagacgcaaggtggctgggcactgtggctcacgccagtagtcctagcactttgggaggcctcgatggatggatcgcttgagtacaggagtttgagaccagcctgggcaacatgatgaaaccccgtctctacaaaaaatacaaaaattagccaggcatggtggcacacacctatactcccagctactcaggaggctgaggtgggaggatcgcttgagcccagaaggtggaggctgcagtgagccaggatcgcaccactgcactccagcctgggtaacagagtgagactttgtctcaaaaataaaaaataaaaataaaaataagaaaagcacactgcttgcagagctgagtcaattaaatgtcaggcccctctactgggtaccacatgtagcgtatgaaccacaggaccctatgcggtggccctgggcactgtagcttagcagaggtaagcactggcttcgctatcagataggcctggatttaaatcctgacattatcacttcatatgtctgtgaccaagagacaagctctctgtgtctttcatttcctcccctgtaaaatggaagttatcctagtgcctcactcatgaagatccgatgtggagtaaatgaaataacatgtcaggctgctagcacaatgcctggcatacggcaagtgctcattacattcatgggctgatcattgttccatcacaaagacttaccgcaattgatgcgcccaatccccatcattaggcattgggttattaccaagggtttgctgttataaatactgctaaaatcaatatcctctgtgcattttgtgcaagtatttatgatttcctcaggaagcaaccctaaaaatgagaccaattagtgcaacggtatttatatttttaaagctttagctacatattcctaaatgcaatgcatacatttaagtcctagcattccctcgtgctttttaaagtcccttcagggattttcaaacagctttcatctttgctccttcaatggggacagaggggggagtgcctgaggcgtgtgaatgttagtgatcttccatcacagagaccacaggtggggaaacccctaggagcctggtcccaggtggtggccacagttcccagagctcagcctgccacgaggaagtgtgagatggccatctgcatgagagccaccaggccactcgttttcacttcctctcggagttttttttttttttttttttttttagacagagtctcgctctgttgcccaggctggagtgcagtggtgcgatctcggctcactgcaagctccgcctcccgggttcacgccattctcctgcctcagcctcccgagtagctgggactacaggcgcccgccaccacgcctggctaatttttttttttttttgtatttttagtagagacagggtttcaccatgttacccaggatggtcttgatttcttgacctcgtgatccgcccgcctcggcctcccaaagtgctgggattacaggcgtgagccaccatgcccggcctgttcctcttggagcttttgaggctggtgtttcctttgcagaagttatcactctgcaaagtgggaacccaaggcggggagttacaggggtctaagtgcccagaccccctattttgaaggacttccagcaaagcctggacgatggccactcactcagttacacatggcagttgtgtgcccgtgggtaggtcaagtcccttctccagcgccattcttctcccctggcaaatgagtgggaagtgattgaaaatgatacagaagaatcagaaggcaacatggccacagtagatcaggtcaggggtagaacaggttagaaaaagatgtttactaaaaggatcctgattttatacacatgtatcccaaaggatggtgggattacatgtgacattttaaagattcatttcttattttgatgctctgaattttgtttctcataacaacatgtat

SEQ ID NO: 15362 - DNA, 51291 bp, Human
  misc_feature (1)...(51291): n = A,T,C or G
gatcctatgtctgtttttgttttgcaagtagagtttttagtaaacatagctatgattattcatgtatgtattgtctatggttactctgtgatacaagggcatagcttagtgttttagaccgagatcctgtggctcacaaagcctaaaatattaggttgatgcataaataattgcggtttttgcaaatttttttttttggcaccaaccaaatatttactatctagccctcccagaaagttcactaatctctgatttacaccatagtgcccccacctccgattctcatgcaggtcaggattatatctaaaaagtgccataacaatggataactatatggtatcttcttacaggtaaatcttattaccttatagtgtcacacacatcaaacatttttagacaataatgtagacacagataattgcaaagtccataaatgcagggagacagacacacacacacacacacacacacacacacacacggtatttgttggagaatcaagggaaaaaccatatctctaaatggtagggagtgaagtcttcctggggcatgtgatacaggatgagtagaagttagacaggtgaaggcaaggggaaagtcattctaggtagaggaaggcagcctaggcaaagcatgcaggtaagacacagcatgacagggaaaaacaggtaatgaggagctaatgaagttgaggagaaattttatttagacatatggaagaaattccaaatgattggttgtccagttgtggcactttctagctttagaagcagtgatcatctcacacctggacataaccaagtagtcatccttcattaagcagaaggccttgttattgagccatgctgccagaaatttaggtgatatcaaatgatgtctatactgaaatcgataccctcaggattctcttagacccagattccatagagctctgctaaaaagtcgtgtttatgtaacagtatttattctcagaacagggttggacggcttaggagcagaaaggcagaatgtatctttgcggatttgggtcatagtgggctgtcaggatttaaattgtgcaacattgattaataatgggctggtttgtacattccttgcaagtcatctttaaaagccaatgacgtcatttcaaattaggattctcagagataatttctctctgtattacactgaaaataattttggaactatccttaatgccacttaaagcctgaaattgaccagtaacttaatttgatagaatataaggcgaacacctcaactatattaaattgtcccatttgggtggacactcctcgggcaccctgttccgccctacacacagataatctgggggcgctcgcgcacagctgtcatcgtagcagcagaggccactgtcaatacaggtcgcctgactgatcgtctgaccaaaccgggctaacccgagggcggtaaataagctctggccatgaagcaatgactccgcaggattgcgcagggcagtcacgggcgttcactccattttctgttcgttgtgctgaggcctttccaccattaacttaccccaactcccccgcatagggcaatacgacccctccaaatatcaaacgctaagcatattaaaataacaaaatacctcgccgctattttatcaccagaccctcctcccagcggggaacgcagagtagacagagaggcaagggagggcaaggcgattgtgacagcgcggaggggtgaacacggcccagctgggcatgaggtaaggtggggagactacctggacagcaagcgcgcaggcgcagccgcggccgcagggcccactggtccctttctagtaatttcgctaaccgtgacgtcatctcggtgcgccgttacagcgcttaactggaaactgcgatttagtttttggtgaaaggagtggaaaaaaaccatgaactgacctaccccgccccattttgcttttagtccttcacactggcttcgcctgcactttgggcaatggagcgggaaaggaaaaggcacgcaggctgagctcaaagtcgcgccagccggggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcaggtgaggccgcctggggctcgggccgggatgggggtggcggcaggacctccgcccgccgccccaggagaccttttggaagggcctgggagaggggtcgtcctcggccattctcccgggcgtcgtcccaaattagatcacacccaagttcgtgggtttgcgccttgggacaccgcaatggtttgtggcgtggcggcgcggcctgtttgtgggacgggctgatgccgcttttctcggagccttccttctctggtatccgccgaccctcagcctcctcccccagttccccgccctccgtcgcctcccctccaactcctcacaaaggaaagggacccaccgccagcctccgggcggggtggaggctgggcgggggcgagggttcgctttagctcaggctgcggttttgtttcatgaattaaaaaggggtgggtgggatcctcgttgttttacgtgcctgcttgttaaggtgggttttggggtgaggtgcatgtgtatatttagttctgcattttaactcctgaaatctttcccaccttgcaacctttaaaaaaaaattatgacgtagaaactgtttttagctccatcttaagtaatagtgatagtactaggtttaaggagaaaagtgaatgactttctttcactgatgacttgctctttcccttttagtatgtttatcatctcttagatgccaatcattgggtaggtttttgtttgattttagaggggcgatagcgatgttgatattagcggttgcaatcaaataaaagaaaatcggagtgaatgcagaatattacttaaacttggttcaggaatacaaatcttgcagttaattaagattcttggtggaatttaacaaataattttagtgtattgttgaatacgtcgtgttttccataattactgacttaatctctgaagatcgcaaacaacgtgaacagtttgtgacaggaaacaacaattcctgaaatgtacctatcagtttccccagggacagtaggtgattggggtattggtttaacgagttccaaaggtagtgtattttgtgaagcagtgaggtgtgtaacatcaaatgagagaaacttttaccaccaacagaattatcacttttgtttttgtctcccagtgcttgtaaaaattttccttaccatttttgtattttcaagcatgcggaaagttgaaagaattgggaagtggatacacatatgtccatcatctacaattagcattttacggtattataatcgattatcaagttcatttaattttggggagcaattcagagtaagttgcacgtatcagtagatgacaccagtacatgtcacttcagcattgtgaacttatttgcctaagttcaacttcattttttacgttttttgacgtaattttggcagcagtgaaatgcatatggttgccattccgtgagttttcataaatgcttacacctgtgtagcccaagctcttatcaagatatagaacattataattgactagaaagttttttcttgccttttcccagtcatttcagtcacttggcctttccatcaaccacccagttttttttttttatgccctaagttacagagttgcctgttttagaacttaacattaaatgggatcccatagagtctatagtagctgtgtgtatttttctgggtaaggcttttttttcccactcagcataatgtttttgagtttcgtctttgttgcgtgtatcagtagttcctttctttttattagtgtgtagttttccactgtatgtgtataccataattaatctattcactgttgaaggtcacctgggctgtttgcagttagttactatgaacagtcttatacaagtctttttgtggtcttactcttttatctttcatggttatatacttagacttggtttgagtaggtcatagggcaattgtatgtttcagttttgtgagaaactatgttttaaaaaatgcttctgggccggatgcggtggctcacacctgtaatcccagcactttgtgaggccgaggcgggtggattgcctgaggttcgagaccagcctggccaacggggtgaaaccccgtctctactaaaaatacaaaacttagctgggcgtggtggcaggcacctgtaatcccagctactggggaggctgaggctgaggcaggagaatcatcgcttgaacctgggagagggaggttacagtgagccgagattgcgacattgcagtccagcctgggcaacaagagtgaaactccgtttcaaaaaaaaaaaggagtgctggcttcagcagcacatatactgaaaaatgcttgtatcattttaccatcccgccaatgaagatacatgggagttcctgttgctccatatccctgctaacattttgatattgtcagtctctgtaattttagctattttagcgggtgtgtagccatattaagttttaaagctctcggatctcttttctaggattcctaattcatgcctccaccatcctgggtgctttcagcattttactgcaaaagattagaaataatcagtattttataaatagaaaaattcctttcagtcaatatatgatgttatagctgtgaggatgtttttgctttttgtgatgttaaaattataaattctgtgaacgcttttattttactctgctgtaaccaaagtgagattttttttttttttttttttttgagatggagtctctgtcaccccccaggctggagtgcaatggcatggtgtcggctcactgcaacctccccttcccgggttcaaggattctcccaccccagcttccctagtagctgagactacaggcgcatgccacaccacacccggctaattttcctatttgtagtagagacagggtttcaccatgttggccaggctggtctcgaactcctgatcttgtgatccgcctgcctcggcttcccaaagtgctaggattacaggtgtgaaccaccgggcacccggcccagtacgaattgttaatagataaaattaaagtctttctgaagtagccttttctgatggtagtttatttttaaattcttgatcattgttttatgttgaagcagaaaatgtgataaaaattgacgcttatcaccacaccagagaacctgtagacaagttgggctttgtatatgcaagggaaacagatacaggaaaatgtggaagaaaaagaaaagcagttttcaaatgacctatttgtaaaatctacttgaagcacaaaagatatgccattttataatttaaaaattttaaagggtttgattgaaactgtttgttacaaatgaaaatttgtcattaaaaatacttaatgacattaaaattccactgaaagtgtccagttagaaattgggaaatatttagtctttaaaatttgtacctaattttggagggtcagagggtaagccgaagacctccagaggataatattgaaggcttatgctctgtatcagacaaattccgttttctataagttaaaatttctttcaataagtatttctatgtaatgtagattccttaacacattataccaaaattctgtttatatgaacatgctgtaataagtgattagatgaaattacgttaaacttcttgggtaaattgtaaggtggtaatttattttcctatttttccattggtttctggtcgtgagtaccaacaggcagaaacaggttgccttaattttttacagtgctatatacatttggtatttaataatgttacttgttcaaggttactaataaagcttaagcttttttccaatttagagtgaaatttattattcacggagcactcagaatcaactgagtaacataaatttttacttacaggttgctagaataggtagtgagaatataaactgcactgtgtacattccaaggtgctgtcattaatagagatttttgtaatacaggttttgagtatcccttatgggaaatgcttgggaccagaagtgtttgggactttggattttctttttttttggattttggaatatttgtatatacataatgagatatcttggggatggcacctaaatataaacatgaaattcagttatatttcatgtacattttatgcacagagcctaaaggtaattttatacaatattttaaataattttgcgagtgaaacaaactgtatacattgaaccatcagaaagcaaaggtgttacatatgggatttttccacatgtgatgtcatggtgttaaaaaatttcagattttggagcatttcagatttcatatttttggactggggatgctcaacctgtatgtaagtaaatagatacaaaagcataaatgtgtagtggcacaaagtccctgtgtatgagattttttttttttggttaattgttcatcatcagctattgaaaagagctttgaggatttccaagtatccacgagcaagataacatctagaagaatggagagttatatatgtgagacattagtgcagataatggaggggagtttctgtgtaacttctaattagcttattctgggatttcatagactgttaggttatgtgtaaaattttgaagtacatttacttgaaatgttcaggcagtatatactctggttttagaaagtgccttctgtcagtgcaaacttctgggaaaatattaatatacttagacataatttaaacgtattgagtcaaattgagcctttctttgataaggcaacttgccttagggtcatcatcacacacatgatttaacgttatactgtatagtgtggatctagaactatactgtccactttgataccatcacccacatgtggttaagtacttaaaaagtgagatgtgttaagtgtaaaatttataccagattttgaaaatttggtatgaacaaaataaatatcttaatacttttgatatattatgtattgaaatagtattttgcagatcgtgagttaagtaaaatatcaaaattaatttgaccttttattaaaaacttttttttcagtatggctgcttaaaatttttaaattacttgtggcttatatatatttctgctggacaacatcttatccagaaggttggattgaatcagtatagcaagatatctgagaaaaaaaatgtctgtgagatcattgttttcttatttgctttgttctaatactggacagctgaaaaactcgttatttaatgattctgattaacagagattgcttagctttttttaagaaagagcgtaattgaagtgtaatttgcctaccatacagttcaccattttaaagtctgtaattgatgtaatacattcacagggtcgtgtagtcaattttagaacgtttagaaccctcaaaaagaaacgctgtaccctttagcagttgcccttcgtttctccctgggccccccagccttaggcaactactgatctattttttgtctatagatttgcttgttctgggcgtttgttgtaagtggaatcatgtggtcttttgtgattggctttcacttagcatagtgttttcaaggttcatccctgttgaagcatgtgccggtacttacttcctttttattgccgaataacattccattgtgttgccaacagcattccacattttatttttctatcacgtggtggacattgggttgtttctactttctggctattgtgactaatgcctctgaacactcatgtataagtttttgtggggacataacgttttcatttttcttgggtgtagatcttggagtggaaattgctgggtcaaagctctatgttgagctttatgaggagctgccaaattattttctaaggtgtctgtaccattttacatttccactagcaatgcatgaggattccgataaccacattctcggtaatacttattactgtctttgtgattatagccatcttactggctgtgaaatggtatcttactgtgattattttgctttttattttcattattatttttgctgggggcactctgaggaaaactggacagcctgctagacaaatttgctttttgttatctgagcagtagttctcactgtggtttggggagtccccataccctgttaagggtaccatgagatgaaactattttcatagtaattctgagatgttatttttatttttcagtctaattttctcaaaactgggcagtgcacttggctagagtctttaaggtgtgggatatgacaacagatgtgaaaatccagctgtcttctattacaagactaaagtgatttccaaaaatttaaaataatgccactcttatcactgagaaaatagttatttttcataaggatgttatttttattaatatataatgtattatttttaaatgaatttatttttaaaggttattcagttttaatttgtaatattataaatatcaacagctataacctaaacaagcaaaactctttggagttctgaagttgtaaaatggtgtcctgagagcaaaaatttctgtggtggcgtattttatagattacgtacttaaaatatcgggtagtggctccaataagttgccattacctcttgcctagaaactgcagtagcctactggtcagttgcctgacttctataactctcccaccagccattccaagagtgatctctgaaaaacgttaatcagagcatgccaccctctgtgtaaagctaatggctccctgttggtcttagaatatataatggagtagcgaggccctgtgtaatacggttccatgccctctccattttttgcagatgccttctttctttgcttgcttggctgactacattgaccttctagttccctgacctgttaatactttttttcctgcctgaggacttctgtacagtttgttcttgctacctagaatgcaagaacactctttgcccattccttttccatctttaaatcttaatgcaaaggtcagtttctccaggtagtatctatttctgattgtccagactggattgggatcccctgttggatttctcacagtagcctgtttttgataagaattcatcacaactaaaaattgtatatttatgtgattccttctctttagagaggggctgtgattgttcaccattgtgttaccagagcctagggctcaataaattatttacagatgaatctagtccattatgtacaataatacatattcagtaataactacttattgttgaacctttactgagtgtagtatgtacataatctggtagctcccagtccttttgtggaagcttcctcttaagctgttccccccaggtcaccactctccaggcacaactcttgactgcttcatgatgttcactcttgcttctctgcctggaacattactcttctagaaccacctttcttagctggagattctcatctgaaccacagagcacagaaagtgatatgaatagctatccatttcttttcaaagatggttcataatgaatataattttagatgtataggagagaagttaattcattacatagtgagtggtttgttggtaaatgctggtttatcaacccgttcttcaggaaaaacactgatttgtagtgtttgctggatttccatgatgtaaatattctcactgtggcagatttcaagataccgttattaaactggctcacaaaatttatgaaaatttaagagccattgcttataatgggtgccttagggcagaggccagcaaactggtagtcgaaatctactgtgcccatttgcttatgtgttatctatagctcctttcagaatagaccgtgtggctggtagagccaaaaatatttactgtctagcccgtaacagaaagtttgcttaccctggtattagggcttcctgttaatatatcttgttcatcaaaacacttctcattggaaatttttaccatgacttattttttatagaaatacaatgtgagctgggctcagtggttcatgcttgtaatcccaacactttgcggggccaaggtggcaggattgcttgagcaccatggctcagtgatcatggctcactgcagcccccacctcctggagttcgagaccagcctgtctacaaaaaaataaaaatttagctaggtgtggtggcacacacctgtagtcccagctagtccagcaaggttgagcccaggagtttggaggttacactgagctatgattgcaccgcagcattccagctgtggtgacagaatgagacttggtctcttaaaaacaaaaaacagtatgagccacatatgtaattttcctattagccactttaatcaaaaggaaggactgaagtcaagttttcaatagtggtgactcacacataacaaaatttatcatgttaaccatttttaagggttcacttcagtgacattaagtacattcacattgttgtacaattgttaccaccatccgtttccagaactcatcttgcaaaactgaaaccctggaccgtttaaacagtaactccccattttccccattcccccacctctagcaaccaccattcttctttctgtctctgaatttgactactctaggtatttcatataagtggaataagacagtgtttggccttttgtgattaacttatttcccttagtataacgtccacaaggttcatttatgttgtagcatgtgtcagaatttacttttttttttttttttgagacaggtctcactttgtcacccaggctggagtgcagtggcacaatcatggcttgctgcagcctccacctcctgaagttcaagtgatcctcctgccttagccccccaagtagctgggactgcaagctcacatcaccatgcttggctactttgtatttttttgtagagacagggtttcaccatgttgcccaggttggtctcaaactcctgagctcaagcgatctgcccccttggtctcccaaaatgctaggattatacaagtgtgagccaccgcacccagccagaatttactgtgtatgactgaataatattccattatatgtatgtaccacattttaaaaatccattgatctgttgctggtcgcttgggttgcttccaccttttggctattgtaattttaatatgctttatttaacccagtatgtctaaaatattttaaggtgcaattgatataaagactataaaatatcttgcattttgaaatactaagtctttgaaatatattttgtaatttacacttaagcatacctcagtttgaagtagccacatttcaggtgcttaatagccatatgtagctagtgactgctgaattagcacagctaataaagctttcaggatgtgcttccacctgccttttctcctgttttcattgcatttcagccagtttgtattgtctcttcccctaccctcaaatatcactggctctttcttcccctttttgaacctttgcaaatgctgttaatgacaatgacataatggccaatatttattgcaggcatgatttataaggcatgatgcattatatttttttaaaatgtcacataactttatgatgaaagcactattattatcctttttttaaaaaatgaagatgctggccaggcatggtggctcatgctgctaatcccggcactctgggaggccgaggcgggtggatcacatgaggtcaggagtttgagaccagcctgaccaacatggagaaaccccgtctctactaaagatacaagatttgccaggtgtggtggtgcatgcctgtaatccccagctactcggaaggctgaggcgggagaatcgcttgaacctgggaggtggaggttgcagtgagctgaatcgtgccatcgcactccagcctgtgggataagagtgagacttcgtctcaaaaaaaaaaaaaaaaaaaagggtacaaaaaatagccgcgtgtggtggtgcatgcctgtagtcccagctacttgggaagctgaggtggaagaatctcttgaatctgcgaggcagaggttgcagtgagctgagatcttgccactgcagtccagcctgggcgtcagagggaaactgtcttttttttttttttttttttttttttgagaaagggtcttgaactgttgccccggctggagtgaaggggtgaaatctaagctaattgaaaactccgccccctgggttcacacaattctcttgcctcagcctcctgagtagctgggattacaggtgcacaccaccacacccagctaattttttgtatttttagtagagacggggtttcattatgttggccagactggtcttggactcctgacctcatgattcgcctgcctttgcctcccaaagtgctggaattacaggcgtgagccaccgcgcctggcctatgtcttaaaaaaaaaaaaaaaaaccagaagatactgagactcatattaataatgtgatcaaattcatacacatattaagtagtagactgtagattcaaacccagtacaaacttgggaggcctcaccgatccactgccccaaactgccttgactttcctttgactggcttttcagtctttaaagttcattgaatagctaggtgtggtggtgcaagcctgtagtcccagctaattgggaggctgaggtgggagaattacttgagcccaagagttccacgccagcctgggcaacatagcaatactctgtatctttttttaagaagtttatttaaatattagttcatcagagggtaattggactcatcagtctatgtcagatcattgattataatctctgataacattttgtgattatatggattgtctccttcacccagcccccctgcccccgagtactgtaagaacttcaggggcagggactgttttgcttactttctaatcccatgttgcctagcattgtgtcctgggcacacactgagtagacaagtatttattgaatgaccaaatagtgttttaaatatttatctgcaatattttgtacctagttgggattttttttttttccttttttagacagaatcttgttctatcacccaacctgaagtgcagtagtgcgatcacagctcactgcaaccttgatctcctgggctcaagcgattctcccacttcagcttctgaagaaactgggactgcaggcgtgcaccaccttgcccagctatttttcttattgggtttttttttaaaatttttttgtttgtttttatagagacaggattttgccatgttgcccagacaggctggtcttaggaatattttaacaatgtgattttgaaaaagtgtgtttattcttagtcaacttaagtgtctgatggcattattacagttactttcctgtaccagcagctgcaactacaaaaaagataagagaggtgatagatatattagcttgatttagtcactccacattgtttacatatatcaagacatcatgttgtactttataagtgtatacaatcatgatggcaggcggattatgaggtcaagagtttgagaccgtcctggccaacatggcgaaaccctgtctctactaagaatacaaaaattagctgggcgtggtggtgtgcacctgtagtcccagctactggagaggctgaggcaggagaatcgcttgaatccgggaggtggaggttgcagtgagctgagatcgtgcgactgcactctatcctggcaacagagtgagactccgactcaaaaaaaaaaattaatttgaaaagtgaagtgaaactatacaaataccattaaattgagattaggagctttttttagagactgaagttgatacttaaatctgctgtttgcagagactgttggattagcatacttcacagattctatttattataggcatgaaaatatatgtgtgtatttgcagaatattgttgctagacctgaactctgatttttccaggtaaatttatacaactatgagttagtttgatgtcctgtagatatggcaacagtctgcctggtttactggttaagcagctgccatatagatgtctaaaacttgggggtaattttttttttaactctttaaagctctctccagttttcttaaaggatataacttttacatttaaaaaataccttttacatatttttgctttaaaattaagaaattcaaatgatgttgaaaagtataaaaaaggggactgggcacggcgcctcacgcctttaagtccagcacttcgggaggctgaggtgggcagatcacaaggtcaggagttcaagaccagcctggccaatatagtgaaaccccatctctactaaaaaaataaaaaaattagccagtgtggtggggagcacctgtagtcccagccacctgggaggctgaggcaggagaatcacttgaacccgggaggtggaggttgcagtgagccaagatggcgccactgtactccagcctgggcgacagagtgagacttagtctcaaaaaaaaaaaaaaggtgggagggcccattcaggataaaaggtaaagttaacttttttttttttttgggtgattctgtccagaaaggtatttatatgttcatatataatttttaccttttgttaagcaaatggggtcaaccacccacaattttctttatcttactcgttctacttgtgttaccttggtagtctttccatatagaactagctcattagactattacttattatttttatgatttattgttttggtttgcttattaatattttgagaaaggagagcatgaaccttagaattggagaaatctgatgatgggtaaggagctttaatcatctcagcctcactggctacatttttaacatatcgtgtaatacctgcttcagtacattgtttggaggattttgtgacatcgtatgcataaagtacctgactcagagtttatatgatttacttatattggtttctttccccacagccttttgttcaccggtgaattgagttttaagtttttgcaatagaaggaagtatatctatcctagcatgtgaatagtgaaacatttagtttgttattcttgtcagatttaaattagagagaatctaaaaaataaattttctgaacgatacactaacatttgtggctgtgtacagttttatgagagagtgcccctttctcatacgtgttacatattcagtgtagtagtttctcatacttggcatccttgtataaagggttatgcagtgttttaaataagactactataaggttaaacatcagactcttggagaatgataactgacagaaccatgtatatggatgatttatggacattttttcaaatactattagcaatattgagtaaggagctaattcaaaaatagactcttgaaggatctctgccttaaaatactgaaatagcaaagatttgaatacagtattcagataactatttagagaatccttgctaaatgctgttaatatgtgattctgcgggaaatgaaattgtgtatgttttatcttcagagctgaagtaaattttacttttggataggttgattcccaactccccggatgtttaataggtgagatggagaatggttgtttaaaagcaagtttggatgtttggattttgaaatgtttgtaaagggtgacaatgttgcttttaaagtcagattaactccattttcagagtgtttacagttgagagtttatccttgcataattagattagcaatatttgaatgtcttagtgaatgaattgtgcccaggaaatttccgtatgtctcttaattctcccatcagccctgcagaataagtatctctattcctgatgaagaaaccaaggctcagagacaggtaacatcctccaggtcacacaactagtatgtagcaaaaccaagatttgaattcaggcctacatgtttcaaaaatactctttcctaaccttgattctcctctctttcctccatatgtgtgtcttattttcttctcaaaaacaattgagaacagggagtaagcaaagtcagccctcagcagctgagattggcaccataaaagttgatacactaaatcttgatacattttcatttcagggcagcatttcacattctctgcgtactcttatttgatacggttttctaacttctcttaattatttgctgcttcttcctcagattaaaaatagaaaatttaggggagaaagaaggcatgctttcaagacaagaacttgacagtctggttaaaaaaaaataagaaaaagaaaaaggcagatacaagataccttgagagtctggacagttatcactatattgcagaacagcagttgatattcacaccagtaactcagcattatcaaaagttaaaattacattcagtagaatggaaaacaattttggtgctcaaacagaggtaaccttcagttagctggagaatccactcatgtgcaacacctggcttttggatgatgttgaaaaaaatggggttgctgaaagttgttttgtctgtgctgggttcattttgaaatcattacattgcttattcaaggtgcattagaattttgattcttatggttgttgagaaagagtttagtaattctcagctttcagttctctggcctgtagttattgtaggttatcagtgcaagaccagagttggatgtacatttgtaggaaatatggatactttgaggcccattctatcatgtatctttcattttgagttaatagtgaccacataggcttaaggataaaaataagttaatctaggtaatctttttaatggaaattacaaaaattcttcctttatggttctggctattccctagatgaaaatatttttttattattgttgttattattatttttaaaacggagttccgctcttgttgcccaggctggagtgcaatggcatgatctcagctcaccacaacctccacctcccgggttcaagcgattctcctgccccagcctcccaagtagctgggattacaggcatttgccaccatgcccggataattttgtatttttagtagagacggggtttctccatgttggtcaggctggtctcaaactgccgacctcaggtgatccgcctgcctcggcctcccaaagtgctgggattacagatgtgagccactgcgcctggccgaaaatattttgtataattgtaataagttttatttttctgcagaggaatagtgtcagtgagctacctctgtctaaacagctttgagattttctaagatggctaattaagtttttccatatcaatactatttagtttctgattcctgctgttgtatgataaaagtgtagattaaacagacaaggaagttacgttcaaatgttagtgataaaatttctagaaattttgaagacagtgtaatctgaaaactttctctttattctgtaggaagcagaatagaagtaaaagatatttgaagtacgtgcagaatttttagctgtaggacaaattccatttagataaaaacactacattatttaacttgatttaattttctaaaatatggtttattcggaaaagtgtaccatatctggcacggtacaattaaacttaagattcttttacctttgtttcaaatagagtggcagacagctaaacttacaaagttgcttatttcttggtttttgcttgcttgttccaagttttgtatattttttactcagaacaaatcaatttaacagtagccttctacttggaagtggttctagtatctaaattaggtgacattggtggtttgaaatttaaaataagaactgaattatgaatggtagtcatatgcagttgtctgtagttccctagaactgtactgtatgctatcaccatttttaacatgttttccaacttttagcatgaagtgccataaattcatacttcaagactaagatacccctccagaaccaagagttccatgaggttggaggatcccagtatctatgacattaattgtcaacagctctgtaattttgtgagtgaacgtgatttctcacgtgtctgtcaggactttggtttggtttcttgaggttttgttgtaaggagtgaatgtgaaaatgtgtgtgtggtgccaggtacagcatagctgtgtaataatgattaatggaggtaattttcgaatgtgtggtgtagtgtcctactctactgcatctaggacattgtagagaagcccttagtctgtccagaaagccctgattatccttcaggtactgatactgacaactcatggttaggagactcctgtctttaaatgttaccagaggttcaagtgagctatattcattgctgttctattagattttgagattacagctgttttggatatcaggttttaattgtctctgccacatacgatgttaatggatcatcttttagcctttggtgattatctctgttgtcattttcatgtcttatatccagtctggtctgctacctaaaactaagttctcttcattccatttcctttcagttgacctgcccaagatgaggcatatatatatatatgtattatatgtgtatatatatatgtatatattgtgtttgttttttattttttttatttttttgagacgagtgcctctctgtcacccaggctggagtgcagtggcgcgattttggctcactgcaatctctgcctcctgggttcaagtgattctcgtgccttagcctcccgagtagctgggattgcaggtgtgtgccacgatgcctggctaatttttgtatttttagcagagacggggttttgccatgttggctaggctagtctcgaattcctgacctcaggtgatccacccgccttggcctcccaaagtgttgggattacaagcgtgagccactgcgcccgctcccattgaggcatattttagctttggggaagggaataatttgaaattgaaatactaaggagagctggctgtgtttcgacttcttgatgtttctgttcttgtttttttttttgagacagagtctggttccattgaccaagctgttgaccaagctggagtgcagtggcacgatcgtagctcactgcagcctccaactcctgggcttaagcagtcctcccatgttggcctcccaaagtgctgaggttacagtcatgaaccaccacgcccagcccctgctgcagcttaaaagttcacagccaacttttaaaactatttttattaaagtacagtatagaggaatacatgtgtcataaatgtacaggttcgtgttttagcctaaaggtcgagaaagtagaacatgataccaactcccaagaagtcacttgcaaacttaaggtaaccactattctcactttgggcaccatggattttgtccccaacccttaaaaaaacgaaaaaactcacataaatgaaatcatacaatttatattcatttgtgactggctttttcgctcgtgttgaggtatccgtgatgatatgtggcagtagttcatttgttgtcattgggggtaatctatcaaatgactatactatagtttattttacagttgagggacatttggattgtttgcagtttttggccaatacaagtaatattggttcaaatgttgattgtattttttgtggacatgtagtttgttaaatagtggaattgttgggtcatagggtaagcatatgttcaacttctgttgcaaaatgttattccaagatgtactgatttatacttgtacccacagtgtgtgtggtttccagttgctctgcatcctctgtaacactctttaacagtcttaaactgaaccattcagtgcatttgttactggttttaatttaaagttacctgtgttgtttgccatttaaatgaaaaggatttcatttttgtgaaattcctgtttcaatttcttggccatttttcaattgggttgtgtttcttggtgatttgtagacattatgaaatctggatttgagctgtgctggttgtgttgcaaattgtctctttaagggcttatctttttactctgctaatgatagtccagtatatggtgcccctttaaaacaatggttaggtctttttgtatcccacttaggtcatcttttccaattgatcaacacttgatttcttgttatctttttggtagtttaattgcatgtggtcacagagtacaacttggtcagattttaattttttgaaatatgttgactttctttatggcccagcatatgtagtctaatttagtaaaggcacttaaaaagaatgcttattctgtagttgttgggtttggtgatctgtgtatgctcaattaggtcatatgttaattgttcatagcttttctatttttactaattcatttttgcccatttagtctgtcagtttctctgagataaatgtatcacattgtttataatagccaaaaggcagaaacaacccaaatgctcatcacctgatgagtggataagcaaaataggtggtatattcatacaatggcatactatttggccatagaaagggatgaagtattgacacatgctgtgacatgggtgaatcttgaaaacatgccaagtataagaagctagtcacaaagaccatatgttataatattgcatttatatgaaatactcgtatggaaacagaaagtagaaattactggtttcttatggttggaagtgatgagccataggtgggtgatagctgtagggtatagatttttttgaggtaatgaaaatgttctgaaatggattgtaacacatgtctgtgaatactccagaaaccattgaatcgtatactttaaatgagtgaattacgtggtatgagttatgtctccataaagcttaaaaaatactattttttggtaggtatttgaaaggatgtaagaatagatgcatgtctttttttttttttgaaacggagtttcgctctcatcgcccaggctggagtgcaatggtgcaatctcggctcactgcaacctctgcctcccaggttcaagcaattctcctgcctcagcctcctgagtagctgggattacagacatgcaccacaatgcccagctaagttttgtatttttagtagagacggggtttcaccatgttggccaagatgttctctatctcctgacctgtcatctgcccgcctcggcctcccagagtgctgggattacaggtgtgagccactgcaccccgcccgatgcatgtgtttaatctagtatcttaccttcaaatcctaaaatacaataaaatgctatataactgtatgttcagtaattaagtcacttatttcagaataacgagggatatcaaaaattttggaaagcatttctgagtttaaggttaagaaacacaaatctagttttaccctctcattttgcatatgaaaaatagttaatctggataggtttgtctttgaagtcaaatctaagtttgaatcctaactaccagtttattagctgtatcagtgtgaggggaagggagacatctgtaacctctttttctgtgtctgaaataggattaaaaactctcttcctcgaaaaattgttgagtattaagagaactggcatagtagtagctaccatttattgactactgcctatatacctgatgtttgcatttatatacattctcgtttaattcttacaaaccatgtgttctgccattcattatattactatttcggataggtactaaagggaaaaatgagatgtctaataatgggagtatagttaaattatgacctgtttctagatatagaatatcatgcaaatggtgttctgtgaagattttctgttagttacttggaaattgcttatcttagataaaaggattatatatcataggatttcaaataaaggaaagaatgcagatggaaaagcttcaaaatatttactgaagtatagttttgtgttatctttatgcttttttggttatttttcaaaatgttagcaatgtgtatgggagttgacaaaggtaaaacagattttttaaaaatcagttgtttatattggctgttgtaaattgattatggaaaattttgttcatacacaaatgtagagtgttaggaactttcatgcacctatctctgattttcaacaatgatatatagcttatcatgttttttatatatgccttcccttccttgtccccacaagattttttaaatctcagacattctgtcatttaatgtctttccgtttatcgtgacaaccagaagaatgcccctatatatttccaaaacaccttcttggcagcaatttcctcatctgttgagatccactgctgtgggacagtgaggtagagtggtttgaagatgtgattcttttctgaatttggactgatttcttgagccagtcttttaatgtagattcctgggcccactctgaagctttcctatttggacagtctggtaaagcctaagcatactggtgattttggtaaagatctgagaatagtataagtaagtgtttctttatagcatgatgctcttttctcttgtctggttttatgtgtctggtccctggaaagcctttcttcaggttttatcggctactttctttagtagtctttctttagttttcacttagggaaagctttccctgacttccctttatgcttcctttggacttcatggttttacttgactctcattggactgctcaccttcagggagagttgtgtcttttatctttgattttccacagtactgcttgttaataaatattgaataaagtaagtgggaaggatggtcagtataatacagattaagtatactttatccaaaaactttttttttttttaaacagacagacttgggaccagaagtgtctcagatttcagatttttttttctttttttgtttttttggattttgggatatttgccttatatacttaatggttcagcattcctaatttgaaaatccaaagttggaaaatgctccaatgagcatttcctttgagtgtcatggatactcaaaagttttggatgttggtgcatttcatatttggggtatttgcattagagatactccaccgctaggccaagaatatgagattggctgtgtatactgtattcaactagaaagaaaggaacaggactgaagatagaagtctgaggaatggattattttggacgtggtaagagctaactgtggctcgaactaaatttggtctcattaacataaaaagaataaggatattgggaagcaatgcattgttaggccttagcagaggatcgaatataggatatgtgcacctatagtaggacctttgtgttagagatgaagtaataatcatttcttactaacatcaagatactgacataaaaaggatgcatctctgtattgttttgaattggggattttttgttttgttttgtttttagaggcgggatatcactctgtcacccaggctggagtgcagtggtgtgataatagctcactgcagcctcgaactcctggactcaggcagtcctcctgcctcagcctcctggaacattgggattatggtgtttgaattgtagcgtctgtagtaggggcctctatgaggtacctgtagaaactagactgtatggtgctgtgcaaacaactgtaatacatacttattttatttttatttagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggtatggttttggaagatgtacagctttaaaattgtggataaatgttcgtacttctaaaagtaactagtgttggctgtaaattactttccctgtcattaatatttaaatagttaaaattctttccttgctgtcgataacaatttttttaaaaagtgtgattccatgttaatgcttacgtgattgtcagataaccatttcatattttacaaggttcattggtatttagttattatacctaaattatttgcattagaacaggcaagtttttagcttttcttttagtaaggaaatttttagacaaagatcatgagtaacttatctccttagcaaaccacgaattgataatcatatttctttaagtctaaggaacttttttttttttttttttaagagacagagtcatgccatgttgcccaggctgggctcaagtgatgctcccatgtcagcctgggactgtaggtgcgtgccacagtgtccagctggcaccaccagttttaaagagatacctttgtgtatcactaagaaagaatactgctaactgaattgatgttttcttgtcacttaaaatgtttattttatacttagtgaaagagctcctttagacttacatgggtatggaattttatcatatcactcttgcataacatacaaagacttagttgtcagtgtccatattttttcatacagtatcaaactctgttctgtcaagagtgttggtggtgtagcattgcttaaaagagctctccagtattttctccaggattttgttccaagccattaacactcctgtaagtttttatgctgttgtttaccaacagcaaatacttgctttactcattcaacatattccttctattttggtgctattctgaatacatggtaacttctgtcagtgccaattaatagtgtaattattttgaagacacttaatgtggtaattaagcccgttacatatgatacaacagtgtacccaggcattcagttgaagtcatgtagactacatgtgcaggcatgtagttgatgcctggctgtcagcaattgtaagacagatcctgatttcggagatgttaaaatagaaaaatgtgtgccttagctaaattcagggaaagaagcaatgagtggcattcaaaactcttatctggtatcatctggaagggttttttttatttccttacttttttttttttttttttgagacggaatttcactcttgttgcccaggctggagtgcaacggtgcgatctcagctcactgcaacgtctgcctctgggttcaagcgattctcccgcctcagcctcccaagtagctggaattacaggcatgcgccaccacgcccggctaattttgtatttttgatagagacggggtttcctcatgttggccaggctggtcacgaactcctgaactcaggtgatccaccagccttggcctcccaaagtgctgggattacaggtgtgagccaccttgtctggcttatttccttttagagataatactaagtaataatcaggccaggcgcggtggctcacacctgaaatatgagcacttgggagggtgaggcgggcagatcacctgaggtcaggagttccagagcagcgtggtaaacatggtgaaacgctgtctctactaaaaatacaaaaaattgcccagcacagtggtgtgcacctgtagtcccagctactcgggaggctgaggcaggagaatcgcttgaacctgggaggtggaggttacagtgagccgagatcatgccactgcacctccagcctgggtgacagagcaagactctgtctttaaaaaaataaataaataaagtaataattattaatcatattgatttgttggctttcttttggtgaagtctctcgctttttattgttttcaagaatttcaagggccagagtaaaactggctcataaccctcaagaactagaaggggatagataaaaaagttgtgggtttttttgtttgtttgtttgtttgtttttcaagagtctctctctgtcacccaggctggagtgcagtggcgcaatcttggctcactacaacctccgcctcctgggttcaagtagtcttcctgcctcagcctcctgagtacctgtgattacaggcatgtgccaccatgcccggctaatttttgtattttagtagagatagggttttaccatgttggccagactggtcttgaactcctgacctcagttgatcgcctgcctcggcctcgcaaagtgctgggattacaggcgtgagccaccgcacctggccaagataaaaaagttttttatatagtcaagctttgtgggtgtaactggtcattggcttccctcttatgagataacctacctccatctcttacataagcaatatgattgaaactaatgaaatatttgtgtacattatactcaaagaggaggggcaattgcagcatattttgtattttgtagggttttattttattttgtattttttgttcctaatgcttagttttctcaggctttttactaaatgataatttgatttggtctgagagtttaccctttatttctagatgtcaggatttcagtggttcttttttttttttttttttttttgagacggagtctcgctctgttgcccaggctggacggagtgcagtggcgcgatctcgctcactgcaagctctgcctcctgggttcacgccattctcctgcctcagcctcccaagtagctgggactacaggcactcaccatcacgcccggctaattttttgtatgtttagtagagatggggtttcactgtgttagccaggatgttctctatctcttgacctcgtgatcagccagcttcggcctcccaaagtgctgggattacaggcgtgagccactgtgcctggcctttggtggttcttttaaaaataatcagctctactgcttactctgtgattaattattttccctaggcctcaggatcattcagctcagcaaacaaatacagctggaagcaatgttactacatcatcaactcctaatagtaactctacatctggttctgctactagcaacccttttggtttaggtaagtgtctttagtcattccagtagggatgggaaaaaatactcctttcccttcctgggtagtttcagataaaatgagaaaataaaacattatgtcactttaacaacaaaaattaaaaaaaaaaaacatacattcctataattgtagatattaaggaagtagttggggatatggatattcttacatatcagttggcgcctttctttttaatgatgaaagagatgtagtttgtgtatacctgatctgactaccacataatttagtatgagtaagattagctggttattaatcgtaagccagcgtccctgaataataattttttcatttgtaaaaggaagggatcagactgcattagttattttgtaactgtcctgaacacatggaagggggtctgggaagccagcctcgcctaaaactgcttttgtttttcttatattagtttttgtttgtttgtttgtttttttttaagagaggcaggatcttgctcagtcacggaggctagagtgcagtgatgccatccatagctcactgcagcctcaaactcctggcttacggtgtcctgctggtgtcccaaaatgctgggttacagatgagagccactgtgcctggcctgtattagatttatatattgaggttctgtggaatatatatatatatattttttgagacagagtcttgctctgtcgcccaggctggagtgcagtggcgcgatctaggctcaccgcaacctctgcctcctgggttcaagcgattcttctgcctcagcctcccgagtagctgggattataggagtgtgccactacgcccggctaatttttttgtatttttagtagagactgggtttcaccatattagccaggatggtctagatctcctgaatttgtgatctgccaaagtgctgttatccattttcttttgataatagatagccaaactcagtggcttattacaacaaagcttcatttcttgctgcatttttctgcatgctacgctttttaccggtttgtaaggtgcccatccatatagtccctcagagactcaagctaatgaaagtcatttttcattctgctgtattatagctctaccatttggaacacggcagaagagacagctacagggttttaagttgaacctgctatactttggccagaagtggcatatatcatttcttgtagtcctttggcatttcacataggcctgtccaagtgcaaaagaaataataaggctgcaaaatgaaatgtttggtgagcactgctatctgctactgtagttagtcatactgaagtttttgtggtttcaagaatgcattaatacatttatttttgtgctttttgtatatggtgttcattgtgcctagtattcagtccccctcctaaccttcttcacgtttccttgccaaagtatttatgctccagactcattaagtgttatctcttcttctgaaagtagccattccacttgggttatattaccataatatcctgtgaatattctttactgaagtacttagcatctgtatagacatttattttcttgtctgtctttcctactagattgagttctgaggatgtctttcttgttgccttattctcaatacatatgtaacacagtctctggcatatataaaaagtgctcagtaagtgagaactgaatgcatttagttggttatgtaattttacgaagtaaacactttgtggtaagcacttggtcatcctgttgctctgttaggtttctccttgattgaagtcctccaaagagaaatctatttccaggtattccctggctctctgtctccttgactggcagtatcagccctcttgtacccagtgtttataggtgaattctgcttcctgttaataaaacttaaactagtcttttggaaagattattagaagcatagtctggtgtgtgtatttattatttcttcctttagctggcataatctggactgttttttctgacaccagccaattgtccaataccagctctgtgtccaagattcagcttcatttctgatactacctacctacagttagtgtctgatctcacaagttagcagactcagtcctgcaagactgcccctacttcagatactggtcacaagttctaggccatctgtacttctgactgaccagctctaagttgggggttcccctgacctcctcctcaggttcaataattgctagaatggcacctagaactcaaggaaacacttatgtttacctgtttattataaaggatacaactcagaaacagacaaatgcttggaagataattattagggcacaaggtatgggtatgtgggggatggaagttgggctcaaaggttccatccaggtttcctcagcgcacaaccctcctaacactcagatgtgcttttcattttgagttttcttaattttattgttgaagaatttgcatagagctctatctccacctccctacccttactttcttggtgggtggggctgaaagttttagccctttaatcactttgtctttctggtgaccagctcctttctgaggctttccaggggcctaagtcacttcattagcataatgatcaaaagggcttgtaatgaataataaaagatactcctgtcactcagaaaattccaaagttttagtaactcaggatcaaggagaaagaccaaatatatttattattatactacatacatgaaaatatattttgttgattttattactttaattaccaaagtgtaaatttttggctaatttcaatgataggaattaaatattagtaataggtattcgatttgtttttaaatgatttcttgtaatagactattgggtcagctaatacttttttgcatcttcatattttatgtcatgttaatgataaattttctgactttgatttgtatgtttttgccctttatcctcttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaagtatgtggaaagttctttcagttcgtttagctaaaaaatgatatatttgttatttaattttctgtggttaatgagattgtcctgtatgtatggttaagctaaagagagaaatccttatcttggtttaagaaaactcaacaaagcgctaatttggctgtttgaactctgaattttctgttaaattgaaggatctttgtaaatagtttattttgaaggcttaagaatcaaaaagtccaatgctggagatgggaaattcactcataacaaagtgcttccttctttatgttatttgaatgctaagttgcttttttgaggtgaaatacaccagggattatttaaaataacctcctgccttatatgttgaatacaaaattgcaacaactttaaagctttaattggtttttatttgtgattctagaatcagacaacacctcattttataaaatagagtgttctcatgagctgagcagaagaggttggctttataggcataaaagggctgaagaaagcaaaaacgaacaaaaagcagatgggtcatttcgaagttactttcctaatagggttaaaatggagggaactctttcttgttacagtgactcacgttgactgcagcttactatggttttgggggggaaactggcccctttcatagttcactttgattacatggcacttggcacaagtggctctattttggtttgttgtggtctgctggggcatagtgcaggaggctggtccaaaacagtggcctcctggccgggcgcggtggctcacgcttgtaatcccagcactttgggaagctgaggtgggcggatcacgaggtcaggagatcaagaccatcctggctaacacggtgaaaccccgtctctactaaaaaatacaaaaaaaaattagcggggcgtggtggcgggcgcctgtagtcccagctactcgggaggctgaggcaggagaatgggtgtgaacccgggaggcggagcttgcagtgaaccaagatcatgccactgcactccagcctgggcgacaaagcaagactctgtctcaaaaaaattaaaaaaacaaaacaaaacagtggcctcccataaactttgtttaatggcagttaataaagtaattaatgtaattcatgtgtatttcaatgccttttttttttctttttttggaaatatttttcgtagacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcaggtgatccactggctccaaggttcaggccaaggagtagcttctgttttaacacaaatatgtgtatgattgagggtagcttttatatgaggaatgtggttttcaatttttaaaaagttcagtggccgggtgcagtggctcacgcctgtaatcccagcactttgggaggccgaggcgggtggatcccgaggtcaggagatcaagaccatcctggctaatacggtgaaatcccgtctctactaaaaatacaaaaaattagctgggcgtggtggtgggcgcctgtagtcccagctactcaggaggctgaggcaggagaatggtgtgaacacaggaggcggagcttgcagtgagccgagatcgcgccactgcactccagcctgggtcacagagcgagactccgtctcaaaaaaaaaaaaaaaaaagtttcatatcttatttaaaacaaaagcttattctttgtgattttttatgtcttttattacagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggaggtatgcttttaacaactcaggcttttttctttgttgtcctcatttacataattaaaacattgtttatactcttattctttgtgcttttgtgtgtatgtatagtgagtatcttttataaactatatttttcatgttgcttttgttttgttttgttttgtttttttgagatagagcttcgctcttgttgcacaggctggagtacaatggcacgatctcagctcaccgcaacctcttcctcctgggttcaagtgattcttctgcctcagcctcccgagtagctgggattacaggcacctgccaccatgcccggctaattttgtatttttagtagagacagggtttctccatcttggtcaggctggtcttgaactcctgacctcaggtgatccgcctgccttggcctcccaaattgctgggattataggtgtgagccgctgcacctggtcacattttgttttttaaaggaagctttaaatgtagagagaacacttatttacttgtgtagttgttactagttacctgtgtagttgttactagagcacatgtttgctgtctttagcctggttttgtattttagatcagtagattgtcaagcacccgtcttgaggtcagggctatactggctgcatcagagcacctgccaggtttattaaaaatcagattcccagatcttaccctcagactttgtggagccaaatctttcatagtggggttaagatctgtgtttgtgtgaagcagattctcatgtgtgaacaggttagaaatttacttttgtccacttttctgtagactgaactcagatgtcttcctttcagctattcagatactacatgcggatgttttgtccatgaattaggtccaagatcattagccatagtgacaattttagtcctaatacttggcgtataagtaggaagaaatggagacatgggagcacttctctaagatgagatagactgggcatgttttaaaagatgcctgtactttggcagaggaagtggaaagatgaggtgctggatgaagaatttttaaaaattcattgctgaaagaagaatcagaatgagaagagtaattaatgatcacagttgatatatattcttttatagaatacagtggatatcttgagatttatgtttataatataggttttgtaaaacctgaagtaataccatttttaaatcaataaaaatattctgttctatattctacttaatccttactttgatactaacaatcttttgagagggttgcaatgttcttactttaaagggtatagagcaggcaaagatttaatcatatttcctgactggttaagctgttgttttctttccctttaccatgattgtctacagtaataacttttgtctaaaaaaccaaaaaccaaaaatcagttttgcatccttttactcagatacttaatggtttgatactttaacatttcatgttaatatttccatcaagggaaaacaagaactagcaagaatgaacttactctgctggcctatcagattgtcagcatatttgtacagtattatgattcttactcaactgtgacatttgatgcatacatatatgcacacatacacatgtaaagatgaaattcttgactcttctttggtcctgtaagcacctactctagaatgtaaggaagtgttagagcaggagttgacagatttttcatgtgaagggtcagataatacttcaggtattactggccaagaggcaaaatggagaatgtattacatcaagagacaaaacaaattcccacaaattttttaattgaaaaaataaaaaaattggtaatatttagttacaatattttccttgtatctactgataagaggaatgggacttctttgggggaataacattttgcataattggggttcagtgttctgtttaccaaaattgcaaagttcatctgttaatactgatatgtagtgagacttgactgacttattcaaaatacgtactcattccaaaagcatttgattttaatagcatatttatcagtgtggaaggcatttatagaattccattagataatgttgtttttaacatgccattacattcagattaatcacttcaaagtgaaaggtagtagctcctcaattgcacagttaagtgaactttgaatgtcagttgcctttgcatttgcattgaggtctgaaaaatgttgctggtggtatgagctcaaaagtaaatctgcaaatttgtgagaatggaggtcttgcttcttgtgatttttttttttttttgacggcataggaagtctgtaaagcaccttgacattgcttgtgattcaaacaattttagttgtcaaaatgactttagtatgatcacacataaatgctgctttgctttgtagttttaggttgaattcatgcataagcattaccaactctctaacaaaaacgaattcatatagtaattcaatgtttggttgttggagggttggcagggtagtggttctcatttactaaaattttaatctttggcatgagctaataaaataatgcaatgaaactttacctctgctaagccaccatcaaccttctgtgtggttaggcatgtcagaatattgagttattgttaataaaaattcatgaagttgactggttaagtttacaggagttaacagtgctcctcattgatactcctggttcagtaacatgatagatccaaatgttttccagagtacctactgatgaataagacagtcaataactatagtctttaaataccttacatttttatatgctttgaaaatatgtccaactaagtcgttttaattctgcacgtttttgctgccatgagatgtagcacatcttagcagattctacttcaagttgtaccaaattcttatttctcaactttttaaaaaatggtcttaccctggttgttccattcagactatttatagagggtaattttccggtcacttcagacttaccattgactccccatacaattgagcagtatcagtaacatctgtcagcttatcaagaacttagaaatagcactcagaatcatttgcgttgtttttaaattgagtattgacatccttaactctgagaaaaactgttcctcctgagagccgagtagacttcagtgagtttattttctctggacacatttggttactgcaatcaagatttaattaactgttaaattagtcatcactagtacttggcttcctttggctaacaagccacttggaaacttaactttggttgcagtcttattttcatttttattttttgtgaaaaagtggctatgatgagatatttcattctaaagtttatatttcttctgaccattgcttttctgtgagtggggagtattgtgatgagtggttggtccggcagtgcttatatatgttgtattcttttagtgtcattgcataagaaacacaagttttgccatctcatttagtaaaatatattccactgtgccttaaaaacctgacatttgtaactctccttcttccttttttcttgttctggcatgattggtatatactggttatttttttttttttaatgctgcagtgattttgtgctgcatgagtataactgattcactgtgttttgtagtagtatactgaacaacagtacgaaggaggccaggtgtggcatggtggctcatacttgttatcccaggactttgggaggccaaggtgggtggattgcttgagcccaggagtttgagaccagcctagccaacatggtgaaacctcacctgtacaaagaagacaaaaagtaaccgggcatggtgtgcagctgtagtacagctacttgggaggctgaggtgggaggattacctgtgcttagggaggttaaggctgcagtgagctgtgatggcatcaccgcactccagcctgggagacagagcaagaccctgtctcaaaacaaaacaaataacagtatgaaggagtgacagtaccatagacagtttctgttgcaagtactcactgcttttgtaaaagtgcaaaacacccatagacaataagtgagaatgactgttccaataaaatggtattcatgggcgttgaaatttgaatttcatatagttttcacgtttcacaaaatatttatcttggattttttttcccttaactatttaaaaataaaaacgtaagcgcagtttttttttttgtttttttttttttttttttttaaaagaccgagtctcgacctgtcacccaggctggagtgcagtagcatgatcacggctcactgcaacctctgcctcccaggttctagagattctcgtgcctcagcctcctgagtagctgggattataggcacccaccaccacacctggctaatttctttgttttttttcttagtagagacagtgtttcaccatgttggccaggctggtctcaaactcccgaccttgggtgatctgtctgccttggcctcccaaagtgctaggattacaggtgtaagtcactgcacccgaccaaaaattgttttggttttttggtttgttttgtttgagacagagtcgtcgcccaggctggagtgcagtggtataatcttgagtcactgcaaccttcttctcctgggttcaaacgattctcccttctcagcctccccagtagctgggattacaggtgtgtaccaccacacccagctgatttttgtatctttagtggagacggggtttcgccatgttggccaggctgcttgaactcctgacctaaaatgatccacccgcctcagcgtcccaaagtgctggaattacaggtgtgaaccaccatgcctggccttgaaacataaaagcaatttttaactcattagcttagcagaaacatgttgtaggccagatttgtcctgcaggctgttatttgccagcctatcttagaatacagatatacctcattttgttgtgcttcacagatagtgtgattttcacagtttgaaggtttgcagtgaccctgcattgagcaagtctgttagtaccatttttccaacagcatgtgcccacttcatgtctctgtgtcacattttgataattctcacaatatttcaggctttttcattattctgttgtggtgattctgtaatcagtgatctttgatgttactttagtaattgttttggggtaccaggaaccaccttgtacctggcaaacttaatcagtaaatgtatgtgttctgactgttcaactgactggctgttccacttgtctctcttcctcttcttgggtctccctattctctgagacacaacattgaaattgggtcagttaataactctacagtggcctctaagtattcaagtataaaaaaagactcctgcatctcttactttaaatcaaaagctagaaataatcttgtttagtgagggaggcatatcagaagctaaaataggccaaaagctaggcctcttgcaccaaacagccaagttgtgaatgcgaaggaaaagttcttgaagaaaattataagtgctactccagtgaagacatgaatgacaagaaagcaaaacaacttcattgctgatgtggagaaaattgtagtgatctggatagacgatcacaccagccacactattcccttaagccaaagcctaatccagagcaaggccctaactctctttaattctatgaaagctgagaggtaaggaatctgcagaagaaaagttggaaagtagctgaggttgactggcttatgtttaaggaaagaagccaactccataatgtaaaggtacaaggtgaggtagcaggtgctgttgtagaagctgcagcaagttatccagaagatctcctaagatcatcaaggaacgtggccacatgaaacaaccagtttttaatgtaggtgaaaaacagccttctattggaagaagatatcatctagaattttcatttctggagagaagtgaattcttagcttcagttcttcaaaggaaaggctgactgttggggctaatgtgtctggtgactgagttgaagccagtgctcatttattattccagtaatcctagggccttaaaaattatgctagatctattctgcctatgctctgtaaacaggaaaaaaaagaaaaaaagaaaaaaagcctggatgacagcacatctgtttacagcatggtttacttaatattttaagtctactggtgagacgttgctaaggaaaagattcctttcaaaatattagtgctcattgacagtgcatgtagtcacccaagagctttgatggagatgtgcaaggagattaatgttgtttttatgcctgttaactaacacagcattcattctgcatgcagcccatggatcaaggagcactttcaacttacaagtcttatttaagaaatacatttaattagactatagctgccttagtgagtcctctaatggatttgggcaaagtaaattgaaaaccttctggaaaggattcattcaccattctcaatgtcattaagaacgttcctaattcatggagaggatgtcaaaatatcaacatgaacaggagtttggaagaagtttgttctgtccctcatggatgcctttgaggggttcaagacttctatggaggaggggactgtagaagtagtggaaatagcaagagaactagaatgtgaagtggagcctgccaggtgtgttggctcatacctttaatcacggcactttggaaggttcgggcaggaggatcccttgagcctaggaattgcaggcagcagtgagctatgttcgtgccactcccctcactccagcctgggtgacaaaagcgagactccatctcaatttaaaaagaaaaaaagaggtggagcatgaacactgactgcgttgctacaatgccatgaaaaaacttgtacagatgaggagttgctttttgtagatgagcaaagagtggtttcttgagatagagtctgctgtaagtgaagatgccgtgaacattgttgaaatgacaacgaattcagaatgtttcataaactttgttgataaagcagtggcagggtttgagaggattggctccaattttgaaagttctgctgtggtaaatgctgtcaaacagcatagagtgcaacaaagttttcctgatgtggcaaacttcatcgttgtcttattttaagaaattgccacagccaccccaacctttagcgaccaccagctgactcactgttagcagctttcggcaataaagtatttttatatttatgtgcagagtttttttttagaccgaaggctgtggcatacttaatagactacagtatcatgcaaacaacttttgtatgcgctgggaaaccaaaaaatgtgtgtgacttgctttattgcacagcagtctggaaccaaacccacagtatctccaaggttggactctaggatgtgaaaaaaaaactaagttaaaatttacaacatgagaaaataggaaaaacaagaactattaaaaacagaattataataaactagaaagataagtgagaagagtcagatgtcttaagcctgatataactggatggaatagcagaaaggagatgaaaaacctaatgagttgacttggcatagtaagtttgagaatatatttgagtttgagtgtatctagttggcagttgaagatctaggtgtgagtcaagcaaattaacttagttttcaaagaaaatttgcctaaatatacagttgtcatcacatatggaattcacataaattcagctgtagcccttggcaataaaaggaaaaacaataatcataagtgctttgtacattaattttcttacaaccaccctatgaagtagatactgctttctccattttacagatggggaacctgaagtatgaagacgctagataacttgcccaagatcacatgggttagattagatttgaacccacgtaatcaggctcctgatactgcttggagtcactgtgctctatggtttcaaatgttaaatgtgcctaccattttactcagtgagtggcagtacacagtgaaaatgggtggaggcattacatcttttgttgccttgggcatgaaggcttacttctttcataagggtgggcaatattaagtgccgaatatgattctaattaattctttgcagtcttggaggaaaagttggctcagtccttttcactttatggaatttttcagcagtaattttgaccatacgtaatttttgccttaagttgacttcagaagctagctcttcattagacaagattttactgtaaatgcagaatgtttaaactcatcagtcctcttttcctggtatatgttgggcatgtacttttagagatgttttagttttaaagttctttcgtagttcagttgatacataatatgtataatcatttgtacttggtgaaattaaacacagtgcatattatattttaaagctttaacttttgtttaagtatttttccttaatatgtcttttttaaaaacaaactttcagctagtatgttcaacacaccaggaatgcagagcttgttgcaacaaataactgaaaacccacaactgatgcaaaacatgttgtctgccccctacatgagaagcatgatgcagtcactaagccagaatcctgaccttgctgcacaggtgagtttgtaattgtattgaaaaagactgtgcagtgtgaattaaaataacctaatcttgtaattgtgattttggcacatttgtgttgtgtatgatatcttaatacactagaaaaataagtaaactgtgtctccaattttttagaccgtgtgtttctttgcagtaaattaatacttcatatgtaattaaaacaactttatctctgccattcattgactagaaagaagtgcaggtttagtttgtttctacgtatgttgagttaggagacaagtacagagttctggaatgcccactcttttgaagataaactacttaatgaaatgtaaatcttgaaagcaattaagagcaatgttaatacatttgaaatacttttatttagtagatcactcagattataatagtcatgctcagaatggcagttgtaaaatagcatttattaaagacgggaatttgtcagaacaatgttctccttctttcaactattgattcccctgctgaaaatcgtatacaggtcccttattaatgtattcctttttctaatttgtttctaaagagaccacagctaagaaaattggggatcttaatgctggctgaacactcaggatcacttgggaagctttatagacagtaccgatggttggggcctcatccttagagattttgagataattgcgtctgataaccctttctccctcaagttgcctaggtactatctaggttccataccacagggcttgaaaaaccacggagaatgtgaaataaaccttgataatctgtagtttatatttgctgttcgttaaaaatggcttctgtagtgtgtcaggaatttggaagactttatagttaatctcatcccttaaattttaaaagctttaagtcaaatgaatggtttttattttctaaattctaaaactatattgattcaggtatctttgtgtataattctcagtaataacttatgccctcaccaaatttgtggaattggaaataacaaattttaagaagaatttttgtgtctgtgattctgtatattggaggtacattttatggaagattgatttatgcatatgaaacttatcagactgagttgttagtattaaatgcttcaatttaccataataagccattttaagtgtgtatttggctaatactgaatgtgcatcttgcttttaaaatttgactttaacaagcacatgcgtagcaattttgtaataatcttactttagtaaagtgacttgagcactcacatactatttttttactctaaaacaaaatgttgctagtactagattggcatgtcttttattacagataatttagaaactattacaatgttcttgttatctgcagattaaaatttgtggtttttctattcttttgatttttaaatatttaaaaagactcttgagtgtaaaaacttgtggtataagcactcaggtaagttataagaaatatctaataagatgattatctgtgaaaggatacgtttaagatgacatgcttttttaagatgaaatgaagtgaattccaaaagatatgtgtgataacctcgttaatatgttgatgataagtatttggaaccaataaagaagcaggtttgttgaccttaagcctgtatgagtttacttactgtgaacttactggtcactttgaaataaatactgtatgttcctgaaaggttgtctgacatctgcttttgttattgtattgaaattaactaaaagatcactttgcaagaattggggcgaattttctctaccagcatttacattgctcttaaatacggttaacttcttgagggcaaggatcatttcctccccagactttggatagataaataggctatcagtaaatccttgttagttgactttttactccgcctggggaaaatgatataaaatgtgtcttttgaagctacaagaatttattagctctggttatgctccttgtgtattttaatcttattttcaggtatatgacatcatactaataatgatcctgatttttaaattcttaacgtttatttgaagtttaggagatgccacttttctcatctctggtagtagtgaggtgaaatccagatgctaatcttggtgttctcaaatggatttacatcttttaggtcttaaatcattttaatacttttcccagaggactgttggtgctaggcctgactgattttcacctagcagctccatttctctggcaagttggttgctgttttgcggtgttatttttttggacctaatattagctgttttgtagtaggcaggtagatgtagtggtccttttcagatctagattttctctgtgcctgccacttgtgtgttgaggtttctaagcaagccatgttacatagttcatgtattgatgtttatgtttattctgccagtgtagtagaaaatatatcttcatgaatgccagttactcccatttttctttcaatggcatatattcacgtttgttcaaggaaaagcctaagaaaatgattgcttttattttttaggatattgcatgtcattatcataaccaccattctcattgagagagaatatgcctcatttttttgtttttgttcttctggagatccctcttgtggacagtatcttcccttttcctttttttatttatgttctaccttcctcccttttaagtgccagctgaggcacttgggggaagatagaataaaacaaggtacattacttgtttcagatatttccagttaaaattgtttgaacacttgccccatagatgatgctgaataatcccctatttgctggaaatcctcagcttcaagaacaaatgagacaacagctcccaactttcctccaacaagtgagtaagacaagatgttagctatcttgggtaatgatttgcttgaaaaaatttgatgataaacatttttccttgctcttctctggctgatagcaaaacatagaatagagaccaataatgctgtcaattcgtagagaattcagcttgatcttcactgagtcccatttcactgctgaccttttgcttatgtttcttaaacatacattctgaggaaagaacattttgtttttgcttttgaggacctaggattttgaatgctttgttaataccataaaccatttcctttcattgtactaactttgaagtgcttccttgtgtcatgttacgctttatggtttaactaattttgagtaacaggaaagagctaccctattctattttataggttttcttccaaattagtagaaggcttttttttcccaaggggtagatctcatttcctcaaactcgggattagtaagattaaaatagtcagtgttgtcatataaggaagtaaggaaggttatagtataaacgagtacttgagattgccatggtattttattatttaaaacaacaaaagagaagtcagtcttggtgttttgaaactggtagttctagggcctcatgtattatgcaaatgactctcagacctgtaaaccattttccaaggttggtgtccttgatctattgtaatgatgtaagcctatctttggttagtcaggtggtgtatatttggaagtagtaaagctaaactcaggatacatgtattaacgtcaaatttggaactgttgttttagagtgtaccttactggtaaaattgttatatcagtaacagataacacttggttaggtggaatatgtggctttttaccatatccacgtcgtaagaattgtgcctttggaggttgtgtcttagaagtaatactttatcttctgttggagaaggggaatagttgtggcttccaaagtagctcctgattttcttccattatggaaatggctttcatgatggacttaggaggaggtcaagtaataatttgcacactaggtttgctgtcaaagaggagatacttgcgtttattttgggaaagaaattatggattaccagtgtccaggagtaaggttttagattttctccagaagcataacagagaaaagatttaaaaatttacgttcactgattttaattcctttgtaaccactagttttctttcttccttagatgcagaatcctgatacactatcagcaatgtcaaaccctagagcaatgcaggccttgttacagattcagcagggtttacagacattagcaacggaagccccgggcctcatcccagggtaggcttatttggggaagataatgaaagtgtataatggttactttctctgagaatttcagatttagtattattctgcctgcctttttttttttttttttttttttggtgggatacagggtctcgcccttcgcctaggctatgagtgtgggggcgcagttgtggctcactgcagcctcgacctctcgggctcaagggattctctcacctcagcctcccaagtagctgggactacaggtgtgcaccaccacacctagctaatttatatatataatttgttgttgttactgtttttagagatggagctttgccatgttatccaggctggtctcaaacttctgggctcaagagatttggcctcccaaagtgggatcagagacatgagccatagcacctggttctcccccaccgtttttatttatttatttacttatttatttattaagagatcggtttttgctcttttaccctggctgaacttgaacttctaagctcaggtgatcctcccacctcagcctccccagtagttgggacacagtgcctggctatgattgtttttaagtcagggttttcaaagttaaaaatgattattattattttttaaattccttttagagatagtctcactccatcgagcagactggagtgcagtggcgcgatctcagctcacttcagcctctacctcctgggctaaagcaatcctcttacctcagcctgccaagtaactgatactacaggtgtgcaccagcacacccagctaattttgtttttattttttgtagagatgaagtctcaacaatgttgcctaagctgatctcaaattcctgggctgctgggatcatcggtctcccagaatgagccactgcaccaggccaaaagggcttattttaagaagatggcttagcttatattaaaatgtaactgatttacagactggcttctggttttgcaggaccttaggatatttcctatttgtgctttctgtaggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcaggtatcagttcttttccattcaagttttgtattccttaatgttggaaatttagaaatttccaaaaagaaggaaaaagggagaaaaaaggaaagcagtagttcttaggtgtttagattaatgaaaaatacagtcttaaggatattgagtaagaaaacaggcattacaaaaattgttgactttggtgctgagacactaaaggaaacgttgttacggttgtagagaagacatgctacaacctaaagtcttattttttagaaattgcctttaaaaatgcattttttttgttcctatttgaaaatcatttgaaatagattttgctttaaaaaagttcttagggaggaatggaaacttgattatcccaagtacctccagggcagctgtattctagtctgtcttttgactggaaaaaagtcctaactaccttaactccacccatgacaccacctcctgcggtagcttgtgttacatatatatatatctcgtaaatatggctaaagaatatggaccccctaataatgtggttgcatctacaaacatacattggttttactaataatgtgccattatataaagatgatcgccagtttaaacctgttttattaggttgtccccaaacttcttaatgtctcaaggtctgttaggtgctttctgttttcttttctgggtttcttttttctttccctttctcctttcccctttccttttcctccttcctcttcccctttcccttttccctttcctcttccccttccccctttcccctttttcctctttcccctctttgcctttcccttttttttttttctttccctttcccttttgacaaagtgcccaggctggatgcaatcacagctcactgcgacctgcacctcctgggctgcagcaatcctcccaccttagcctctggagtagctgggattacaggcgcagaccaccacacctggctaatttttgtattttttgtagagctggggtttcaaccgtgttgcccaggttggtctcaaactcctgagctcaagcgatctcacccgccttggcctcccaaagtgctgggattacaggcgtgagcctggcctgctttctgttttcaagccttactaaatataataaatagggtagggttctgtctcatacatatctgtattcctgataagctagcgtagcatagtttctggctcttggtaggtactcagtaaatattcatggaataaataagaaagaaggatttggagtattagaattaattgtgacataagttaacttacaagcctccaaattatcaggtaggcctaggattgattggtcatttatatggagatttttttttttaacttcatttctgaagaaaagatttgatgctgctgaaatgtcagaattaagagtataattttgggcctgaaactgaagctcttttctaagaattgactgtccagtgcaaaaattaaactcacattcattcgaagaatcattgaagctttagaattttatacatgaggataccagcttttatagttactcaattggtcagtagctacacaaatcatctaattctgaactatctgtgtgtgtgtgtgtgtgtgtgtgtgtgtgtgtacactatatgcacagaaatcctaacagaatcttggttgccagtattatttaagctggccccatcaaggacagattccgctgacccannnnnnnnnnnnnnnnnnnncaccaaagtcaacaatttttgtaatgcctgttttcttactcaatatccttaagactgtatttttcattaatctaaacacctaagaactactgctttccttttttctccctttttccttctttttggaaatttctaaatttccaacattaaggaatacaaaacttgaacggaaaagaactgatacgtgaggatttactccagcaagagcctgcagcatctgctgaataaactgctgatgtccaggttcagtggttcctgctgtgggacttgtgttttcactaggtgtggcgtgtagatccattagttcccgaacacacacacatacaggtttttctgcatgtacgtgatcctctaaaataatggttgatgtttattaagcttttctccccctcccctaaagtagagtcgtgatctatttgacatgattatttaggtacaaactagactatttaaaataaactgctaatggacttttaaatatgttggataagtttcaagaggtgggcagtgtttttaaagctcagtagatcagcatatgttataaaaaagcaattaaaaaattttaaaagtcatgtgtggcagggactggcttcctttagagttggattaattttttttttctttaatagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtccttgatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagcttttacacttgatttgtcttgcctcttttgtagaaagaaaaaaagtatttaacttttgctaaccatgtgttttaaaggctattggagttgatttaccccagattttgtcacattttacattctttatttttcaggttttccaattaaaacgtcacagtcttttgtggtgtgataaaaagatagcacactgggaaggtaggtgacttgagctccacttttgatcttggtacttgactagttatgtgacattgaggcgtcatggtttctttattatacatgtggtggtgaggcttataggtgtgctggactgggcgataagctctgaagtacctttaagctactgcagtggtatggtttttgtttttaatatgtttatttaggtctaagtctaaagataaatatctacatcttaaggggttcaaaatacttaaaattcttatcagcacttaaaggatgtttaaaatactgtaggcttaaattgttctcatattgagtgataatatttagtacaaattgaataaagaatggggtagtgaaaatagcatttcaggattttatttcccagttataatatttgcgatatcctaaacaaagtctagcaaatattgaaaaatcagataaatgacacctggcctctgtgtgtatttagaatcttgagtttcagacttggtttaaatataataatgaaaagagtcttttattcttactatgttaatttaataggcatatatcacaacaaaatataacaatggataacaatatgctagtgacaaaagtgaagctaagccgtgtgtgcaatgacatacaca

SEQ ID NO: 15363 - DNA, 13871 bp, Human; identical to SEQ ID NO: 12037

SEQ ID NO: 15364 - DNA, 43576 bp, Human
  misc_feature (1)...(43576): n = A,T,C or G
gcccataggaaaattcctcttatcctcaggttctgcaacctgggaatactgtaatttttgatatgtggttggttgaattggaggatgcagaacccacagatagggagggctgactgtatactactgggcacatgcccaagagaaatgaaaacgtatttgcacaaaaatgtgtacatgaatgttcatagcaacgccaaaaggtaaaaactttttgataaataaaatgtggcatatacatacaatgcaatattattcagccaaaaaaggaatgaagtactgacacatactacaaaatggatgaacctgttacaggtggcaggtatccaagttaccagggcaaatctgtatgggtctgcagcaacttcagttcttgcctcctcagaagaaagaatttgaccgaggggcaataaggcacaaaaagagactgaggcaagtttcagagcaggagtggaagcttatttaaaaggcctttaggaaagaaaggaaagcacgctcggaagagtcccaagctgtcactgaggtcaactgtgatattgacctcgatcctaggactttataggctggctcctttcccatgattcttcccttagggtgggctgcctccatgcgcagtgccctccttacccttgggaagtgagcacagcgcaatatgtatgaagttgtatgcgtgcccatctgaggctttcttcccttttccgatagagtccccctgaaaggtcatactccccgattttgtctcttaatgcatatgcccaggaagttgcttctccctgtcacctgcattcaacgagcactttagtgcaacaggtgtgagccatcaggaaatggcctctccctggcaccggctgccaatttatcacttttagaggcaatgtgataaatgcctaagcatcaccccacattcctagtgggtgagggaagagccctctcctgccctgctcatgcctaactacctgtaacaaaccttgtaaacattaagccagccaccaaaagaccatataattccgtttatattaaatgtccagattagttaaatctagagagacaaagtaggttcttggttggctagggctggaggagttgggaggatcaggggtgatagctaaaaagtacaagtttcttctttcgagtggtaaaaatgctctcaaatagtggtgatggttgcccaagcctgtgaatataccaaaaatcactgaacacttcaaatgggtgaattatatggcatgtgattacagtctaataaataaatagtatgtcctgctgtatccttcagggcctctgagaaatggagagagctccatctgaagccagactgagttccgatcctgcttctattttccccgcaggtaaatccttcctcaacagcaacacggggtgatacgccctatccggaaaggttgttgtaatttttaaaaacattaaaaacatacattagggttaatcatgtagcgtgtgatacacagacgctctgaaacactactgcacacgcacaccaacatggggcctctgcggagcttgtgaaagaaccagatctggagggctggtcgtgtccctggtctcggccctcgccctccttgtttcttaggctctaaagcaatcaggcagcagagcagtccttgaaccccagtcaagaaaaagccctgcaccccttagtccgaaagccgcaaggaacggggcctaagcgcctggcgaggccgccctaccgggcagagacagttgctacgtaactcggggaccagaaacccagccccacccgctgcggttaaccgacagccgcaacggttcccgcaccgcccgggtcggagaacaatgctgcgccctgcacgtagagcctcgcggtgccgcgccctggggcgggcctgcccatggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcgggtgagtgcggagcaaaggggctcttgcagcttggggtcaaacagggtgcagccttgctcgtgcgctcctctgggactcatccctgagaagggcctgtggtttagacctgggctaggagtattaccctttaaagctttcaacccgctggagccttcctgggacaccaggagaagtcctgggacccgaatgcacagtttctacgagttggagcaaagggacaagacagctgcatcaaagactagtttttccatttgcttattctaagagtgcttgttaataaagaaaagcaatcagggcaacagcgacgtgtacctgccattgacagacactttgacaatggaggaacctgagtaatgctgaagctgcgggagacttcatcagaggagtgttaaaaccccgactaactggtttcttttggggaccttccgggtattctgttactgaaatatttcttaaaagtgccttatttggggatgaaaatataaaaataactttaatctctttctccatttaacagtactggctgccttcatcggccttttcattataaaatataatcacagaaatcgttgtcttaagttctggcctctctgagccgcctgctggattttatctgacttcgtaattcagtaatgtatttaggaaaacaaccctaactcgctgtgaaccagatgcagagtcgaccttaaagtattgcttttcctttttgttttagccttgataaactgaaatgccttgaggacggtgaggatccagaagtcattccggagaatactgacctggtgactttggggtatggaggacttggtttttatgacctatttatttaaacattttttcaacattatgttttgaaaagttgaaagtgcagtattgattgttgtctgtatacccaccccttaaattcagctgttcttaatatttgaccatatttactttagccgtgtgtatgggatgcctgctgtgtgttttttcattttgctatcccccattcagtaagttagacatgataatttacccgtaaatacataagcatatagcttctaaaagtatcattctcctacataattattgtggtattattatacctaagaaaaccataaatacataatctataatattcagtccatattcaaacttgtgtttattttttaatatttttgaatgtttgtttatagaggtaatctacttagatctggggggcaacctaaatactctgacagtgtttttcaaactatttgtggtaaaggacagttcttgtttttaaaaatttttaatctttgacagatttatgctttgataaaatactataaaaagaattactagaaaaatggaattaaaaaagacaaacacaatataagttcaaatttttaattaaattcaatagacaaaattattcaatgataatggaagtttctaaatgcttactgtcattttctgtacagattggttaacaaataggtcatagatgaattctggtctgcctaccactctttgagaggcactgttgtatgataatatagagaaattgtgcatgtaatagtgaaatttataatttccaatttatagtccacttatttcatactacctcagctatgttctgtcgttcttgatcctacgctattatccccctcaaatattcaggcagtcatttcaactctacttgggttttctttcataataactgctaaatctgctcccctggtccctactgctgacttttacagcagcaacacctggagcactatgcaaggttcttaagtgtctttgataagtacagtcatttctcccactgatttatccatcatgctgtcgcctgagcatgccattttgcttaaaaatggtctatggccctacatctcctatatggaaaaatttcaaactccttagctagacatttgaagccttccacatatatcccaaatttgcctttccagatttattttcaaccactttctctttcagatggctcaggatgcatgtggcctctctcccatctgaaacataccacttctatgttatgttatgttacgttatttttttgagatgcagtctcactctgttgcccaggctggagtgcagtggcgtgatctctgctcactgcaacttctgcctccgggttcaagcgattctcctgcctcagcctccggagtagctgggattaccggtgcctgcaccctcggctgcctaacttttttgcattttttgtagagacgggtttcaccatgttggccaggctggtttcaactcctgacctcatgtgatctgcccaactcgttctcccaaagtgctaggattacatgcgtgagccgccacaccttgcccataccacttttttaaaagcccaaagattcctttccagattaccacaacccatctttcccttaggaaacagatgcatttatactgccttaaactcttaacatttctaaagtccttgaaggctcaatgagagtccaaactcccatctgtgtattgttctcaagcctactatactgccttgctccaattggtgctctgtaactattgttgattgattagttgtatttgtctaaaatgcacatctgattgtcactcccttgcctaaaaccttttgatgtcccttaggctgaagtcctgagtctgtagtggctcacaaaggcctctaaggagtggaccttgctgttttcattttgttttgtttttgagatggaatttcactcttgttgcccaggcctgagtgcaatggtgcgatcccggctcacggcaacctccgcctcctaggttcaagtgattctcctgcctcagcctcccaagtagctgggattacaggcatgtgccaccacgcttaattttgtatttttagtagggacggagtttctccatgttggtcaggctccatgttggccaacctctcgtgatccacccacctcggcctcccaaagtgttgggattacagatatgagccaccgcacctggcccgaccttgctgattttttttaagctttctctctgcagtgttccagccacactgcactgtgtttcagttcctcgaatatgctctctcactccaggcctttgcccagaacagtcattcttgcttatctcctgaccttgttgacttctactcatcctgcaagtcttagctaaaggactacggactccatttaggtcatcttgtatgctcatgtagcaccctatgcttccctattgaaatgctcatcacatctgtaatatacgtgtttaattttctgtcttcttagctacacttgaaagttccttaagttacatctgccacactcactgctatattaccaattcctagaactgtggtgcatagtagggagccaacaaatatttgtagaatgagtggaataaatgaaactttcagaagactcaggcaagtgatttttagagatagactgaaaaaagaacgttgatgataatcatattaaagcagactcttttttgctatagttaataatgtattcattgatttatagtaattttgttaagccatgttaaatagtaattttaagactgcttaaacattatttcccttgactactttgcactactaggtcaactagatctctttggtttcttctagtccctccaaacaggatttgtgggtagaattatatataatctaatgtaaatcagtacggtattcttcaactggggttattttgatatactgtgaagctagtgtatttaatacatgaccattgttaaccttaatggtcctgccaaaaaaaaattagacttgtggcaaaagcctaaatttgtatctctatgctttatctttctctgaaccttccttttcctcaccaataatttcacattattatattataaaaataaaacataagtacatcatttctttattatgacataaaataaatttctggtactttttctttcccacatcaaatgaaagagctcgttttatgcatataagggaccaaaggtagttggtagatattgattcttccttgatacatgttgctcccttaatctatagcaaactacatagctttggcagttttgacattttttttgactacttagttggttttaattcctaggaataggagagataattgttaatacatgggtgctgctaaaacttacttgtcattccaaaagcttcagcaacatcacttatttatttgtttatttatttatttttagacagagtctcactcactctgttgcccaggttagagtgcagtggctcaatctctcctcactgcaacttctgcctcctgggctcaagtgattcttctgcctcagcctcccaagtagctgggattactggcgtgtgccaccatgcctggctaattttttatatttttagtagagatggggtttcaccattttgaccaggctagtctcaaactcctgacctcaagtgatctgccggccttgccccaaagggctggtattacaggcgtgagccacgacgcccagcccttcagcaacattacttttaatacaatagaaattttagattattctgcccatccccctcacttttgtgaccaagaaagcactgtttacaggtccaggatgtactgtttaaaggttaacaaaaggaacttacagagtcctgcaaaaacaaaaaacaaaagaaccatgaaattggagaactcaaaactcctattccaccaaaccaaccacaaatgattttttaaaaaaacttaaacagggtggagtgcttgaggtcaggagttcaacagcagcttggccaatatggtgaaaccccacctctactaaaaatacaaacattagctgggcgtggtggcacccgcctgtagtcccagctactcgggaggctgaggcaagagaatcacttgaacccgggaggtggaggttgcagtgagctgagatcgcgccattgcactccagcctgggtgacacagcgcaactctgtctccaaaaaaaaaaaaaaaaaaaaaactgtcaaacagctctcatatatctgaagttggctagaatgacagaaaagagcaccatcaaactgggaatcttgtaaactatcactgtgccccagatgttacaaaaatgagcaagaggaaataaaatctaacgagagcttgttgcagataatcaggaaataactgtttatacagatcaactttggagactacctgttccactcggaaacaggtaaagcctgttaagtctagccggtcgtggtggcgggcgcctgtagtcccagctacttgggaggctgaggcaggagaatggcgtgaacctgggaggcggagcttgcagtgagccgagatcacgccactgcactccagcctgggcgacagagcgagactctgtctcaaaaaaaaaaaaaaaagagaaagcctataagtctgtactccaaacagaattgaatatactcaaataagcatttgagggtataaaaatgtttaccttggcttagaatttttaaaactattaataagaatggaaatgatgactaaaggagaaatgaaaaaagagttgatgaaacaaagggaagaaatggaagaaaaagacaattacctcataagtgaataaattgtaagatacctaagggaaaatagactgaaatgaaagcaagaggcaatgaagaaaggcataaaaacaacgaagagaattgaaaatgacaaagaaaaaagtaagatgaatccgagaaagtagggaatggtaggtagataggcaaagacataatattcatattatcagagtccctgaagaagaaaaagaaatggaacataattcatgtttaaaaacataatccagcaaaagtttccagaaattgaaaaaaaaactaaatctagaaagggttccctaggtacctggaaaaattaacccagacttattgacttttgggatatattttagtacaactattagatttcagagataaagatgaaatcatcaagtcttctgtgcaaaaagaacatataacttacaaaggcaaacttacaaaaagcatcacatgttgaaaaactgacatacaaagcaaggcaacatagagcagtgtttttttttaaagctcaatgaaggtgtgaattgaaggattttatatctaactgaatgttctcaaatgtcaaggttatagaaaaagagttttcgacataacgaaaacctgggtaatttctgtacctgctggccatttctgaggaatatacaagagaatgagctttatccaaccaattgatgactggaaaattttcagcaaaaggactaatacagagaggatgagggtggaagatttgtgtaaccgttgggtattgcaacaaagtacagtattgcaactaaaatgatggaaggagaaaaatggataatgtgtgggcaatagatgggttttaaagactactgcagaggagaaaaaacctgacacaccagatagtaaagtgttaaataagaaaatgggtaactctaggatttaaaaaatgtgagtagaaaggtaaccagtagaacaataatagaaatatcaactccccctcaatttctaaaaattaaatggaaaagaagggtatgcatttcataatgaaaaacagctattacaacaaaatacaaataattagaaaatattgtgatagagttgagaccaaatacattagtcttaagcaacctattaaaaaaggattttcaatttggcttgtaaaacaaaaatcttgggatgacaagagacacatctaaaataaaatgattccgaaaagctaaaaataaagggttagaccaaagtataccaagtaaatggaaacaaaaatcaagcaggagtagtgatgctgatatcagacaaatagtattcaagccccaaagtattacatgtgataaaggacactttttaatttatatcttatggaggtacgtatacataaaatttgctccctgctaatgagaactgtatgacatgttcacaaaaattgattatgtattaggtcacaaaggaaacatcaatgacattcataacatagaatattactaacaggttgcgtgcagtggctcatgcctgtactctcaacactttgggaggccaagatggaaggattgcttgagccctcgagtttgagaacagcctcggcaagatagggagaacctgtatctacaaaaaataaaaacaattagccagctgtggtggcacacacctgtgctcccagctactcaggaagccagggtggaaggatcacttgagcctaggagattgaggctgaagtgagccgtgattttaccactccactccagcctgggcaacagaaaaagaccctgtcaaaaaaacaaaaagaaaataaatttccagctcagaaaacaaaaaaagaacaacaaagtaagtgaaaagaaaatactagaaaggaaataataaagataacagaaattaatgaggaaaataatactttttgtccgagcaatcccatttctagtaatttataccaaaggtacccctccaacaatatgaaaatacatgtgttcaatacttactagtgatgtttagcttgtttctgtctgcttgttattccttgcagtattgtttgtaattgcaaaatatttgaaataccttaaatatacagacgtaggagaggagagtgttgaatacgctatgggaaatccacacggtaatattttgcagctagaataaaggatgaggaaggattaattcagagtaatttccagtacattctattaagtgaaaaaagcaaagtcccaaagtatatgccacctttcatgtaagaaaggtgtgccaggtgtagtttattggctctcatcttcaaatttacctctttttcctgctctgtaaaaatggaccttggccttttaaatacttttcttttgccaactagcacatccttaagctttgtcagtgaagggcaatggagagacttctcaggagtctcaaaggttttgcttcctgatctgatgtgctggctcagcaggatcctgcagtgcacacagcttccccagtgcccagctcctgcaatacactgcagtctgaagcaccccgcgcccagcagctttcctgccaaccccatttccctccacagctcccctgaacaggttttcctagtgcccttgagggtggatttccagcaagttccactgatgcagtaccatagcaacttctttctccagctcgtctggatctctgtccaggaagaaaaaaggacttccctgtgctctttctcagccctaggggtagggtgctccttctgtttgctattattctatactttagtgttcccttttactgcttccttgccaatccctcattattccaatcctctgttaaagttattgaatccttaacctttgttcaaattgctgttctttttttcttcctaattgaactcagattgatacaggagataacagagtatacacaaatatctgtttatttgaacaaaggaaatggaaaggacaaaccaaaactatagagattgattgcctgcaggggtgggtgggaaaggggtggaaagaagggagggaatgggaacaggttagtaggaacaaagagggagtgacacttttgactcttaggatcatagtaatgtgtcacatatttttcacacaccccaaatgtaatcagacaattaaaaccaactaggatgtagggggaacccaaaactgaattcaaaaactaaaaaataaggctagttgtattacggatgtgtaatataacaccactgaaaagggtggggaagaaagaactaaagtctgtattaaagcctgtctttttttttttttttttttttttgagcacttcatgaatttgcatatcatccatgcacaggggccgtgctaatcttaaatatattgttccgatttttaaataataaaatgctaccaaaagcgtatcttgatataatgtaaaggtgaagacagaactgtttataatttagtgtttctcacaggggtataggttagcaattctgtaactattttatgtatttactagaattgaacaaatcataggttgccaacagtgaaagctggatttctcacttgtggagaaagacgttataaacaaggaaatgttaaaggctaaaatgaatcctgtggttttagtttgggatcagaagtatcagtataaacccatagttttaaatgtatgacagtaaaatacagaaatacagatatttatacatgtataggttagtatacatacatatatttcctgcctatctcagctgagaggcctagaagcagtgactccagtaacaatgagaacgcctagaacccagatactggtctctaaacacctttttccagtaaaggaactagggctcttacaagtggttgattccggggacgagacaagaaaaatataggatgggccttgagcatcttgtggtgccggaaagtaagggaatattaaaaaaataaaaaataattttaaaaaggagaggacttgctgaaagaacgggagctcctaatgataaagctgtaccaatttgaacaacaaaatagtgatagtattagattttaaccccagaataaaacaattatctgtaggttcatactaatagaaatgatgaaataaacagatgggaggaaagaggcaggtcttcctcaaaatataattccaatgaataaatgtagaagatccaatgaataaatgtagaagaaagtaaagacagaattgctattaggcatacagcacagtaataaatgttgcagacataatctatcagtgaatgctaaaattcatgggtgaagtttgaggagaaacaagatttgcatagtgtcaaagtatctcccccaaaatatttaccaagttcatagaaaataaggtgtctttctggtgcaggaacctggcagacagaaacaagctaaacatcactagtaagatgtcatattaatatcatgaacatcttgatatgatataatgagaagggcatcattgtagtattcttaccaaaatgctaaatttattcctatcatgaggaactagcggtcaaacccaaattgaaggacattctataaaataactgattagagctctttgaaattgtcaagatcgtgaaagataaggagagactgaagtattttaacaaactcaaggagactaaggaaaaataacagatgccatgtgggatcctggataggaatctggaacagaaaaaaaaaaaaacgagtaaattaaaaattgtgtgaaattttaaaaaggcgtatagctaataatattgtgtaagaatttatttcctgttcttaattgtctcatgatcaagtaagatgttgacataagggaagctgaacaagagatagaagggaactttttcctgcttttgctacttaaaattagttcaaaataaaaaaacttgaatgttaaatatgtttttgaagcccgaataacaaatgttgaactttgatttttttttttcttttacatctacaacagggttagaaaaaggttcttggaacatcgggaagaaaccattacaatagatcgagcctgcagacaagaaacattcgtttatgagatggtaattaagagtctcatctttttcacccttttctcttaaaacagtaaaccgacattggctgagggttagtaatgacagtatggtagctttatactggatatgcttagttgaaaacaaactagagaaactcctttgagtctgggaactagtgagagaagaggacccttagaactcaagtgaccacatgtttgactttttcagatctctgcctttattcttgtttggttttatcttgctttcgatattaggctaaatttatgccttttcactaccctatttctggtctttttgttctgctcctgattttggtttaaccacattctcaatcctcatctattatctcttgtgtaaaactttgggaaaatttaagatgatgactcttgaggaattaggagctagtagacacgataggttcagaatcaatgtgctaggcactgtgctggcacttgatcatgcatacgggcacctattgtctctcccacttattttacttttattgtggtaaaatttacataacataaaatttaccattttgaccattttaaagtgttcaattaagtggcaataagtacattcacaatgctgtaaatcatcaccatttccagaactttttcatcatcccaaacagaaattccatacctgttaagcaataactcaccagttttccctcctgcagcccctgctaacctctattctaccttctttctctatgaatttgtctattctagatatctcatgtaagtggaatgcttttttgtccttttctgtatggcttttttttttttttttgaaacagagtctcgctgtgtcgcccaggctggagtgcagtggcgccatctcggctcactgcagtctccgcctcctgggttcaagcgattctcctgcctcagccttttaagcagctgggattataggtgcctgccaccatgcctggctcatttttgtatttttagtagagacggtttcatcatgttggccaggctggtctcgaacccttgacctcaagcaatctgcctacttcggcctcccaaagtgctgggattacagtcgtgagccacagcacccagcctatggcatattttacgtagcataatgttttataggttcatccatattgtaacgtgtattagaacttccttcctttttatggctgaataatatctattgtatgtatacaccacgttttgttctatttatccgttgatagacatttgggttgttttatcttttggctattgcgaataatgctgctatgaaaattggtgtacagatatctttttaagtcctttttcatttattttgcgtctgcccctaggaatggaattgatggattgtatggttaattctgagaaacctgtttttcatagcaatgataccgtattacattcccatcagtaatgcatgaaggttccaatttctccatgtacttgtgaacatgtgttttctagcttttttttaataatagccatccttgtgggtgtgaagtagtatctcattgtggtttcgatttgcatttccctaataactagtgatgctgaacatctttttatttggtttttggccatctgtatattttctttgaaaaagatctattaaaatattttgtccattttcaaattgggttgtttatcctgttgagttataaagagttcttggccgggtgccatggctaacgcttgtaatcccagcactttgggaggccgaggtgggtggatcacctgaggtcaggagttccagaccagcctgaccaacatggcgaaaccctgtctctactaaaaatacaaaaattagccgggcgtggtggcatccccctgtaatcccagctactcgggagactgaaacaggagaattgcttgaacctgggaggtggaggttgctgtgagccagtatcatgccactgcactccagcctgagcaacagaatgagactctgtctcaaaaaaaaattagccgggcgtggtggcaggcgcctgtaatcccagctactctggaggctggcaggacaatcactagaacccaggaggtggaggttgcagcgagcccagattgtgccattgcattccagcctgggcaacaggagtgaaactctgtctaaaaaaaaaaaaaaaagagttctttgtatattctggattctagacccttaccatataagtaatttaaaaatattttatcccattctatatgttgtctttttacttacttttctttcttttttttttttttttgagacagagttttgctcttgttgcccaacctagagtacaatggagcaatcttagctcactgcaacctccatctcccaggttcaagtgatgcttctgcatctgcctcccaagtggctgggattacaggtgcctgccaccatgcccagctaatttttgtatttttagtagagatggggtttcaccatgttggctaggatggtctcgaactcctgacctcaggtgatccatgcgcctcggtctcccaaagtgctgggattacaggcgtgggcaaccacagtcagcctttttactttcttgatactgttgctggatgtacaaaagtttttaaatttgatgaagtctagtttatctttttcttttgttgtccttgcttttgatgtcatacttaaaacattgccagatgcagcatcatgaagattttcccatatgttttcttctaggagttttatagctttagctcataagtttgtctttgatccactttgagttgatttttatatatgatgtaaggtaagggtttgatttcattcttttgcatatagctgtctattttttgcagactgtcctttccctagtgaatgatcttggcccttttgtccaaagtcagttgaccatataagtttcattgttacattctatcggtctagattctaacctagaactacactgttttgattactttggctttgtagtaaattttgaaatcagggagtgtgagtcctccaactttgttcatgtttttcaagattgttttgactattcagagtcccttgaaattccctatgaattttaggatgggtgtttctatttttggaaaaaatgccattgggattttgatagggattgcattgaacctgtagattactttgggggagtattgagatcttaatgatatcaagtcttccaatccatgaatgagatttctttccatttatttagatatttaatttcttacagcagtttttttttttttttttttgagacgaagttttgctcttgttgcccaggctggagtgcaatggtgcgatcttggctcaccgcaaccttcgcctcccgggttcgagcgattctcctgcctcagcctcctgagtggctgggattacaggtgcatgccaccatgcccggctaagtttttgtatttttaatatagatggggtttctccgtgttggccaaactggtctccaactcccagcctcaggtgatccgcctgcctcggcctcccaaaatgctgggattacagacgtgagccaccgtgcccagcctatcagcagtgttttatactctttatgtatacaaccctttcacttccttggttaaatttatccctaaatattttattcttttgaatgctattgtaagtgaaattgttttcttaattcctttttttttttgagacagtcttgttctgtcacccaggctgagtgcagtggcacaatcttggctcactgcaacttccgcctcccgggttcaagtgattctcatgcctcagcctcctgagtagctgggactacaggcgcccatcacaatgcctggctactttttgtatttttagtagacacagagtttcaccatgttggtgaagatggtcttgaactcctgacctcaggtgatccacccaccttggcctctcaaattgctgggattacaggcgtgagccaccgcacccggccctgttcctattttctttagtgtttttatcatgaaagggtgttagattttgtcaaatgcttttctgtgtcagtcgaggtaatgatctgttgttttttttttttttttgccccatcattccattagtgtggtgtattatattgattgacttgctaatgttaaattacccttgcattttgaggataaataaattccacttggttgtgggattcaataaaaattgtaatcataaaaagtaccttttcttatcataactgaatgacattagaaatcaataacagaagaaaagttggaaaattcacaaaaattaaacacatttgacaaaagccttttcatatgcttctgaatttgctttgctagtattttgttgagattattgcattcctatttataaagggatattggcctgtagttttcctgtagtgtctttgtctcactgtggtatcaagataatgctggcctcatagaatgtgttaggaagtgtttactccttttgaaattttgtgaaagagtttgagaaactctggtattaattcttttaatgtttggtagaatttaccagtgaagtcatctggttctgggcttttctttgttgggaggtttttcattgctgattcaacctccttacttgttacaggtctatttagattttttatttcattttgaatcagttttgatagtttgtatgtttccaggaatttgtccttttcatctaggttatccaatttgttggcaaacagtagttcatagttttctcttctaatcctttttttcctgtaaaatcagtagtaacgtctccacttttacttctcattttagtaatttgagccttcttttttctcagtcagtgcagtaaaagtttgtcaaatttgatgttttcaaagaaccagcttttgtttttattgatttttctgtattttctattctttttcacttatctccactcatctttataattttcattttttttgctagctttgggtttagtttattcttaattccttatctagttattgagattgttcttttatataaagttatacagccataactttttaaaatcactctttttactatatctccctaagtttcctatgctgtgatttttgtcgagtgttgttaaatttccacatacttgtgaattttccaatttttctcctgttattgatttctaatattcacttaatgatcagaagagttacgtttattactttaattttttttaatttaagatttgttggtgtatcctggagaatggttcacatgcacttgagaagaacctgtattcagctgttgtttggagagttctttgtatatctgttgggtctaattgttctcgttgttcaagtctcctgtttctttattgatcttctatctagttgttctacccgttattgaaagtggggtattaaagtctccaactattaccatagaactgtctatttcttcaattctgttggcttttgcttcatatattttattttacttatgttttttgagatagggtcttgctctcttgcccaggctggagtgcggtggcgccatcactgcgcattgctgcctcaacctcctgtgctcaagttatcttcccacctccacctcccaagtagacaggactgtaaacttgcgccactatgctgagttaagtttttgtattttttgtagagatggcgttttgccgtgttgcccaggctggtcttgaactcttggactcaagcaatctgcccaccttggtctcccatgcttcttatgttttagagttctgttggctttatataagtttataattgtatatatcttcttgctggatggcatcttttgccaatatataatatccttctttgtctattgaaaccttaaaaaattttgtttttagaggtgggtcttgctctgttccccaggctggcctcaaactcttaggctcgagtaatactcccacatcagctttctgatagctgggactacaaacacatgccaaaacatcttatttttctgtaacttaaggattactttgttttttttgagacagagtctcactctgtcacccaggctggagtgcagtggcccgatctcggctcactgtaatttctgcctcctgggttcaagtgaatcttgtgcctcagcctcccgagtagctggaactacaagcacccaccaccacacccggctaatttttgtatttttgtagaggcagggtttcaccatgttggccaggctagtctggaactcctaacctcaagtgatccacctgcctcagtctcccaaagtgctgagattacaggtgtgagccactgtgcccagccaggattacaattaaatcttaaaattgaaacaacttacttttaattatacacagtcctcaacctactgtggtttgacttaggatgttttgactttatgatgggtttattggggtcttaaatgcattttccacttgtgatgtattttatttatggggtttattggggcataatcccatcattgttgaacatttgtgtcagttttgtttctataatattcaaatactctgcttccacatctttgtctgtccctctttgggttgtcacagattatgtctttatatattgtgtgtccattaacataaccttgtaagtattgtttaatccatttattttgcaatcatataggaaaaacagaaaaatcgtagaggagtgagttacaaaccaaaagtacaataatactggcttctatatttacctgtgttgttccctttagcagtattctttatttcttcttatggcttcaatttactgtctagtgtcttttcatttcagcctgaagaatcctctttaacacttcttacaggtcaggtctgctggtagtaattaattcccctagcttttgtttatctgcaaatgtcttaatttctccttcattcctgaaggatagttttgccaaatacagaattcttggctgacaggttttgttttttttctttcatgggtttaaatatgtcacccaaaaaagaaaaacaaaagtaaaaaaatttaaaagctgaacacagtggtgggttcccatagtctcagttactgagaaggttgaggcagaaggagcacttgatcccaagagtttgaggccaatctaggctacatagatagatagatttaaaaaatcagggccgggcgcggtggctcacgcctgtaatcccagcactttgggaggccgaggcgggcggatcacgaggtcaagagattgagaccatcctggctaacacagtgaaaccccgtctctactaaaaatacaaaaaattagctgggcgcggtggcgggtgtctgtagtcccagctacttgggaggctgaggcaggagaatggcatgaacccgggaggcggagcttgcagtgagccgagatagcgccactgcactccagcttgggcaacagagtgagactccgtctcaaaaaaaaaaaaaaaaaaaattggtcagtcagtccatccgtctatctgcccattctctggtttcttaacctccatgttttctgatgagaaaactcctgttaatcttattgaggaatctgattttctttaagtatttggtttcctttagctaactgaacacatttttaaagttgatacataatgattgtacaaatttctggggtactcattgagcacatttaagtcagttgctgtaacgtctttttttttttatttaacgttattattatttttttaatttcattttcttcattttatttcatttatataccctgaagtgggatgactgaatcatgtagtagttctacttttaattttttgagagacctccgtattgttttccgtaatagctgtatcaatttgcatccttgccaacagtgtgcaagagttcccttttcttttttttttttttttttttttttagtatttattgatcattcttgggtgtttctcgaggagggggatttggcagggtcataggacaatagtggagggaaggtcagcagataaacaagtgaacaagggtctctggttttcctaggcagaggaccctgcggccttctgcagtgtttgtgtccctgggtacttgagattagggagtggtgatgactcttaaggagcatgctgccttcaagcatctgtttaacaaagcacatcttgcaccacccttaatccatttaaccttgagtggagacagcacatgtttcagagagcagggggttgggggtaaggttatagattaacagcatcccaaggcagaagaatttttcttagtacagaacaaaatggaatctcctatgtctacttctttctacacagacacagcaacaatctgatttctctatcttttccccacatttcccccttttctattcgacaaaaccgccatcgtcatcatggcccgttctcaatgagctgttgggtacacctcccagacgcggtggcggccgggcagaggagctcctcacttcccagaaggggcggccaggcagaggcgcccccccacctcccggacagggcggcggccaggcggaggcgctccccacctcctggatggggcagctggccaggcaggggctgccccccaacctccctcccggacggggcggctggccgggcgggggctgccccccacctccctccgggacggggcggctggtgggtggggggggtgcccccaacctccctcccagacggggcggctggccgggcgggggctgccccccacctccctccggggcggggcggctggccgggcgggggctgcccccaacctccctcctggatggggcggacggccgggcgggggctgacccccacctcccttcttgactgggaggccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagaggggctcctcacatcccagacgatgggcagccaggcagagacgctcttcacttgccagacggggtggcggccgggtacaggctgcaatctcggcactttgggaggccaaggcaggcggctgggaggtggaggttgtagcaagccgagatcacgccactgcactccagcctgggcaacattgagcactgagtgaaggagactctgtctgcaatcccggcacctcgggaggctgaggctggcagatcactcgcagttaggagctggagaccagcctggccaacacagcgaaaccccgtctccaccaaaaaaatatgaaaaccagtcaggcgtggcggcgcgcacccgcaatcccaggcactgggcaggctgaggcaggagaatcaggcagggaggttgcagtgagccgagatggtggcagtacagtccagctttggctcggcatcagagggagactgtggagagagagggagagggagaccgtggggagagggggagagggagagagggagagggagctaacgtctttgtttagtggacttttatttatgtgcgaatgtaactattgcctgtaggaataattaattgacactttgactagtaattccaatgtctgggcttcctcagggttggttttgtcaaattcttattttcctaagagttgtccatactttcctctttttttgtgatttatatgtttttttgagaactagacattctaggtatattttttcttgtgcatggctggagctgcctgtgacttttccaaacgattattgtagcacgtgtattacttgttgtacgtggtcactgatgtttctgtttcattctctctgcggtcaatcagtgatctgacaaagatttccttaaatacctggctccaaaaagaaaaaaagcatcttgtctgtaagtcttccaatatagatcctgctgggggaagctgctgccaccaagagggtgaaaaccaatgcacgtacctggaccaggcactcggcatcaccagaccaaccaaaacataaaatcctcagttcttagagaacaggtccccactgcctgccttggcaccagccagcttctccaggaattccagctgcctgtctcatcggcgaggggcgaaggagtgagggtggtagttgatttgcacacagtgcttactaatgaaaagcagcaacttctctcgtcatcaaacactcccctgattgttgtaagtgtcccatcaggttccagagttcccaaatagtttattccagtctctcattccagcttactggttgcttctgttagagggactaggccctggagctgcctactctattttgtgacatgattcccacttatttttaaaactcctgcatctaaaccagttcagcctggcccctattttatattaatttagcacacataaaagatcaaaatatattaaagatgtcatggtgttataaaaagcatagggtttagagccaaacaaatccgtatttgcgtcctaactctggtatgaccttgagtaaatcactgaacctctgagctttatctgtaaaatagctttcacaggaatatttgataaggaatgtaaaaatgtaactggaaatgccagtgttataccaacattagttgatactactgtttgctcatcaactgctaagtactcagtaccacacatcttatcagatgcattgtgtacacattcccagcaacagtacagtaagtattttctggttctgtttgtttattgaaagaagatgaaactaaagcttagagatgtcttaacagttttcccagagtataattaggtgtcaaacccaaggctgcttgactcgatcccttgctgatagccattgtaccacactgcatcttatctgagttatagtatctgatttcagtgtctctttttctttcttcaggagtcacatgccataggaaaaaagcctgaaaattcagcagacatgattgaagaaggggagcttatcctatctgtgaatatcttgtaccctgttatatttcataaggtaagtagtaaaaccttttggattttatggataatagtaacttttgtaaaagtgtttaattatttgaagagtcatattcctatgcttacattaaaaataaacactctgggagtggtggctcatgcctgtaatctcagcactttgggaggccaaggcaggaggatcacttgaggccaggagtttgagaccaacctgggtaacacagtgagaccttgtctctactaaaaatcaaaaaaattagctaggcatggtggtgcacatctgtaatcccaactacttgggaggctgaggtggggagatcacttgagcctaggaattcaaggttgtaagcgagctatgattgcaccactgaactccagcctaggagacagcgtgagaccctgtctaataaatgcaagcatatgctgcctatctgatgtcttatttttagagttgacaatctataatcttgtgccatctgttctaataaggaatattggaaataaggtcaaatttcaaacaatctctcgatccagtaggattacaggtatagtattgaaatatatgcctgatttctgcactagaagcaactgaaagtatatgtaaatccataatgattctaattctactaattcttgagggatttttgcagaataggtggctaatggaggaattagcctatgttcactaatttagaatacttgggaagttattgaactaaccagaggcagctcttctttgatgaaaatacagaacattattaagtcaagggtatctaggaatctcttaggagaaagaactctttcctaggccagagtgtatatattcttgattccttaaatagatgtgtcataaattctgatgagttgtcattgaaatattaatatatataagttgcacttatgaataaataggcttttacaaagcatctgggatgtagttagtactaattatcttatttgattaagatctcaaattgctggctgggtgtaatggctcacacctatatcctcagcacctttggaaggctgaggtgggctgatcacttgagctcaggagttcaagatcagcctagacaaagtggcaaaacctcatctctacaaaaaatacaaaaactagctaggtgtggtggtgtgtgcctgtagtcccagttactaaggaggattgcttgagcccgggaggtcaaggctgcagtgagccaagaccatgccatggcactccagcctaggtgacaaaatgagactgtccctcaccgccacccccttctccccagaaaaagatcccaaatgaccaatcataaaaagaaaccaaaccaaagtatgaatctgggtttataacctcaggttacagtatagattgcctgacctcaatgaagtaacttttaggaaattttaagacagtcttgctaaatgaagttacattccagtggatcttaatgctcatgtcagtttggtatcatcttgattataaacttcagtttaaaccagaaaatttccatggctgagtatgtcagttgtacccatgggatttttgttggtttgtttgtttttgagacagggccttgctccattgcctaggttggagtgcagcagtacaatcatggctcactgcagcttcgctcgagcaatcctcctgcctcagcctcccaagtagctaggactacaagcatgtatcacaacgcccagctaacctttaaattttttgtagagatggggttttgctatgttgcccaggttgatcttgaacttctaggctcaagcaatcctcctgcttcggcctcccaaagtgttgggattacaggcatgagccactgtgcttggacattccatgctattctaatttatggagatgactgagtgatgacatggagaggctataatgcctttgaaaggagatttttattacatttccttagaggagggggcacaccatgtagggccacaggaagaagcatcattctcatttaggaggctgaaaggggagaggggaaggcatagaccacagtttttattggggtttctgtgggaaagacaaggtagggaagagtaaacagtttaggattggctagttcgaacaattccagtaggtttggtggcagaggggctgtcccttgtagcctggtgcttggccctgggtggattgaggttgagggaataccaggggaaatagtggcttggtgtgtaataaaggaggtggtttcagagtggctctggatcacaggggagatgtaaacaattttgaccatgagtttggccctataattattggatgtgaaaatacagagcatcaagttatggggacaatttaaaattaagaaaaccagcaatttaattttgatctagtcatgacaggatttgtagttttatcgctttgtctctaaatgaacacttatttattctttgacttttagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagtaaggtgatttcctcccataaaacaaaaggaaataacaagctaagaaaatagcgattactctagctggttcataaatgtcccagtaaatccttttcttctcctgcgggattccatcaaactactacactatctcattccttccctttatcaccggaacttttccaaagaagaggctagactctgttttgatttcttcatctctcatttgtttctaaactattgtatggagacttttccttctgggctaatagggaccacctaattttcttttttgttttttttttgttttttgtttttttgagacagagtctcgctctgccgcccaggctggagtgcagtgtcgccatctcagctcaatagtgaccacctaattttctaagcagttggtcacttttccatttttatgtaacttgacctcactgtagcatatgactttgctgttcattcactcgtttgaagctctgtcagagttgtgatctgtcatgattgtgcccagcaaaaggctggagtcgacctgagagcctcaaatagttagcacccattcttcacctttcgctgcccaaggaccaatacccaacaaggagagagcatatgaagttggtccttgctggtgtttccccaatgtgttgctctcaaaaggaaagagaagccctgcataccccctggataaggatggaaagaagcagtgtggtagactggctacccacaatgttttcagaaaggatcatttacctaataaagcaggagggccttgatcccttccacatttcatcatagggcaggattgaactaaacctgctacaactctggcagagggcctcaggtttacagggccatttcaggggagggatagcatctcctagagataagtaaaaagatatttggaacaacaaggatggagatagtgtttggacaagaaccaacacaatctccttttttcctgggtcctgttccaccagccacataaatgttggtataactgaggtttcatgttaacttttttttttctccctaggctgacatataaggccttttataatgatgcttcccaaattaactttctgaactgtttacttgctgcctttacacctcattcatccatagtgaatttgtgtattttcatcagtgtaccatactttttcatgtctctgagtatttgaacatggtaggaagccctttccctacttcatccgttttgtgagttcatcctcagatttccaaacccagctcaaaactcaccaattatatgcaatttttcttgactcctttctttgttaccctggcaccttttcttttgtccattgtagtatgtatttcagtatgctgattcagtgtaatgtgtgtccgtctgctccacaggctgactatattcgtttttggtgactagtgtggagactagcatatggctcacatgtagatttcacttaagtacctgttgagttatgctgaaaatggtttttagatatttaggttcttcagggttgccatctcagtgcttttggagagaaacaataggataagaaaagtagaatttcaaaattttacgcggagcaggaaatacgagatttatctttttctttcttttttttttggatggggctctgttgcccaggctggagtgcgatgatgcaatctcggctcactgcaactttcacctcccagtttcaagtgattctcgtgcttcagcctcccaagtagctgggattacaggtggccccactgcgcccagttaatttttgtattttttagtagaaacggggtttcaccatgttggccaagctggtgtcgaactcctgacttcaggtgatccacccgcctcagcctcctaaagtgctgggattacaaggtgtgagccaccgtgcctggccaagatttttctttaaagcagcggtggcaatcttctgcaaagttttttaaccttgtcaaaaaaaacgtaagatgtaactgttaaataataagatcagtctaagaagaaaaatctgaatttaccctcttcactccaaccatctgaacattgctcaaagcagtttgagtcagatctgggaatcggtcttaccttcaggaaaccctggagaatgtttgtctgtctgttttttaatcaagtccagtctgggcaacaactcactgtgttgcccagcagaaggttttaaccaggctttgtcaatttacttggtctgtacattgctgctgatagcttcggaagttttttaagcagggattaaataacccataattgtattttaaaatgtttacatatctcctgttatattgtttctgtctcttctattattattatatatatatatatatatatatatatattttttttttttttttttttttttgagacagaattttgctcttcttgcccaggctggagtgcaatggcaccgtctcggctcactgcaacctctgcctctcgggttcacacgattctcctgcctcagccccatgagtagctggaattacaggcatgcaccaccatgcccggctaatttttgtatttttagtagagatggggtttctccatgttggtcaggctggtcttgaactcccaacctcaggtgatctgcccacctcagcctcccaaagtgctgagccaccaggccagtcagggaagtttattagtggatgacttttgatttaaatggaaaacatttttgttcttttagagttcaccttgtaattaataattatgccaaaagatagtaagttgcttaaatcacctaagatgaagttttatggcagtgttttgtaaaacacatatatattaaacttcattttgtttccaaaataatagttatttttttagaacctttattttggaccctgcttacctctttgagggtgtagaaatatattaagtggcagattttgtattgtagcagctagtcatatgacattaagtacattatacttaatgtacataatctccataacaacctatgaggaaagtaaaggctttactcacattttacatgggaaaacagtgtgagtgagatttagtgactggtccaagaagaaacaacatagccagtcttgcaggagtgtctgatgcgaacacaagataatctgtaagtgggggaatgaagacaagaaagaaaaatggaagcttcaaagaactaggagaaaaattaaaatattacggtaaaattattttagtacctgaaacatatctcctatacataaattgcttttgatcttcaccacaatcctgtaagacatcgtggcagatattattattctcatttcacagatgagaaaacaggtctgagaagtgattgctacataccaaaatcacaaagctagtaagtggtagattaaggaaaagaactcaggtcttctgaccctcattcaggagtctaaatagaaggtgaaggaccagtttaacagagtgcttctcaactctggttgcatgtttttttctagagagctttggaaaaatactgatccccaaagattcttaattaatgagtctgagttgacacttgtgtttggtgtttttgtgatttgattttgcagtcaggattgagagccactcctttgacggacactgtggtagaatgagttaagaacccttgaaggttccaaccagttgtggtacaactacagtacctggggcaagattgcttgagtaaaaatagaaattcagattctgtctgcctaagagttactgaaaatataaagagagaatttttgtaaaaacattgcaaatacaaaaaaatgccagaaaaacatagctcgatgatcattgttactactggggaaacattaaagataggactttgtttaggttttagttctagtatccaacactacttactgctctgtaagtataataaaataatgatgtttatttgatttctaattgggttcctttcatgaatctcaggagaatatacacatttagatcaaacgtagtgattataacagcaatagggtaaaattgaaaatagtagcagtttttgtaacacatattagtgtgattttatgatatatctattttgaattaatacttagagcaatttcatcattgttaatagttgattttctctcaatacaatctgttttcttgtaggacctatacaaatcagccttcttttattttgaaggaacattttataatgataaaagatacccagaatgcagagatttgagcaggtatagtttccaaaaatcttctcaaagtctttcctatttctagttatcaaagtagtgttatctccacaaatcctattattggcctattaaggacctttgccaaggaattattgataaatcttgtcttttgcattacatacatccaaaaaaaattagccagacacagtagtcccagccactccggaggctgaggcaggagaatcttttgaggccaagagttcaaggctgtatagcatgctataatctcgcctgtgaatacccactgctttccagcctgggtaatatagcaagactctgtctctaaaaaaaaaataaataaatcaccttaacatgcattattagtctctggcctttacatataagtaatagtggcaaattaacctttcactattttttctgcctatccagcatatactattgtttgccctaggtgatggtgatatatatatattgcttaagtacatagtataggaaaaatctgtaagctcattttaatgagaccatactttcattatcaatgtcttaacaattacagtatacaagtatatatattattgttgccctttttaaaaaaaaaaatgaaaaagtctcgttctgtcacccagtctggagtatggtggcacgatctcagctcactgcagcctctgcctcccaggtcaagccattctcgtgcctcagcctgccaagtagctgggactacaggtgtgtgccatcatgcccagctaatttttgtatttttagtagagacagggtttcaacatgttggccaggctggtcttgaactcctggcctcaagtaagccgactgcatcggcctcccaaactgctaacgttacaggtgtgagccacaatgcccagcatattgtagccatttttaatctgtattctaacccaacagttcaaacctattggtttcagcattttttttttttttttgagacagtttcgctcttgttgcccaggctggagtgcaatggcgtgatttcggctcaccacagcctctgccttccagtttcaagcgattctcctgcctcagcctccccagtagctgggattacaggcaggcaccaccacgcccggctgattttgtatttttagtagagatggggtttttccatgttggtcaggctggagtcgaactctggacctcaagcgatccgcccacctcggcctcccgaagtgctgggattacaggtgtgagccaccatgcccagccttgcatttctttatactataaataattgaagaccccaatgagctactgcttatgtgggttataactatcactatttataatattaaacattgaaactaagaagtatttgaaatattaatctcattacatactaacattttgtgaaaaatatttttcaaaacacaatgagtggcattgttacacattttgcatttaagctaaagtgatgcacatcatgtaacctgcagaaaactgatcccttatgaaaattcagcgttcctaatctcaacatgtgtcaaacattttggtcttcatctcaagatggcaactgtccagttagttgggtgagctaggttaatgtgaattactgcaatcacaaactgttttctgtagtttttaagtttttgtggaaaaatgatatatccttgccttttcccccctcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggtaggtgacagcacttaagacattttgttacctttttttttctttatttcagagtacaaaaccagagatagtttttttaaaaataagaggagtaaaagtaataaccattgcaacttggcttgggagcagcaaaaatactgtcttctttccatgcaaataccaactctttccatccatttgcatcctctattgttcattattttggaaaatctttaagaaatactttactattagacggttaaaaatctgttaatactttaaaaagtatctctattttgtattaaatagctgttattcagatatagtacttatccatttatatataacattgcaactttatttttaggtttgtctttttgccaaaatttgaagaagataaaagggaattggaggaagagtaattctaatatttgacaaatgtgaagtcttaatgctttgacaaagatttaaattgggaaggagctaagatagtctaaaataagacttagggatgagttataaattttagacagctaatagctctattccatgaataaggctattcatttcctctttatttaggaaatcacagtttaagaaggaatactatgtacgaataaaccctgctccattgctggtttgattccttatgagagaccatttaaaagttttttgtggaacaataatgtacctgtgtttgaccagtaattagaaaccagtaattactggtattaattagtaatttattataccactaatagaaactgatgcctgccgggtgcagtggctcacgcctataatcccaacactttgggagactgaagtgggcaaattgagcccaggagttcgagaccagcctgaacaatatggtgaaaccctctctacaaagaatacaaaaattagctgagcatagtggtgtgtgcctgtaatcccagctactcaggttaaaacgtgaggattgcttgagaccaggaggtcaaggctgcagtgagctatgatcatgccgctgcattccagcctgggtgacagagtgagaccttgtctcaaaaaaaaaaaaaagaaaaaaagaaagaagctgatgctttcagaaagtccctgcttccatttttggtcttactgactcttctccaaaattttgtatcccatgcactccatctcaggaaactatcagaagatgtaaaagtgcttcacagaaagtgtaaaccatgaacaagaaagacatggaatgcaacacagaataggttaaatagacataaaagggattctcagaattatggaaaagtgaaatcccagtgtgagagctttacaccagacccagagatttgatcaagggtctggagccaggagcatacagaactcaggaaggatgtctgggaggaaaaatagaactggtagactcccggttgttcactgttctgtcagaaaataggggactgaattcgtgacaggtacactgaaaattaagcaaatgggccaggcccggtggctcacgcctgtaatcccagcactttgggaggccaaggcgggcagatcacgaggtcaggagatcgagaccatgctggctaacacagtgaaagcgtctctactaaaaatacaaaaattagccaggcgtggtggtgggcacctgtagtcctagctactcgggaggctgaggcaggagaatggcgtgaacccgggaggtggagcttgcagtgagctgagatcgtgccactgcactccagcttgggtgacagagcaagactccatatcaaaaaataaataaataagaaaattaagcaaatgcaaatgggagagaattaatagattaatagctacaaaacaaaatgtcgtccaacagatgtcaactgtgtggcttaggtagaagtagcagtaattcgtcctgaattaaatatctgtttaaccaaaattatggtagttctgtggtgagaagttgaggagctaaattctaaacaaacaattaagaatggaaaacaattgcccctagggaagaagaatggggaggcaagagccagaagaatacataaaccttggatttatatgacttttaaaattatagacagtacatttatgtctttgatgttattaaaattttatatcagcagcctggcatggtggctcatgcctgtaatcccagcacttcgggaggccaaggtggccagattacttgcagtcaggagttcaagaccggcctggccaacatggtgaaatcctgtctctactaaaaatacaaaaattagccaggtgtggtgatgggcgtctgtagtcccagctacttgggagagtgaggcacgagaatcacttgaacccgggaagcggaggttgcaatgagccaagatcgtgccattgcactccatcctgggtgacagagcaagactgtatcaaaagaaaaaaaaaattatataagctgttctgcctgctcttcctttcaaatgtgggaaaatgtgctggccttgtaataaacataagatggaaggcaatcccctattctctctgatggccttatttttcatatatttttctttttttttttttgagacggagtttcgctctgttgcctaggctggaatgcagtggcatgatctcagctcaccgcaacctctgtctcctaggttgaagcaattctcatgccttagcctcccaagtagctgggattacaggcacgtgccaccttgtccggctaatttttgtattatttatttatttttttgagaccgagtttcgctcttgttgtcccggctggagtgcagtggcgtgatctcggctcaccacaacctctgcctcccaggttcaggcaattcttctgcctcagcctcccgagtagctgggattacaggcatgcgccaccacgcccggctaattttgtatttttagtagagacagggtttcaccatgttggtcaggctggtctcgaactcccgacctcaggtgatccgcccacctcagcctcccaaagtgctgggattacaggcgtgagccaccatgccaggcctaatttttgtatttttagtagagacggggtttcaccatgttggccaggctggtgtcgaactcctgacctcaggtgatccgcccatgtcggcctcccaaagtgctgggattacaggcaagagccactgcgcctggccttttccgtacatttcttatagtgtaggcctatttctataaacaacgtgattccaaggctgaaggataaaaacatgaccattaaactcatggtaacttcttgatacagtgatcaacaaaagaaacatgatttgtttgagtgtcaaagacaaacaatttacacttttttttttttcttgagaggggatgtcactctgttgctcaggttggagtgcagtggcaaaatcatggctcaatgcagcctcaacctcctgggctgaagtagtcgtcttccctcagtctttcccatagctgagattataggcatatgccaccatgcctggccaatttttctattttttgtagagacagggtctcactttgtttcctaggctggtcttgaactcctgagctcaagcgatcctcctgccttggcctcccaaagtgctgggattgcaggcgtgagccaccacatctgcccttttatttttttaaatggtttacatttattaagagtatgcaatgtagggctttttaaaaggcaatttatagaagtcatttttatcttacaggtggatttaatcattcattgccattccataataccaactatcaaaaggttaattattttctgatggtgaaagttttaattttaaaaaaatcaaattttagaattgttagagacctttagaacaattttgtgtagtcctttcatctttcagaagaatctgaagtctgtcatcatttaaaggatttacccaaagccatggagctgattagtggcagagtagagattgacttccatttcttttttaataaaaattatgaaacttcttaaaggtttcataattctgatacttaaaactaagattctaccaattcatattatgccaggagtcagaattagattttaataaaggagacattaaaaaaacaagaggcacattgtaacaaccagttaatctaggtaaaatatcactgagtagctttgcccaaattatgtttcattacaaggtactaaatgttagccaggtgtcgtggctcacagctgtaatcccagcaccttgggaggctgaggtgggaggatcgcttgagaccaggagtttgagaccagcctggacaacatagtgagaccgtgtctctacaaaaacttaaaaaattatctgggtgtggtggtgcatgcttgtagtcccaactactggagaggctgaggtgggaggactgcttgagcacaggagtttgaggctacagtaagccaagatcatgccaccgtactccagcctgggtaacagagtaagaccccatttcaaataaataaaaataaaaggtactagtgttaagcaaagcaaggattctctggtagaatacattcaagaaatgctctacataataactccctcttaaggggggatcacagtgtacattaccataaagggatttgagaagcctaaggaaagaaaaccttgtttaatccaaaatgctcttggagaagctattttgtggaacagaatttggtcaaacatggcataacaagtaattcagcaacatcttgtaagcaaaaattgaaaatatctattttcctaatactcaggcacagatatatttaatagctcataaaaatttgtcacttaatatttgtcaccttaatatctttattttcccacgaacaaaaggcttgtgcatcatgatgactgcttggataggacattgtatcccctccttatcaagaagcattggctatggaccagaaaatgttttgtttgtaaaatgtatacagccaggtgagtgataatgtattttttttttttctctgagaaatggcagttttgacttttggtattttgttttccactttggatctaagaatatttgtactttaggttataaatatgaagtatcatctagtagggaagtgccagaaaatcaatttagtgagttaaaactaacattcttaaatagtcaggaaatattatatgtacacaagtccagggataggtcaaatttcaggcttgtaaaatgtatacagctaggtgaataaaaataaaagtcactagtgttaagcaaagcaaagaattctctgatagaatacattcaagaaaagctctgtacaataactccctgttagagggtcacagtgcacattaccataaagggatttgggaagtctaaccaaagaaaaccttgtttaatccaaaatgctcgagagccatgttctttctgcctcttgtccacatagtttacataatcagcttcatcaataaaacttcatcaataaaaccacagtacatcacatgaagttaaaatatagttttataaaatttttactttatgtgattctacatgtttagattataaggcatttcttactgtgggtcagtaaaaaaaaaatttgttgcttttggaggctgaggtgggaggatcgcttgaggcctggagaccagcctggacaacacagcagtaactataaaaaacatataaaaaaaatctgaaagccactcagaggaaaggaaatttagtacaggttgagcattccaaatttcaagatcagaaatccaaaacctgaaagtgtttgagtggcaacatctgatgctcaaatgatcattggagcattttggatttcaaattctcagtgggatgctcaaccggcaaatatatgcataatatatttaaaaatctgaaaaaaatctgcaatttgaaatacttctttttgatcccaagcatttcagataaaggatactcaacttgtatcttcagtttgttttcgccaccccaccacaatattcttttctgaaagatcaataggaaaacatgataaatcaaagtgaaaataatgttaaaagcaaacattccatgagatgcagaattcaaacataccatacaatagcatcttcatgccattcaacattttggttgaataatgttgcccatattgctatttgtatatactttataacataatcttgagttataggtaaaaagagttatatagttttcaaattaaccagtactcatttatcagttaagaaggtatattaagcaaaagtctatcagatttgtagcatctaattttgccatggtttttcaagatggtctgttagaagaaaatgactatattcgtacttggaggataggtatgtcgtggcaaatgtgtgatgctttcaaatagatttatattcttcctttaagggtaagtattacagagaaacagcattctgcagtgtttcttaatgttagatgccctttcgctttgtagagagagtattggtggtgatgtatttgtatctatgtatacaaaattaagggattattatgcattaataacagactgataaggaaatagaatgttatatttacatattgctacaggtcataaagcatgttaagtatggcaaatttgattgtaatgatgtacttctttttttaaaaactacagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatcacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggtaaagatccttcaaataactgtaatggaaactagggagaatgaattatttacaaataagacaaaattaatagctttgggattatttattttttgagacaaaatctcgctcttgttgcccaggctggaatacaatggcgcaatctcagctcactgcagcctccgcctcccggattcaagtgattctcctgccacagcctcctgagtagctgggattgcaggcacctggcaccatgcctggctaatttttgtatttttagtagagacggggtttcaccatgttggccaggctggtctcaaactcctaacctcaggcgatccacccgcctaagcctcccaaaattttgggatcacaggcgtgagccaccgcgcccggctgctttgggggaatttaatcttagtgtgctgtttagtaatgttaggttttgttttggaggaaactaggcatacaagacatgttaataagactatgtgaataatgaatttaaaaagatcttgagtatatactcataactccagaaataacattaacttgaagctttatttcttgacaaaagctttatgaatgttatgagtttaaaatatgtcaatttaatactatgatttaaaaaacaatagcagatttcgtatgactgtggggacatggaaaaatcaagatcctattgattgctagctctggctcacttattctccggtaatgatactattggatatataccaaaattatataagcaaaaagaaaaaaaataagttttcctggcccaggtcttccattcttctggtccccttactatagtaattctagttactctcatcttattctgaggaaaaaaaaaaaaaccaaaactttttaaacttattttttgacatagggtcttactgtgtcacccaggctggagtacagtggcgtgatcttggctcactggagccctgacctccctaggctcaggtgatcctcccacctcagcctaccgagtagctgagacatggtggcacaggccaccatggcgggctaatttttttatttcttgtagatacagggtttcactatgttgcgcagaatagtctcgaactcctgacctcaagtgatccatccgccttggcctcccagagtgctgcgattacaggcatgaaccacagcgcccagcaaaataaactttctttattttcaggtctagaccatcagatagatttactcaaatattttctgggaacctttatgggtagaacatttaatactgtttagaagacttttaggaatactatagatttcaaatgcatcatttaaaataaataaattccactttctctctcctaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcactatagagaacttaagaggctggcttatgttatacctaaatttttactttcttgtatacaacaatgctaaaattgagcagattgataactgccagcaaaccatagatttaagataaatgaatgatttacccaaccctaaaattccatgggtaaaaattttgattcctttattttcaatactgcgttccttataggtcttacatgcatatgcaaggatattttatcttattcattcatttcatactctcaaaacaccaaacttcaaaaagttaattattgtcataatgcattattccatgtgtggtgtcaatacattttagcggacaaagaagaaacatgccagttaaaacatttctgctactgggattctttattaattatttgagaatgttattttgctagttcttaaggttaagtttttcatcaaagactcaggtacctattattgttccctggtgaaactgaggagaaaagttaatcaaccaggttactcccacagtttgcccgtgtgttatgtatcagttatacaggtatcccaccaagttcaagtcaaaagaaattcctaactttgtatatttctggagctataaaacccctgatttaagacagcttttctcttttttcgaggcagcttttctttatgcttatttcaatcaaatgtaacacgcctgtcaaattacatgtaacacattagctaatgaagataggcaactgaaaatgttgtcatgaacatgtcaacctgcttggtagttgaatttgacttttatataatagtggatacacatgcacagaagttactagagaagcaatagctatttctttaaacattcttcaggcatcagtaccatttaaggacaattagacattctagttttactaggagaaaggtcagtcatctctaacattgtgttgcagaattacacgacacaaacataaacacatttctgcctattaaaccagtttctttgtttctaaagagtttaatgatacaggtttgctatttccattagagcatcctttttctggccaatcggacaaaatagagttagcaaagccctcacagcaccctatgaaaaatctctgctcttatacaggattagatgcagacctcatcttgacctaacatctgtaaccaggtaagtgtatgagtaggaacacagacagcagtactgtatcagcaaaatctatcatattatttgaaatcactggatataatattaattataaagtgtatggttctctccagttgttcacataccaaatcccagtcagttctcagattcagatagatgtatctgcaatttctccaagcagctaagaaaaccttcaatggtcagttctgcttggtcatggtatgactcttttttttttttttttttttttttgagatggagtcttgctctgtctcccaggctggagtgcagtggggcaatctcagctcactgcaacctctgcctcccgggttcaagcaattctcctgcctcagcctcccgaggagctgggattacaggcacgtgccactgcgcccggctgatgtatgactcttttatccagtaatcaaaacacatacgtacatacacacacataccagcccaaaagaggtgttaaaacatacatattacacgtactttttggaggggtggggtggggtgggatggggtgggggttatctatctcaaaattaccttttggtgccttgtcaagctgtggagttttgaccacacacacaaattgagccaatgaacaatttcaatgatcctgaaagttcttaagtcttatgaataattatcaagagttctgagaagttatctgtaaatcagcctatgacaccatttcttgagagttatgattaaagaaacagcaattatgcttgaagcgaacatacatcaactagttagagcaaggtcagcctgtacaagctgacataaattatgagaatgatgctctatctctagaattggaatattctgtggcttctttgtaaaactatagatctggtgggtcatgggaagaaagggagggtgaacaaaagataaatattacctttattttttatcatcttgagcttactgtttagttaccccgtttcccaaaacagcacaacctctgtgaccagttaactaagaaattatttccttggcagcaaacccagaattccatcacttactcttgtaaatagcaagaaagtaatttactagcagagtttgatagaaaaattctttaatgaaaacaagtttacacgttgaacttatggcttaactagaataaatctaagtaagttaaaactgtataaggaccaaacagataatgactggtatatatgcaggttctctcaaaacggtgattcctagttccattataagacctctttaaaagcaaaaatgcaattctgtagatgaaaacagttatctcagagggtcaaccacacaatgtcatacagagacgctggtcttaagccatttttttccatattcatataatttcaaaacatgagaagtatcctacttgctgagaagtgccaaatgaccctaatattcaaaatatcttagaaatgctatcctttagttaacatacccttaaattttgtaacattgattttaccct

SEQ ID NO: 15365 - DNA, 65561 bp, Human
aggtagtgaggaaatgagaaatttaggttcttctccagggttggggcctgaaaagagatgggcagcgatgccgtttcctggaaaactgggagaggaaatgtttgggatgagggcagtgagatataatgaaggtcaagttttttttttgtttttttttttttttttttgagacggagtcgtgctcagtcgcccaggctggagtgcagtggcgcgatctcggcttaccgcaagctccgcctcccgggttcacgccattctcctgcctcagcctcccaagtagctgggactacaggagcccgccaccacgctcggctaatttttttgtatttttagtagagacggggtttcaccgtgttagccaggatggtctcgatcttctgacctcgtgatccgcccatctcggcctcccaaagtgctgggattacaggcgtgagccaccgcgccggccgaaggtcaagtttcagtggtgctaggaaaagaagatagtgagcaaaaatgttaatttttgtttcctcctcttaatatttggagaaaacgtctgcttccttttgttatattggaaatctccatgacttccaaatacagaatattttacaatttttccctatcccaaagttcagcgaatatgttgatttatttgagggagaggacatgaaagggaagccacctaggcacaattttctgctcaggccctaccagattagtttttgttatcaaaaaaaaaaaaaaaagtgccattccttgggccaagctatgtgctcagcactttccctccatttttgatttaatcttcacaacaaccttaagatgaacgttcttttctacttcccagttctcttgattaacttggctaccccactatatggatcaatttgcagggtcctaggtccctttgaaaatctgatgaaagttataaaccttacctgggaaaaaagtacaaacacccgcaagaacttgaaataggagttcactggccctcaactttctgagcttactatttcacaaacctgcctattcttgaattctgagctggaggtcatgattctctcttatgtactttaagatgatgcactcttccgaagtttttgattgaactctagtggctaactgaattgactttttcagatcactaaaaagcttctccttgaaaaatactcagaagatgcaacacacacacacacacgtgtgtgcacttacacacgcggacaccgtctcacatcatcagtgggaaaagtgatagaatcttgctaaaggctgatcataccatattaatccgattcgccagaactactttcttcactgagctctcaggtatgctcgggtcttcctttaaagaaaataaatgtcaacgctacactctatcctactcccattttcctcctcaccccatttccactctcccttaaagagatgtgtgcacacaatcactgcccaatgcaagaatgcaccactgcatccaatgcttggaaattgtccgtgaagatgcctttgagtagctgtctatttgaggatttgtggctaattcctccccatttgtttccttagcctgctcccaaccaggtgtctccagaactttttctctccgccaccaactccgcctccagacagaccgcaggtgctttctgtcatagggactggcgtgccgcggacagtgtgacaaagaaactgtatgatggatatgagaacttcgtaagacccagcagcaaacggggagcggctggcgagcgctccacagcccccaagcgtgggagctctagatcggaatttgtaatttggaattggaacgtgagcgccggaacagctctcccagcaaccacctctcccagcaaccacctcagctggcgcgcggaaaacccggaaagtggatttcgcccccgctccctcccggaaactcctcctggtgcctgcgaccgttctcactgagcatgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggtgggtgaggcctgacgagccctctgatgcactgttggaaggggaagtcgtccctatccgggggagctgatcctcgggtgggagcgagggaagggggcgtagcagcgggtggggttgagtttccccagaagcttttggggtctgctgggctgtgggtggggggctctgaaacagcccttgcaagggtagtttctggaggacgcagtgggcctcagactcgcctcccgtcttgcgggccaagtggcacgagcagctgtattcagttttcctggaacagggaccgtgtggagcgcccttggagttgggcttcacgcctcagagctttggagttggatgtatgcaggtccacgcgtgagtgttcgctcacagccctgtaacatgtacgctgaggaagcgggtgaccgactccctacatgtgagcaacactcagcctagttaacagtttccattagcttttaacttcattgcttcctgtttaattgcattttcctggaaccttctagttggttaggagagcttgttctttctaggactttgatatctcgcttcacaattagaagttggttccttatttgtggagtataacacccagagccacacaaagtgcattaataaagagttgctgtaatggttgaggcacttgatttctgagttttaagtgtaaaagattttaatacacaaaaaaagatacgaggtctcactattttctctgagatggttttaaacacttaaaaggggcaaatggtgggagaaactggtgttttcctagggcaagtcttgaaaactttgatctcttacaacattcacactcaaggttttcagtttaattgctagtaaaagaggcgtaaataaagtaacctgcttttaggttatatggtgtagggctttacagtatacatacacaattatttcgttaagtttatttaaaacttaacatttgggggatgaggatctctttgaaacctttaatgatttcaacaattcaaataatcgttcaacaaacgtttacaatctataaataggcttatttattaagtttgattttcttaagctggtgtttattacagttagctttactatagctgtgaattttgaggttattttagggcattagataagctttaaatttttcataacattttgcagtttctttttaggttgtcagctatcttgaatgacatgtttatacatctgtgcaaaaccttgtatctgaaaaaatatctaaggatatttaaggtttactcaagtctgcagttagtgtttcagtacttaagttcatactctgcagtgcaagaagctttcactcctttttgaggattctgactgaaagactgttgttgtgcttccaagtggaagatctagacttgcaagtacactggtttttccattaaatattttagtaaccaacctttaaggcctagtgtttggtcttactttaacagcagttgtatattctattcctagtgcctcaaagatgaaaaatatatttcctgccctctgggaacctcaaagtaagggacataagcttatgaacagattattgaaatctgatctgttacacaggatgatgtccaaagtgtgctaaaacaaaatgaggaaacatcagtggactagagtctttagggaaagctctatagaagaagtgacagggccaggtgtggtggctcacgcctgtaatcccaacacattgggaggccgaggcgggtggatcacctgaagtcaggagtttaagaccagcctggccaatatggtgaaaccgcgtctctactaaaaatacaaaaattagctgggcgtggtggcgggcatctgtaatcccagctactcgggaggctgaggcaggaagaatcgcttgaactctggaggtggaggttgcagtgagctgagatcgcgccattgcactccagcctgggcaacagagcgagactttgtctcaaaaaaaaaaaaaaaaaaaaaaagaagaagaagtgacatttgagatggacttagaaaatgaataagtgaaacttataggtggtcttccagttagatgattgttttctcaacaggtcctttggtaagtggctaggttgtattctagttattttttagttaatcttgggagtcattttggatgtttaattttcataggtatagggataaaacaggcagagcagatcatttttccgaaatgtttggatttttatctttattgccagctacactcacatctggttaatggaaacaactcttagaagagcaggagggtgtactttcagcttttttcctgcgatatgactaactggtgtagagaatttgaaatacactttaatatttattttctttgcctttcaaagaagatgctataaataacagtaaacagttgaaatttgtattacttcaatcaggatgttaataatttattctcatctatttcgtatttgttaaggaggacagtcttgtacacattattcagaaaagtggaaggaacttcttttaaaaattagaaatgagagttgtgaaatggaaataattttttccaaaagatgctgttaagttagtgaatctgaagttggagaaattgggcaggtcattgatactgttaccaacagtttttccatctgtaaaatagggataatcatatttgattatgacatattccccttgaaaggtattttgcatttcttagaggaaaagtgcaatatttgtcattgttgtgatagtgtagagatgaaacaaatatatcttcaacttatatataatttaggtagtagagtgtttttatgtactgtaaagtttgtctcatgcatttagctcaggatgtaaattgagagagaatcagaagaatgctgaggatttagtaattttctctctttaaaaattatcttatgttgaatttactggcagagaaacaggagtccagtgaatataaaattctatttatattgctgtaacttctgattaattttcttagccttcatagatactgtgagtatgttttcatggcctcctttttttaacttattttacatgtgcgtgcatttggatattgaggaggtgcacattcttattgctttttatagccgatactatttcattctgttcctgtacaatctgtggtttgcctgaccattcttacttgtagggcctttagattgggcccaatttttctctattatgaatagctttgctacagtgtatttagcagtaattatttgcatatccccaaatataaaattctaggtaaagacaagaagaagtttttagttctgtttagtattgccagatttctttcaacaatgataggtttgatttcctttaactaaataataccttgtgttgccacatcattttaatttttatttatcaatttaatagtgatgtgatggtccctaagacttttttttttttttttttgagacggagttttgctcttatcacccaggccggagtgcagtggcacgatcttggctcactgtaacctccacctcctgagtttaagcaattatcctgcctcagccccctgagtagctgggattacaggcgcctgccaccatgcccggctaatttttgtatttttagtagagatggggtttcaccacgttggccaggcttgtctcgaactcctgagctctcaggtgattcacccacttcagcctcccaaagtgttgggattgtaggcgtgagccaccacgcccagcctgtacactttttaaatgttttactttcattgctattgaaatttctgtgtcttttaatatttttcttttatttgccttattttgttacgttttgaaaccatagtaataaaagattgagctatggtattcctttcctgtagaattcactttactttcttaaaatcaagggacactgtgtgactgaaataagtagaataaagccctgattataagtgactagatattccaggataaaatccacagttctaatttagtttgtaaaagttttgactatttcagttagctttgtgctttttagctttaaatcaaatcttagtgtgccgagtggcattctgatggctaagaggtgaagattagtgagcagttcacctttgctgctttcaactttcaagtaattactgggttgtcaaccagaattcagaactaagaactaaaaatagtattaattctccaaaatgtctgccacttttttactgtttgatggatagatcacgttcttagatgaaagattaagattttttttcctttgctgtaaggaaaaatgaccaattataccccctagtggttaaaaacaatgtttaaatgaattagtttaacaactttttaataaaaaggaaaattactcagtcatactttcctttcttggtagttatttttagaagcattttataagttgtgtttgttattctgggagcagttgtgtataaatattggaatgagtcagctttaagaaaatagtcctgaatgttgatctgaacggacacagaatgaatatatatgtacctgttttaatttgaccatagaagtagtttgaagattttgaaatacttaaagaaaaaaaatctgtatgtgtatttattggtatagtgataaatatttatcgatatgtagtttcacattctcacagttctctctggaataagagcattgattcttagcttctgggaactcattagtgtttgggtgttgctctttcaaatctgaaatctggcactggaaggacttactttgactatggtaaatatacattccagcaattgtttcttcttcttctgaaaaggtatgttaaactgagatagtttgcctttcagaaattagatttttaagtaaaattaagactgtaattgttcattatagtgaatctgagagttagaatcaagaaagcaacaaaagtctatgaataaaattgtgtctttctgcctgtggcccctcaccaaagtgggtgtaaacttgaacttccaaaggtgtaaactggaacgtctgaaacaaatcacagatatatgttccacacctcacacccccaacacaaacacacagacacacatcggcactacagagattggtctgtgcactgtcagccttagagcccagctgcccaaacccttacttccctattctctcctgtagcttcctgtcaccatggtctctcagtaagttttgtagttaattttagctgctttacatgtatccaacaatttcattctattttcattaaaattaactatctatgaaaggctttggaggaaatttgtgaattttttctctttttgctcctcttctcacttttcaaacctgtttattgccctttgctaataataatggtaaagactacgatttgtgtgtgttgtatatgccttagctaaatttcataacatctctgtgatatttagatgaggaaacagaagctcaataagatttagtagctgtctcaagtgtacaaagctagtaagtattaaagccagaatgcaaacaagcccaagactgagtccaaaaagcctaggctcttcgccactgccttctactctgagcactcttcttcttgtttgcctttcccctggggatccctgaccgcttatcaccctggactttgacagttccagaaaacactctgtatctattatatgtaattttcattttattttattttttagaaacagtcttgctctgtcacccaggctagagtgcagtggtgcagtcataactcattgcagctttgatgtgtctatgtaatttttaagtagtcaggttttatatttacttctttcgttgatatagtctaaaattgaaattgtatttttcagggctttggggaaagaaccctggtaattatctaggagatcagttgctgggcattgctgatcggataactcagagctcataaataagcatttgtgagtcccagcattgcttttgagacttttattgtgcctgagttaagacttcccttcttcaggaaggcgccactgtggactgctctaatattaaggagttgaagcttccatagatttccttttttatggcctccatatctcaaacccttttgtgacttgtcatttgccatgacccttgtacagtcacatctcttcactgaaatttctttctcccttgaaaatccagttgtaagtgtggggtgggacagatgtgatgatagcagaataaggtgggaataaaagcagaaacgaactaggaaatgggaaaaagtgtagtcctgtggcatggcccgtgtgccttgttaaaacaaaaaaatagactagttgtgaccatagctgggatcaggtatggaactggcagattaggactagaaataaaattgtacatttaggagagaaatttaaaaggaagactgtagagttctaaataaaaccacttctataaaacatttcatagtacaggattgtaatcagtcttgctttctctaagtgacataggattctgcaacttccttaaaatgtttcatgttgtcaaaattttgcatgcttgaaataacctaggtggggacagtttgaaagtgggaatgtgaagcaagtaaaccttgaagttctttctagtcacatcagtgataatctagagtcgtctgtctctatttaaggcaaatttctgggaggagatggacttaactcttttggatggtgaataaagatgtttagagtgggaaaaaaaaggcaaacaaaacacacacacacacacacacacacacacacacacacacacaccaccccagagattcagtagctactccaagaacatataaataagtgctgtcattttttttttaatatatgctgtattaggctgttcttgtgttgctgtaaagaaatacctgagactgggtaatttataaagaaaagatgtttaattggcccacagttctgcaggctgtacaagcatggcacggacatcgctcgacttctagtgggaacctcaggaaatttttactcatggcagaaggtgaagcaggagcaggcatgtcacatggtaaaagcaggagtgaaagagttttctgttgagcgagatgccacactttacaacaagcagatctcacaaggactcactcaccatcatgagggcagcaccaagggagtggtgccaacccattcattagacatctacccccatgatctagtcacctcccaccaggccctacctccagcattagggattacagcttgacataagatttgagtggggaaaaatactcaaatctcatgtccttcttatattgcaaaatacaatcatgccttcctaatagtctcccaaaatcttaactgactgcagcattaattcaaaagtcccaagcccaagtctcatttgagacaaggaaagtcccttctacctatgagcctgtaaaataaaaaagcaaaaacaagttacttacttccaagacacaaaggggctataggcattgggtaaatattcccaggccttgggcagctccaccattgtagctttacaaggttcaacccccacagctgttctcacaggttgttcagtgcctgtagcttttccaggcacagggtgtaagctgccaatgaatctactattctggagtctggaggacaatgtcccccttctcacagctccactaggcagtaccctggcggggactctgaatggggctccaacaccacatttcccctccacactgccctactaaaggtgctttgtgggggctccatccctgcagcaggcttctacctgggcacccaggttttctcatcctctgaaatctaggcagaggctgccaagcattcttcgctcttgaactctgtgtgcctgcaggcttaacaccacatggaagccaccaagacttacggcttgcattctgtaaatggcagcccaagctgtacctcagcctctttgagccatggctggagctggagtggcctgaatgctgggatcccaaggctgcacagggcagtggggccctgggtctgacctataaacccattcagtcctcctgggcctctgggcctgtggtgggaggggctgctgcaaaggtctctgaaatacctttgaagccttttccccgtagtcttggatattagcacttggctcccttttagttatgcagatatctgtagcatgcggttgccccacagcctgcttgaatttctctccagaaaaaactttttttttctttgccacatggttaggctgcaaattttctgaatgtttgtgctctgcttcctgtttaaatataaattccagctttaaatcatttatttgacccttcagctaagataggctgttagaagcagccaggttacctcttgaatactttgctgcttaaaaatttcttctaccatatatactaggttgtcactctttagtgcagagttccacagatccctagggcatgaatagaatgcaagtcaagctctttgctgagacgtaacacgtgtgacctttgcacaagttcccagtaaccttctcatttccatctcagacctcagcagcctgactttactgtccatatcactatcaatgttttggtcacaaccatttaaacagtctcttaagaagttccaaactttgcctcatcttcctatcttcttctgagccctccaaactctgcctgtttcccagttccaaaaccagttccacattttcaggtatctttataacaacaccccatcctcggcaccaattttctttgttaggctcttcttgcattgctataaagaaatacctgagactgggtaatttataaagaaaagaggtttaattggctcacgattctgcaggctgtacaagcatgcaccgacatcactctgcttctggggaggcctcaggaagcttttactcatggcaggagatgaagcaggagcaggcgtgtcatatggttacacaggagcaagagagagtgggggcaggtgccacactttacaaacaaccagatctcacaagaactcattatcaggaggacagcaccaagagagatggtgctaaaccattcattagaaattcaccctcatgatccagtcacctcccagcaagctccacctccaacactggagaatacaatttgacatgagatttagacaaggacatatattcaaacacatgcgttgtgtttccatctggattataaattctttgaaggcaagtgttcatgaatttgtattattttgtcatccaaaatgtctagtataggactttgtgggcattaaatacatgtattggctgattgagtttctcgtggtcttcaggatctgttgttgtaaatgttctttggttttcaaatatattgcaaattctactatttttttcctatttaataaattggcttctcctgagatcatcgttcctgctcctggaacacttttccaccctaaattttactttttaaatctttcttattgtttttgtttgccttctgttgctttacagtgagactaaggtctactctcaacttcaaagccctttttctggcttttaattgtgacagttttcaaaattcaaaaagttgaaagagtagtgtaatgatcacctttcactcacctagaccacctagaatcaacagttgtttacattttttcatacttgtcttatttgtgtgtatttatgttttataggggtgaatgtcatgacatctgtggcatactttcacatggttcagcttgaagctctttattgaactatataaactccccggcagtctcatttcctttcttccaatttttaacaattgttccactgacatattaggaggatctcattcttatgacacttttgaaatttctttgtcttgctgcaagagttgatatttagagttattgcaaatgtagcatatttacaaatatattgtaaatggctgtattctatattctgtgttaaggttgactttaattttaattgacttcacattcctcagcatgtgtgagatggtaattcttgaaatttcagatcctcacaatttagaaaaggaagaataaaagtgctgtgaaagctaagatgaactgaatattcaagctgtgtttgattactttgctgaacatcaaaaataggtccataatttagtgttgatatctatgatagactttcttacaaaagtagtgtggaaaggtgtcagaagagacaagaaggaagaaaagtagaggaataaaagcatcagaaataaaaagttacggtagcaacagttgagtttacctactttgtttctgcagtccagctttttaacttgtttcctcgtgttaaagaagcaaggaatccctagttcatgaggctactatcagaattgtgcgtgatagttattatcttccttttccctagactagtggccaggacaagtataatggataggcattaataaggttcagaaggctgactgtcttagtgtcctttaaaaacactggaatagcctagttgcactacttggatggatgggagacgagaggaaggaagagcctttcacagaaacccttatgctgataaacctttattcagactcaggaatggcagtttctttaagataatagattacagctgctatgtttattatttgttatagttattgtgtgccaattatggaccagcttctgcgtgtactgttttctattttattatgatatcattcagttcccacattcaaaattattacttgcccaagagcacttaataaaagtagacctaggatttgaagtgaacccagcattctgatgatacattctttctaaggagaattggaagctgcttcatcagatcaggaagggttgacaaataaggtacatttaatgggtattagatattagatgaaatgccaaacgtagatggataaaaactaataacatgtagataagaaaatgagggaggaaagggtgtgaaaaccccccgtgggctatgtactgaaatggaataagagtgatagtaattggtttaaatgacaccaagttttataaacagaagattaacatggtttctggaaaagaagttttcctggtctctagagttactggaagatttgctgtagttttagaaggagccaatgagtttgatttctaaagttttgacaacattgttttttaaaggttaaaatggaatttaaaggaagtgtggcttgggttggcttaagggctgagtgaggtggagtgagagaaatccatggggagtgctgacagtggagatttccaggactggtgcttgaggctaatttgggttttaaatttagaaaagagaatgcacatgaaatactttaatttgctagtggtacaaatctctgtatgtagcataatgtaaagctaatgaaaatatattttcagaagctctcttcaagttatatgagacagcaaaaagtaaattaatttgctcaaggacaaattgagaaagtatatctgaagagaaacagttaccatgtttttgagatgatgagctccaagctgtcagtttagaacataggaaggaaataaagaactgtccatgaagaatttaagcttctgggtagaaaggctaatgaaagtaacagtgttattctatacttacatgaaactttaacatgtaaatcttaaactttgctgtaattctctatgacatgccttttaagaaggatatgagaatagggcaaggtcctgagaagagcagctggcatgatcaaggagataggtgattcagaagattgagactcaaaggagataggagagagtgcagaaatgagaataatgttttccctcaatcttagactcttagagccaaaagttgtcccatgaaacttcagagaggacatcataagctaagcaaaaatttgtattacttcatcaattgggtagaaatgggagaaacatttaccctaaatttatatgccctgagacagtgtcctaaaatttttcacatggcctcaggctttcaaactttatgccttgtgttcgaccctctgagatttgaattcaaataatagtgaaaaatacctggaaaacagtgctgaaggaagtactagaattctaatccagcttactgcttgtttttatagggccttcaggctaagaattatttttacatttttaagtggttggagaaaacaaatcaaaagaaggataatatttagggatgagtgaaaattacatgagaataaaatatcagtgccgtaagtgaaagttttattgggctacagccatgctcacttgtggatgtagtgtctacggctgcttttgcactacggcagtggcagagacccaatgtcctgtaaagcctaagacattactctctggccctttacaggaaaagtttgccagcctcttggatagactaataaaattagcgtcatttttccaggaaaagaaaagattgtagtggctagaggaaaaatgttaaatagatgaagaaacactgtatacagtcatgaaccgcataacgttttggtcaacgacagaccagtggccttataagatgataatggagctaaaaattcctattgcctagtgacatcatagccattgtaacatcacagtgtaattaccttatttttaaaaaatttagcatagcctaagtttacagtgtgtaagtctacagttgtgtacagtagtgtcctaggccttcacattcattcaccgctcactcacccagagcagcttccagccttgcaagttctattcatggtaagtgccctatgcaggtgtaacattttctccttttagactgcattttgattgtacctattctatgtttagatgtgtttagctacacaaataccattgtgttaacagttgcccacagtatttagtacaatcccatgttgtttaagtatgtgatggaccacaccatatatatacccccaggtgtgtagtaggctacaccatctagatttgtgtgggtatgctctgtgatagtcccacaacaaaatcccctaataacacgtttctccaaacacatccctgtcgttaagtgacacatggccgtaaatggtgctgagcatcatgctgttctttcccgtgctgttctttctgtttctggtctaacacagaggccgttagcctcctgggactatttacatttaattaaatacaacttaaaattcagttcttcagctacattgactgcattccaagtgcccaatagccacatgtggctggtggccaccatatttgaagaacatttccatcattgcttaaaactctgctggacatggctatgtaatagtaaatacggtactttatgccaggtgctgctcttgaatcttctcaaaaacttcttgaagtagggattattatcacttctgttctacagatcagaacgttgaggaacagggaagtgaagaaacttgcctagaatcacacaactagtgtcagaggcaggatttaaacccacacagcctagcttcagagtcttgcttcttaatcatttcgtgctgagaaaggttgagagtgaggaatacgcttaattgtagcaagagggacatggcttatgtgttgacagtgctgtacagattttgaaaaacaaaacatagaaaagttgtgtagagtataatagctgcattccttcctagaaggaaatcgagagataggaactggactagtattttggagacccttcagtcttctttatgttaaatggatcatttgaattctgacatatcttcatagcagtgttgaccctttctaattagtggaaattattttggcaaaggaagccattaaatgggaattttgtcttcacaacggttgtatgtatttgtgttaattcaagcatgctgtattgctacaatatcatgtcctattaccttgttagctgtgttgaagtctgtgttgctgttgcattataatttcacttgagtagaggtgtaggggccacatatgatgctgttgtcggtattacatgcaaaggctaatgccctctgttgtatagcatgaatattgggtgagcattttagtggatgaacacttccctcttctgaatattactaaatttatttggttttattttaacaaatgcatagcatttcatgtgtcaggcactatttggagtactttgtaaacgttaacttatttaatctccctatccctatgagaaatactggtttttttttttttttttgaaacggagtctcgctctgttgcccaggctggagtgtagtggtgtgatcttggctcactgcaacctctgcctccagggttcaagcaattctcctgccccagcctccccagtagctgggattacaggtatgtgccaatacgcccggctaattttgtatttttagtagaaacggggtttcgccatgttgaccaggctggtctcaatctcctgacctcaggtgatccgcccgccttggcctcccaaagtgctggggttacaggcatgagccactgtgcccagccgagaaatactgttatcctcattttgcagttaaggaaactgaagcacccatgaagcacatttgacccatgtggtcaaatgtttaataatttgaccacagtcacacagttagacaagtgatggcaccgggatttgaacccaggcagtttgaccacagaacctgtaatcttgcctgctgtgttttgctgcctttctggtggcagtggactattgatttgttttgattgtacaccaaccgtctcgtcttgctttgggggatgttagcaagtgtagaggactgttgacagcactagtaagtgaaatcaaaatgacaagtgtggctccgtggcactcccagaagcctcatgactagtccaaaggcagtgtacagctctaactctataaaataaatacttgtcccagctgaacagctcttaatcattttttgattagcaccaaaggtacttcagggcacacgtgacttgctggcttcttcagctagtaaattctgtcatgagtagcctgagctccttttttgagagggtgggtcagtgttatgggtcctgtaggacttcagctacacctgggagaaattttggaagcttcagtaggaaagtgtagcttaaaattagcctatatttcccaggaagttgatacagcttatctccctctaccctgttgttgagcttgatctggtcattgccaccttcttcactgctactaccttgtagttcagtgttcttaaattgatggaagaggtccttcaaagttagaccatgtggtcattggctatccctgtgtgtttaagagtacatgtgcatggaattgtatttccagtatagttaatctagaaatttctaaccaacttggcagcatttcttggttgcttgctgtgaaaatgctaaaaaaatttgtttaaaaatttttgtgctgcagagtgtaataccaaatttggaaaccagatttttaaaaacagcatctatattaatatgataaatgcttttagttaaaatatcttattaattttttagaaaatttagaaagcatttaaaaactattggagacatttgcaactctgaaaattatttgtgtatttttaaaattaattatttaaaaaaattttaagacacagccttgctctgtcacccaggctggagtgcagtggcgccatcatagctcactgtaacttcaaactcctgggctcaagtgatcttcctgcctcagcctcacaagtagctaggaatacaggctcatgccattgtgcccagctaattttaaaaaattaaaaaaaaatttttgtaggaacggggtctcgctgtattgcccgggctagtcacaaactcctggcctcaagtgatctcccacctcagcctcctaaggggctggcattacaggtgtgagccaccattcctggccttactttggtatattttaaatgtatataaatccagtcagtgaatggatttgtaagagaattgtttaaagttgactggaattataacattttacatttcagacatgtcaaattcttttttaattctaagcatgacttaaggctttgtgtcctgttgtttatattctaattttgtgtttccttattttcaggccgaaatagaactatttgtgaacagacttgattcagtggaatcagttcttccttatgaatacacagcgtaagtttttcagcttggcttttatataaaattttatgtgactcatcagaattttgtacattgagaactttgttttctcacagttatggacaagcctgaaaatattttttaaggtgtactcttccaaggtgtggttaaaaatgtgatcttttttttaatgtttctttgtaatacaacagaagcactgactaaacaatggatttctttttttatctgactaaacaaaaagctattttgttttcttaacattttaaaattataaatagctccacatatttttaaacaaaatttttatgtcccacataatcagttcccagaaataactactttgatgtctacctccacattttttctctgaataaatagtctaatctatataatcacatttatacatttttgttttaaacagaagtagattcatagtatttatttttatttttatttttttgagacagagtctcactgtattgcccaggctcaagtacagtggcgcaatcttggcttgctgcaacctctgcctcccgcgttcaggcgaatctcctgcctcagcctcgcaagtagctgggattatagatgcatgccaccacgtctggctaagttttgtatttttagtagagatgggtttcaccatgttagccaggctggtctcaaactcctgggctcaaatgattcacccaccttggcctcccaaagtgatgggattacaggcgtgagccactgcacctggcccatactattatttttgattggcaccttgtttttctcattgaatacattgtgggcatctttccatgtcaatacatagctacctcactctttttagtagctgttattatttccattttagaaattgtatagattccatgtacacttactttcactagtttcctatttaccaacatttgattatttccaggttctttgtttgcttttgagacaaggtcttgctctgttgcccaggctggagtgcagtggcacgatcatggctcactgcagccacaacatcctgggcttaggtgatcctctcatctcagcctcctgaatagctgggactacaggcgtgtgcaaccatgcccagctaatttttttttttttttttttttaattttttgtggtgatggagtaccactctgttgtccaggctgtccttaaactcttgggttcaagtgatccttacaccttggcctcccaaggtgctgggattacaggcatgagccattgtgcctggcccagttttttgatattgtgaaaaacgctgcatgaatatcctttattcatttgaccattgtataccatattgggtctaaaactgttgctaaaatttagtttaatttctcagctgtttaagagttttaaaagaaaatagtttgctgtagagaaaagtatacacaaaaaagttacgactatcctaaagaattcatatatctaagtatgtctaagaaaagaatacagaagacatgaatgggtagactataattcatctaattattggatacttaaatttttttctagtttttgttttgttaaacatctttaaatctttgtggatattcttaggaaaagtcagtggatctgtggagaatcttcatttgggaacttcccagccccagtttttttttttttttaatcaccagagacccaccttcctctttaggaatctcactaatctgttactattactgtactgatctcagatattccccatatcattccagagtgagcacagaactgccctttaattttctgtggcaaagctgaaattaagctgtaatgtttaaacagaactttattaaagttggttagtaatacaagggaattacaacacagggaatcttataggtgactgactacatcttctccacagcactcttcacagagggtctttttagccatgcttcacatattgggatgtgttggcaagtgtactgagatgagacaactgcaggtagacttgacatacattactgaaatgtcatttttaattaaagatttgaattagatatagcaaggagataagttatgcaaaatttgcttgaataataaggatctaaataattttattattggagtgaacaaaaatgaattataatgagtcaattaaaagatattgtaatatgcattctaataagagaatgttatttagaaaaaaatattcgaaggcataattttaggtgttttgtttttttatgaggagagatgtggtacataggacttggagtatggatagatttcttactcatctactagagctgctacaatgatcagtacctaatctgctctcaagattggctaggtgtttgatatttcatcgttcccttttatgtgtaaaaatttaaatattcttctcccaggtttgatttttgccaagcatcagaaggaaagcgcccatctgaaaatcttggtcaggtactattcggggaaagaattgaaccttcaccatataaggtttgtatttagtgttacataataattatttacttacagcttttgtttttgttatttaagaaaagcctgagataactcagctatcattgctaaggaggagttcatttctctttttcatctaggaataggttcttaaaatcaaagttagaaggatccttctccttctcacagtgtgtcattgataagtctgtcttaatgaacattcacgcaactaatgttaggaatgttaagacggtggcttaaagggcagggctcagatgctctgcctcctttacagagggtcctgaaacccgggtcctggaacccagcttccagtcatgagaggttgtctcagctgctctgtgtctctttccccctgttttccagcagtatctagagacactctccgttagcacgtacaatgctgcctgggctcccgcactgggatttttggaagctaatctttcttttttttttccagacagagtcttgctctgtcgcccaggctgcagtgtagtggtgagatctcagctcactgcaacctctgcctcccgggttcaagcaattctcgtgcctcagcttcccgagtagctgggactataggtgcatggcaccatgcccagccaactttttgtatttttagtagagatggggttccaacatattggtcaggctggtctcaaactcctgaactcaagtgatttgcccgcctcggcctcccaaagtgttgagattacagatttgagccagtatgcctagcctaacctttctattttgatgtatttggaacatctttggtacattttttgaacaccagttaaaccaaactaagcacaatataaggtattcttttcaacatatgtacttcatcatctctcagaattcttttgcctttaaatctgttatcttttaagcctattatccttccacattgcataatccctgtttgttttgtatctgttctcctactgtacaaagaacaatggtcttttgcttttagaaacattaaagtagtttattataataatgtatcaccatataaaaaaattaaatgatgcaaaagaataaataataataaatgtgcagttccacttcacagtttgttattaaaatttcctgaaaattttcatacacctataagcttacattaaatagattagatttacttatttgttttaacatactatatgccacactttgcatttttcctttaactctctaccatgggcatctgtccacatgagaatgtgtgttctgatggctctaacttgactccaggtgttattccccagcccgacagcttcctctcctggcttcgcgtctctgctatgtcttagacctcatccatagccaccttccctgctttctcacgaggcacccccatctccctcgacattttattacatggagcacaacatttattatctgtccagcaaatcccgaagcctagattcatctcaccaaccgtcttactccctccagcacctgcacctacactgtgaagccctgggggaaaagaaacatcactgtgcaaatttaatccactacaagttgattggttttgactgtaaatatatcctcttcaaatattctttttttttcttttctttttttaagagatggagccttgctctgtcacccaggctggagtgacgtggcacaaccataggttactgcagcctcagactcctagtctcaagtgatcctcctgtctcactcccctgagtggctaggactacagatgcataccaccacatccagccaatttttaaattttttatagagacagggtctcactctgttgcccaggcttgtcctgaacttctggcttcaagcaatccttctgcctcagccttccaaagggttgggattatagacatagacgtgagccgccgtctgacgcctttcaaatactttttttttctttttcgagacagagtgtcactctattgctcaggctggagtgcagtggcaagatctcagctcactgtaacctccacctcctgggttcaagtgattctcctgcctcagcctcccaagtagctggaattacaggcgtgtgtcactatgcccagctaatttttgtatttttcgtagagatggggttttgccaagttggccaagctagtctcaaactcttgacctcaggtgatctgcctgtctcgacctcacaaagtgctgagattacaggcatgagccaccatgcccggcccctttcaaatattctaatctgaaattgtctaccctaaaattgccagtaacttttaaagtttcctaaacacagtagattcaaaggcctaatgggatgaagtcattgaggaggaaggaactcaaagtgtatggacatgggtgccattgagcagggcaggcatgtaacttgcgaaacacctcttccctcttgggatatttggaagattactttgaatggtattgcattcttcttatagcagatgactgttttcaggcatgctttttaaattttacaatcttaaatattccagcagcctctcagccccatctctctacttatgtcttgcccttgagaaatgatgggtgggaagaatatcagtaatgcccttagtgaactgggaagacagcaggagtccctagcaggaaacagaaggaaacccagcaaaatactcaaacccatggggaggtgttgccctttggggcagactttgaaggcaggttactccccttagtaggatgtcattgggcacatttctgtttctgtgcaaggactgttccttgctcatacacaggaccctttttggggcctagtgcttttcagatttaatcctttgttgtagaagttgaggttaaatataataaaaggagagctttagaatggagaaattgtgtacccaacattttccctgagtcttctggaatgtttcaggatccatatctgtactaaaacaaattctctaagccccaaacttaaagggacagagcaggcacattttaaggccaaggtgtaagccagccataaatgtattgaccaacatttttcatttcactattgattctttattttcaaggatttttatctttatgtatgtatttatttatttcttttttgagtctcacgctgtggcctgggctgggccacggctcactgcagccttgaactcccaggctcaataaatcctctcacctcagcctcctgagtagctggaactacagatatgcccaccatgcccaggtaatttttttattttttggagagacagggtctcactatgttgcccaggctggtcttgaactcctgggctcaagcaatcctcctgccttagccacccaaagttctgggattataggtgtgaaccactacacccagctttatcttattttagatctgctgtaaaaactgaggtaacaaccagcaacaaaataaaatcccagtctgctttgtcgtcttttatatttgacttctgtttaggtcaggaaaacaacagtgcaagacattgtgtgtattatgtgaagctggaaccacatttcataggaccataaaatctcatctcagatctaagcactcatattcattcactcagttaacacatttgctcagtacctttcatgtgccaggcactgtgatgggatacagcagtgagcaaaacaaaaatctctgtcctcatggatcttttatgctgatggggaaaaggagacaaaataaattaccagaatatatgtttcaattactgaggaaagaactattgaaaataaatctgtgaaggtgtgtggggaatttctaattttaaataggcttactgcaaaggtggatttaaaatcttaaaaaagccttaccgagaaggtgacatttgagcagaagacctgaagcaagtaagggagtgagccatgtgaatatgtgggggaggtgttctagctgaagagaggccccaaggtgtgtaacttgagcaggtgagcaagatagagcatagtaggcagtgggcacagagaagtaacaggaccacattatagaatgactcagaggccactgtgaggattggcctttacatctgagcaagatggttagttaacactggagggttttgagtaggcttcgattttaccagggtcaccctggctgctgtactgagaatggaccgtgggggtgcgaggggagaagccaggagaccagtaggaggccttctccctcatctaaatatgatctgacttgggaagggtgagggggtggtgaagaggtcagaatctgtgaatctggctgtgttttgaaggtggccgacagaatttgccaagggatgggatgtggagtgtggagtttctattttctaagatggggcagtctgtgggaagagccaggttgggggatggggaagagttagttttggatgtggtaagtgagaggtgtttattaggtgtccaagcagagatgctgaataaacagccaaatatatgcttttggagtttggagaagggcttcatcctggatatacacagtatatatttgagaatcatcagtgtatagatggtatttacagccacagaattgaagagatccccaagggagtgggtatagatgaagaagacaagattcgaagaggcacaggactctccccatcctcctgacctataaaatcaggtgccccaagggctcctggtattgtatttttagtagaaacagggttttaccatgttggtcaggctggtctcgaactcctgaccttaagagatccgccccctctcagcctcccaaagtgctggaattacaggcgtgaggctcagacccttggggcacctggttttataggtcgggaggatggggagagtctagcaaaggacactgagaaggagccactgatgagaaagaagggtaacggagaatgtggtccccagaggccaaggcaagaaagtgtttctaggaggagggattggttgatttgtcactgatgggtcaggtgagataaggacagaggattgaccttgggtttagccttcaatgttgaggtcattgatgtgaaagcagccgtgatagaatagccaggtggagagagaatggaaagagcatttgcaggtggacacatctacaactgtcttgaggacttttattttactggcagtgagaaaaagagtggaaactggaggatggcgtggttcaaagaggactgtttgtttgtttgtttgtttgtttagagacagtcttactctgttgtccaggcttgagtgcagtgttgtgatctcagctcactgcaacctccacctccgaggctccagtgcttctcttgccttagcctcccgagcagctgggattacaggtgcctgccaccacacctagttaatttttgtatttttagtagggacagggctttgccatgttggccaggctggtctcaaactcccgaccttaggtgatctgcccaccttggcctcccaaagtgctgggaataagccaaggcacccgccccaaagaggacttatgatagattttttttttttttttttttgagacagagtcttgctctgtagcccaggctggagtgcagtggcgtgatctcggcttactgcaagctccacctcccgagttcacaccattctcctgcctcagcctcccaagtagctgggactataggcgcccaccactatgcccagcttattttttgtatttttagtagagatggggtttcactgtgttagccaggatgatctcgatctccggacctcgtgatctgcctgcctcggcctcccaaagtgctgggattacaggcgtgagccaccgcgcccggccaggaggacttgtgatagatctttaagcaaggtgtgtatgtggatgagtgtgatcagtagatacgggaaaagtgatgatttaggagagggaaggattgccgtgggtgtccttgctctggcaagaagggatgggacctagtgtactgttggagaggttggcctcagtgagctcgttcatccgtggtaactggagggaaggcagagacatggggcatgatgctgggaggtaaatgtggcaattgctcctgattcctcagtgaagtaggcagcatggccaccccacctgtgagtgaggagggaggcagcagccaagtaggatccaggagagctaatagagcaggagtgtggagcggctgctaggctgcatcagggaccctctggccagctggtggtttgaagtaacagcagccagcgtgcttaattgtgtatctccagctatttccagctgtgctgctgagttggatttaaccaggtttgtggttttaacaagtgaataccaaaaaagtgagagaagaacacaggatgtgaggacatctttggatgttatgaaagatggagatactgttgagcttggagtttgagcttgcacagggggcatgtgaggccacaaaaggagtaagagacagtgaaaagactgtaggatctgtcgatttaagtggagtccagggcttgttggaggtgatgaacatttgagccagtgagttggaacaacgggaggaggtggtttgacactgggaagcttgaaatggagataatggctgggactgctgtcattgataaaggcagggtggaatgcgaccagaggagggagtgctttgaaattggatgaagaccagagtcgctggaggagagggcagaggatcaaaaggtcattgttttggaaggatcgttgatatagatgtaatcaccaagaatcaggagcgaggaggagtgttgcagtgacagtgagccaggagctgagggccagtgacctgggttggtagatgacaagaacaggaaggagtaggggcggtgtggtctgatcacatgggagtcaaagctagaggtttctggaggagggagaatggtctggcccagcgctggggcctatgagagaaaacaggcaccaccagcaagactccagtgaggcagcatccgtcagggacagccaggttttcatcagaacaggctccagaaaacattctgagaagaggttgaggaactagagggtgttctgctggtgacacatgagtttcagggcatagtggaagggattaagcagttgaggggggatacattttgggattcaaatgtgggaatggaaggatgacatggaaatcctggacttctggtggtgactaatattcagagggtagagggcataatgggattagtcctgcccattagtcctagtgggtagtagtccgttctgacgctgctgtgaagaaataccagaggctgggtaacttataaagaaaagtggtttaattgactcacagttccatatggctggggaggcctcaggaaaacaatcatggcagaaggggaggcaaccatgtccttcttcatgtggcggcagaaaagagaagtgcagagtgaatcggagaaagccccttataaaaccatcagatcttgtgagagctcactcactatcacaagaacagcgtggggtaccgccccccatgatctaatcacctcccacgaggtccctcccccaacacgtggggattacaattcagatcacaattggagataagatttgggtggggacactgagccaaaccacatcaatcctgatggtctcaggctgcatggaggagaagtcttgccagaagtgtgcagccttatatgatttccctcagatatggactttgatataatttttctgctatttgctaaaagctggtggtgagatacataacaataactgttatttagtgaatacctattttcatcagtcagcatgctaggtgttttgcacacacgtttctgtatttaatccaacaaccctgcaaggcaggtactgcgcccattttacacataagttaactgaagctgaggcagggttacgcagctttccctggtctcctaacaagatggagttgactcgtacccaggtctgactctagattgatattttgattttcagaattattccaaggagaaggttaaatcctcactgaaataatttaggaaaaattataatcccacgttttcccgaatagaaacagaacagtgctgtgcttgcgtgttataaggaggatttgtttcccttgggagctaagaatatttaaaaatccttagcaaaacataaataaaatacaattccatccataaccaaacatgatttaaaatattataaaattcccaactaaacacatgacagggagaggctgcagggtgttgtgctgaagagcatgttctccggagctcaactcacttggctcagatcctggctatgccgatgctcagttgtgtgacttggtgctccagttttctcatctgtaaaagatgaataagggttgtttggaggattacatgaggcttgatatatacaaagtacatggaacataggaagcactaaacagatgttacctattactacattaatgtcaccttagtcttgctatttccttcacaattgaacacacaggttgactcacctaatgaagtgagcactggattgaggtgtcagatttgccattttggtgtaatattgtctctctgcttaacttattttaagtttggtgtctgtgcttctgatttcttagtgtgtatacttttttgtttttccattttccactttttaagaatgaatctttaaggttcatataaggtttaaaatatcaactagtggtacagatatggctgtattggaaatagcaatgcagacagaatgaaaacattggctgacaggtggcagcagtggactatgcttaaacattcacttagctgcttcactgcacctgctttagggatgttaataaatacatacatacaaaagagtgggctgcttagaagtgaaccatgccatttttttaatcaccttatgtaataaagtttgaatttattaaaagatggaattatggctggttgtatagctggtaaatttcagccttctggagtcatgtttagcctgattttagacatctgaatgtcacatgctctcttgttcactgctgaatctctatcacctgacacttaaggagggcacttaacatctgttgattatttgaacataaaaatttgtctgcttgttactagaaagccattaactccagaattcctaagacatgaccatgggatattactaggagagactaaagttccatttttgttctacatgggatttttttttctcttctagaacttatttacatttaaaaggtaagtcgattgaaattaccaaaaagaacgtatcaaaggaaaacttgatgacgagtctttagagaaacacagtaggattaaaatttaaatctgattgagctatgaggaatttaaaaatttatttattaccaatattaatgcacttaagtaatttaatgggaccagcacttttactctatttgtgatattggtatgaaaaacctggatattttttctgaatttgctttccacttccttttaatacagtttacgtttaataagaaggagacctgtaagcttgtttgtacaaaaacataccatacagagaaagctgaagacaaacaaaagttagaattcttgaaaaaaagcatgttattgaattatcaacatcactggtaaggcatgaatattttcgattttggggtttatcctttccatatgaaatctttgttgctttgactgtataaattacttgattgtgtaaaatatagcaaattaattgatttccttttttttgttactagtggtcgtagcttgaagtagtgactcttagttaaagatgacaacatcatttaaagtatcatcttttaactgtgtttagattactgtaatatctggtacttcttttgatacatagatctggtacatagagtagttatttttattcacatacaggcataccttggggatactgaggttcagttccatgccactgcaataaagcaaataacacaataaagtgagtcacataaagtttttcttggtttcccagtgcatataaaagttatgtttatactacatatagtctattaagtgtgcaataacattatgtctaaaacaactctgtaagtaccttaattaaaaaatacattattgcttacaaaaaaaaaaaaggctgacacaaagacagaaagtgaacacatgctgttgaaaaaatggcactgatataggcatggtggctcacgcctgtaatcccagcacttgggaggctgaggcggttggatcacgaggtcaggagatcgagaccatcctggctaacacgatgaaaccccatctctactaaaaatacaaaaaattagccaggtgtggtgatgggctcctgtagtcccaactacttgggaggctgaggcaggagaatggcgtgaaccccagaggcggagcttgcagtgagctgagatcgtgccactgcactcccgcctgggcgacagagcaagactctgtctcaaaaataaaaaaaaaagaaagaatggcactgatagatttgcttaacgcaaggatgccacaaaccttcaatttctaaaaaacaccatatctgcaaagcacaataaagtgaagtgcaataaaacgaagtatgcctgaatagttaacagtagcatattatgctttggggaaaaggacctgggtcagtcttctagtgaaaacattgttttatacttgtgggctatgaaaaaaatcacaggaaaacaaaacttaacttttgtttgataaatagcatcaacttcaaataaaacgcttacattttgcttagcctttcattttgtaaacatgacataacattaacaaattctgtaccagtttgtatcagaatcaaaaagtatttaaaactgtcctgtttttccttccaaagtagtatatacttattatacaatattcaaacatagaattttttttttttttctgagatggagtctctcactgttccccagactggagtgctgtggcgtgatctcggctcactgcaacctccgtctcctggggtcaagtgattcttgcattttagccgcctgagtagctgggattacatgtgcccgccaccacacctggctaatttttatagttttagtagacacggggttttaccatgttggccaggctggtctcgaactcctgaccttaagagatccgcccctctcagcctcccaaagtgctggaattataggtgtgagccactgcgcccggtcaaacatagaatatttttaaagactttcaaaatccaacatttgaagtataaccattgctattcttctgagtaattttgcttggaaatgcctatattctgtggggatcatagtttacatatgttttgccttttctagaaagtgtaagatgctttcagtggcgaacaggaggactgtgttcatgcacttccttttggatatttgtcctgtcagtatattagatcacattgtttgctcacgccaataaggttaggaaccgtggatctcagctgagacctgaccagatcctgtggcctcgcattccctcctaccccttagttttcctcctcctccaccccacccaacccccatatgcatagaaccctgggttgctgagtcctgtgcacagccatgagctagtttgtgatgggaaggattcattctgactgaccagacctgggtaacatctacctgaaccccataagaatgggttctgtgtaggctagtggggctctgttggaaggagggagatggtgctgttagaaacctgcctgttatgcttgtgtcagcttctttgtcatctgaccctcagtgcaaataggaactttaaagactcctttgtctccccatttctttcatttctggtaaacgaagagcttgtttcccctaaactaccatagaaatactgcttatttgctagatcaatgcatatcaattgcatatcaacctgggatatgtttacttattgttaagtaattgaaatttccttgttgtttttctttgtaatcttcaaaataatatttaagcctcagttcttatcttctcatattagccctatccacctgcgtttactgcaatagctatcagtttgttgactgactgaaagaatgactgttaaggtctgtggatgattttttttttttctttttttttgagacggaatctcgttctgtcacccaggctggagtgcagtggcgcaatctcggctcactgcaagctccgcctcccgggtccacgccattctcctgcctcagcctcccgagtagctgggactacaggcgcccgccaccacgccggctaattttttgtatttttagtagagacggggtttcactgtgttagccaggatggtctcgatctcctgacctcgtgatccgcccgcctctgcctcccaaagtgctgggattacaagtgtgagccaccgcgcccggccttgtgggtgattttttagctctttcttctaccctctgtgcttagaatactgtttagtcagcccggcaccgtggctcatgcctataatcccagtattttgggaggccaaggcaggcagatcacctgaggccaggagttcgagaccagcctggccaacatggcgaaaccccatctctactaaaaatacaaaaattagccaggtgtggtggcaggcgcctgtaatcccagctactcgggaggctgaggcaggagaattgcttgaaccaaagaatactgtttagtcttgctcctgaaggtagtagaagcagttcttcactagcctcctgacaggaaagtacttagagatatttttaactaatttatgatgcagttaacaaagatttcattataatgccaagatgcttaataacaagaaagaataaatacagtagtgtacaaactaagcaagcatcagacagtaaaatttactgaatgatttgtaatcagcatatcaattgcaaacttcaactattctgctttaaaaaaattacctgagaaagtgctggtaaataatgattttgcagttgaatcagaaaagttgatgattttaagtgtaacccttaaatcagttcagtatacatttggaaaatgttgattcacattgatgaatttattgaaaccattatttgagtatattctgtccatgacctatttcagagagattttactgtataacttgattttaagcatagacagtagagttgacacataaaataccatgtacccatgggaatttacagtattctgttagggagtttgtgaatatagcacattttattttatactttgcactaagacatactagggagagcataatcattttctaaatcataaagcaatacatgccgatgagaaaacacaagcagtacaagaaaatattaagtaaaagtaagtcttctgtcagtctcagcctcatttctattctacagaactaacactattatttctcatgtgtgtttctatatttactatgcatatggaggtatagaaaagggtgtgtccctttttaaaataatgcaactaaaatattgtacacgttattctgcaacttgctcattttatttaagaaaatattatggacttttttcaggtcaagtaacattgtaaatctataacctcctccgtcttttccataatttcataattcactgcatgaatcaatcataatttctcacccatgacattggaaccgtgctgtagtttattattctcactataaagaacagttaataatagtttcttatataaattgacgaatactttttatttttttatttgttgttgttgttgagacagagtctcgctctgtctcccaggctggagtgcagtggcacagtctcgactcactgcaacctcagcctcctgggttcaagtgattctcctgcctctgcctccacctccgcctcctgagtagctgggactgcaggtgcccgccaccacgcctggctaatttttgtatttttagtagagacgggatttcactatgttggccaggctgctctcgaactcctgacctcttgatctacccaccttggcctcccaaagtgctgggattacaggcgcgagccaccgctcccggccatactttttattcttatttggggctttagcacataatttgaggatctttttggcttactctgtcagtagctgctaagctattttgtgattcctgaaactattgctttgataccagcactggacacttaaaactctcttcagctgtgctctgtgtggtttgtgattatacttcttgcctgaatttccaaatcttgatgacattttatttataaaaatataattaactagttatcagagtacttaccatttcttagtatcatagaaccactggactatagcttattgaattataaaggggtcttgaagatactttagtgagttccaatcccagatcccaccaagttagcaaaggagaatgatgtgctgttttcaaaaattcaaaatcctaatgaatactccaaatgtactcatgttaaaactacatagaaatgccaactgtgggctaccctctttgggtcacctccctttgtatgggagctctgttttcactctattaaatcttgcaactgcaaaaaaaagaaaagaaaaaaaaatgccaacttgttaaatgccaactttctttgctttgggctgtaattttctgagtgcattgtgacaatatgggttattctgattagaaacttttggaattaatttattggaaaaacaagtagttactaagtgaagcttgattggtagaactgtttcaaatggagtccttggagagcagacagaagtaaaggaaaggagttcttcatgataaaaagttgggagtcattcagcctttatccttgcgagtcttcttcccattattcagtctgtcagattggaaataagagttttaatttttttgatattagaaatttaaataaatactacttgttaatttaggaagacagtaattgaaaatcatattctttggccaggcgtggtggctcacacctgtaatcccagcactttgggagaccagggtaggaggaccacttgagcccaggagtttgagaccagccctggcaacatagtgagaccccaactctacaaaaaatatttaaaaattagccaggtgtgatggcatgcacctgtagtcccagctacttgggaggcacagatgggaggatcacttgagcctgggaggttgaggctgcagaaagccatgatcatgctactgcactccagcctgggtgacagagcaagaccctgtctcgagggaaaaaaagatatcctttaagttttcttaaatttatttcaaagggatttttttttaaatgcttcctattaccagaaaaagctattgtgtcaaggtattatataaatgatacatttaggatgttggcttttataaaacctaaattgtgctttaatttctcattttgtaactagcactataatttttatgtagtactttccctccagtatggtagcatgaagatactatatattgctagtatatattcattaattgaacttcatctctatctaaaaaattaaagcaattaacggattcgttaagctttcagaaaatctgaattatttattctatataacaatgcgtttatgcttctaatattttatagtcttttcattggaaccactagcctgctgattataataataagcagtttaatagtataggtgattctaaaattttgtacactgggtactgttaaatagcatttaaaggtgacgagacatgttttattaggtcattaaggtacaccttgggtgaatatagaatcataattttacttcctaaggcacacattaattaacaaataaaacatgccctggagtgtcgtcttatgactgtaatatagctgctatattttgagtagtttttttatttgtatcccgcagtgtactctgggcgcagggggccacatgcttggactgtaatgtagttatatggtgctacagaactttattttctgcttttattatttaagtcctttttcactatagaacttgaaagatttggttcgctagctttgcaacagtatttcttttagaaataacttggatttatagttttcacagaatttttttgtatagctttcacttttcctcctggctctttagtttaatgttttcctatatcttgcaattgtattccttttttattgaataacctgagtaataagaggcatttccttctctactgtctaataaactgttcctgaggaactagatatattgctttgtgtacctatttagagctgtgagtattctgctaaaggtaaattacagtgaagtgtctaaatagtattgttaaattagcaattacaataaattagtttataaaactctttcctacctaccatttatcctttcaaaaaaggtacgaagttttttttgtttttttttttttctttttttaaggctagtcaaatgaagcagtgctgtacctggttgtgatcaattagttgtaaacaccactgcactcggaccagcctgtagttttttccatcactgcagtgtatcagatactggcatattgttattgcttatgaaatagcacatttcattaacattctttgtggtttttgtaatcttaaggcatttacacatttaaattttacaaagtgatgacactgatttgggcagtaattctttgtcatgtttggtgggttcttttctaacttaactcctctttccatgtgtaggattgtggataatatgcctgtaacgtggtgttacgatgttgaagatggtcagaggttctgtaatcctggatttcctattggctgttacattacagataaaggccatgcaaaagatgcctgtgttattagtgtaagttcatgataaactctttgctgctttttaaaacatggcttttgatagaattcagtctttacctggacaaaaattgttatattcattgaatgagtgtacagttcagatgttctgaagtacaactacttcaatcttaaacttacagcagattaataatgtataagttgaggtttagaattggaataattcagattcagttcaacatttactgagattgtctgttgtatgttaaatgctatggtaaggtctagaagtttgtcctaactctcataaatcttatatattacaaaatgtacatagtagagtgtcaaaaaaggcttcattataagttaactaaatttgtattgcagaagtcagatattataacctttttaagacctatgtgtctttgaggccattattttatatttaaaaatagattaatcaaatagagacattactatagaaggtaattagaactaggtggggatatatattaaaatgaattttgtgtaatcagatcaacctgatttaaatctcttaatggatctgattcagtggaaggtagcatgagttaatcatgaaactgattatatcagttagtgcttttgtgagtgctgaccagagatacttgaataatttaggttatgagtttagtccaaacttataagcttccaggcaggaaaagtgtttaaatgtataagcattagtgtgctcataatattttaaattttattttgtttcattttaaatgaaaggctagaaaatactagattagtgttcttttgaattggtacttattagattttatgtaaaaaaactgtaagaagcatataccttccccaattaatttttggcttaaaaagagtttaagtataaaattgaaacatgttaatgtgaaaggcttaaaattccattcaaacttaaattttcttacttgttgtagcccattttaaagttttaagttttgactcttatgtagtcagttttctacctttaacttttaagttctgttctgcagtcagatttccatgaaagagatacattttacatcttcaaccatgttgacatcaaaatatactatcatgttgttgaaactgggtccatgggagcaagattagtggctgctaaacttgaaccgaaaaggtaattatattaatgataaaaagtaaacaagtataagtgaaatttagacccaaagaataagtatttggggctcaattactccttaatattctgacatttcaggattgatttcactaaaactccctttggcatgatttgttattgttatgggttgtccagaaaaccataccaatagttattttcctgtcatgataagcggtcaagccaaggtgccttagtgttttgtttttcagtcaggaggttttgacagcttttccacgtgtcagtggggagggagaagttgagtggttgggacagtggtccccttcgtggtggaaagaacactgcctcagataatgtgtggctttcctctggtcagaggcccaaatgagtggacaagtactgtgatttctcaagcccctatgcagtgttagatgccactatgaaatacgagccattgaaagagatctcttcaacttattattttttatcacgaacgtacatatcagttatttatgagattttttttttaaatatttcattttttttcacgactttttctgccattgaattagcctttttctcatgcactggtggtcaagaaatacatgccataataagatggcagttaaacttcatcagtattttttttttttaaataagattatttagccaggcacagtggctcgcacctgtaatctgaacactttgggaaggccaaggcaggaggatcacttgaggccaggagttcaagaccagcctaggcaacataatgagaccctgtctctacagaaaatgaattcgctgggcatggtggcatgtgcctgtaggaagctgaagtgagaggatcacttgagcccaggagttcaagaccagcctgggcaacatagtgagaccctgtctctacagaaaatttaaaaattaactgggcactgtggcccgtgcctgtaggaggctgaagtgggaggatcacttgaacccaggagtttgaagctgcagtgagccaagatcacactactgcacaccagcctgggtgacaaagcaagaccttgtctcaaaaacaaaacaaaaaacaaaaaaggccaggcatggtggctcatgttgtaatcccagcactttgagaggctgaggcagtaggattgcttgagcccaggagttcaagaccagcctgggcaacatagcaagaccttgtttctacaaaaaatgaaaaattagctgggcgtggggtgtggtggcacacacctgtagtcccatctacttgggagactgaggtgggaggatcacttgagcccaggagtttgaggctgcattgaactgtgatggcaccaccgcactcaggcctgggtaagagagcaagaccctgtcccaaaaaaaaaaaagaaaaaaaaaaagattatttaaatgctcttcaagtatagtgttttcaaaagtatgtttataattttgtacacatatgatgtaaatatttatgctattaagtgtgacatgaataatttcacctttgtcagcagcattttaaaatacgtacaaaatctgtaacctttacctcatttttaaaaagttgtactttatcagcatcttgccaaaatgtttcttcccacagcttcaaacatacccatatagataaaccagactgctcagggccccccatggacataagtaacaaggcttctggggagataaaaattgcctatacttactctgttagcttcgaggtgagtctgttgttatctttagtataactctgaaattgattttaaatttgtactacttaaactaattaaaatgttactgattatgcttgtcaaataaagaagctattaatgagctgatttttaggatagtttgtcggtgtaccaagcaacataatcactcttgtaactgagtcttagtttaaatgagaatatagaggaagttgaagacttgagcctgatttagtgttaagcataagagatacatataagacaaaagtagaaaacaggcctagaggacgggatggaaatgccagagatatattcagaaaccatttgggaaatcaacaccgtactttaaaggatttaagtgtgaactttaaatggagagcttccaattggtagattgtcttagaaaattgaagggagtgttttcattaacgaagtttcttaaaatgcaaattcattgttatgagaatcttagtattctacctttattttttcaccatttttaaaatcaagatttaattatgaactttaaatgaagagtttccgattgggagattgtcttagaaaattgaagggagtatttttattagcgaagtttcttaaaatgcaagtttatcattaaaatgcaagaatcttaggcagtgttccaactctattttttaaaacttttggcaatccaatatagttgtgatgtttaatatccccgtataatgtttcattttgcaaacctggtgcagtaaatagtatatatttctagatattaagagctcagtgtgcctggaatgactggtctggttagctgcccccggcataaagaaaagaataattattccattccattccattattttcttaaaaaaaaaaaaaaaacctacatataggtctaaatgttgacatctaaacatctagttataatttaaagcaatacttttagtaggtattactaggaattcttttttttttttttttttggttgcataatcttactctgatttcccctagactttagtaaatctgaaactctccaaatctcaggactaaccaaagttagataatttagaaattgcagttgttgactcaatggaaggacaagctttgaatgggatttttttttgttcttaatgtgctgtcagcagatgtttacttaaagagattttttaatctcctctaggaagatgataagatcagatgggcgtctagatgggactatattctggagtctatgcctcatacccacattcagtggtttaggtaagagtacagagttagcctgcttttgctttctacttttctaccctctgtccctttgaacatctcatttactctcaaatcctctctactttattcaaaagtctggccttgggttcaaatcctggctttcagccactgattgtgagtcacagcaggtcccttaatttctcagcgtctgtttctttatctagaaatacccaccttatgggattgttgtgaggattaaaggacatcatgggacagaatatttgaggacattgtctggcacataagagtgttcagaaacagaagccgctgttgttgctatgactttattattatccccttcaaacatgattcaaaacttttatctagagttgttcatgttgccataactctccttttcctattgctgtctgatctttttgacactcactaatttactgagtaaagttgttcttcagtaaatttcttgagggcacaagccagtcctttgttgtggcagtgatttgggcacagtagttatttcataatattgaccatgtaccaaaaaattctagttctaaacagactatgaaactgtattatgataagtatataatgttatttatctactggagggaaacatgaaagaacacagttcattgaatttgttggatttcagatagctttcattttgattttgatcaagactgttttaatgttactcaataaacagtttttaaaagagttttactgttcctaggattaagctacagattactcatgatgtgcttatttctacagcattatgaattccctggtcattgttctcttcttatctggaatggtagctatgattatgttacggacactgcacaaagatattgctagatataatcagatggactctacggtaagtggaaacattttagtctttagtctgccaaggacactgtttattgttattttgcaaaaaggtaaaataatagctttagaatctgcttttaaaacattcttcaaaaaacaaaaacaaaaacaaaaaaattcttctcaaaagttatcttgaattcacattttcaaataagaaagtgatacttaagaattaatattcttggctgggcgcggtggctcacacctgtaatcccagcactttgggaggccggggtgggcggatcacctgaggtcaggagttcaagaccagcctgaccaacatggtgaaaccccatctctcctaaaaacacaaaaattagctgggtgtggtggtggggacctgtagccccagctacctcgggaggctgaggcaggagaattgcttgaacccaggaggcggaggctgcagtgagccaagatcgtgccactgcactccagcctggcaacagagcaagactctgtctcaaaaaaaaaaaaaaaaaaatagaaatggagtcagcacagccttgggagctgacctgttcacagcctcctgtgtgggaatggactggtgcagcgtggggtgtaggtgcacagttacaactctgtaaggtttctccatccctgacacatacctgtttgtgaaaccacaaagttgaatggaataactcctaagcaatttttatttgtgtggttaattttttaaaattaatcttaacaaatttgtatcatttcaaccttttgatatatttaaaataattgcatgttccagcctctttagtctcaaactttttaagttgcacagtgttacacattttctactcttcatttcatggcagcataataaaagaattttcacaagaatcacagtaatttggaatgaatgcaaaaaactcaggtttttattgtattctcttcccccagcttcttcagcctcctgtcccccaacctctctgacctgttctgattggggaaaatatatatgaatattcataagcttttaacgtttgtactctatagtctctttcctatgatttttattgattttatgtcttattaaatattaaaatgattttaaaatactctgtttataattggctgttccacataattgctgttaatggagttttatcttaatttgcacagcgttgccatgtggaaccaggccagtggtgactctgcttccacaaccctgtcctacttcccatctcttagcacagcagtcagagtgaaactgctcaaacagaagtcagatcatttcactcttgagcacggccctccagggacttctgttcagtcagagcaagagtcagaggctttacagtggcttctaaggccccacgttacctcagcactctgctgcacctgtgccggctaccttgctgttcctcagaccaggcagacataggtttccacctcagagccttcacgaagctcactgttttatctgctaagaaggtctgcccctcatttacatggctagttcccttacctccctccgatctttacaaaatgtgatcttcccattgaacccctcccagccatcacatatgttacatcctgtcctgcacacacccatacatcctgtttttctgtacagcgcttattaccatctaatgtacagtatactttcctgacttattttgtttattgtctgccttcccaatgagatcatgtactcctgagagtaggaatttttctgttacactcactgtggtatctggtgttttaaacagagccgagcttatagttggtgctcaatgaatgtttacatccatgcttactgtattagcaaagtagctagaatatgagagctaatgccatttgcttattgtggagatcattaagagtaggatgaagaggatagaatgtgactaaaaatcgtcatcaagtcagatcacaaagcttgacttagagtagaattaggtagcaatcacattgtctttgtaaagtttctcaataagtatatttgtagaccttaatgtcataaatttaagaaactgacatataagacagttcagcaaagccatattaagctccatgagtcaagctgtattcttcaaaattgaaataggtactaacatttttaagtttaaaaaaaacctgttttctgtaacagcatattcaacagtgaacaaactgtctatagttgtcttgttgataccatgagacaatcgaactgatttcattccccttttaggaagatgcccaggaagaatttggctggaaacttgttcatggtgatatattccgtcctccaagaaaagggatgctgctatcagtctttctaggatccgggacacagattttaattatgacctttgtgactctatgtaagtgttaactgaaaattttcaagtagaaaatactttctaaatacagtaattgcttaaaaaccagtttttctggccgggcatggtggctcatgcctgtaatcctagcactttgggaggccaaggcgggtggatgacaaggtcaggagtttgagaccagactggccaatatagtgaaaccccgtctttctactaaaaatacaaaaactgggcatggtggcaggtgcctgtaatcccagctacttgtggggctgaggcagtagcttgaacctgggaggcggaggttgtagtgaactgagattgcgccactgcactccagcctgggtgacagtgcaagactccatctcaaaaaaaaaaacaaaaaacaccacagtttttctaagtgggtaggtaagccagattatttctgagcatcctttaggttctcaaaatctaagtgacttggggcaggtttagttgcacccaaagactgactcttggtttctcccttcagctcttcctagaccaagcctttgtcagggaggcactgggctggagatgaacaggtccttaagaccatcagcatctgagtctaaacagcccagaactgggaccatttagggtctcttttacccaggcatcgtgggcaggcacagtctggttagggttccaggatattcttggcttccacggagggaggagggtgggaaaagaagggatgggacaggaagcactgtgtagatccttctcatctggggaggatttgggaagcaggatctctctcctctagggaaagcgagtgtgtaggaaagaccttccttcctccataaaaagattctcttctttgagctacctcagcgacttcagaaattgtatttaaatttttgccaactaggacaatttttttttttaaataaatgttccttagaggtattgatagccacagggattgttctgaaactacctctgggtatatgttaattccactgtcttccagtttccttaattggaagataaaaaaggtttatgaatagaattttctaaattttacctttatttaatgtattttactttattgatgcctgctactgataaatagcaacaaatgaatatactgggagaattcagaaactaacctttaataattttttagtaaacatttattttttatgtttgattacatattaaatacataataccacagttatttttgttagtaaagttgttccaaatttttatgataaaattaattatataaatgctttgcaaagagcagtatcattttcaaatgtctggcactgaataagtttgggaaccaaactcacaccttcaggttcagtttgaagactgactaggatatcttttttttttaatctactaacaacttaaggagatacaattttgataggtagagctagaatttgtaactatatcatactaaagagaagttaagtcatactaaagagaataggtcaggaaaaggtgtcataaaaaaggtttggacagagggtggtagggtgaaggcactgggtgacagagagccaaactagacttagagcagaatgaatgtttgaagataaacttctgctttctttctttctttttttttttgagacggagcctcgctctgtcaccaggctggagttcagtggcgtgatcttggcttactgaaacctccacctcctaggtccaagtgattcttctgcctcagcctcctgagtagctgggattacaggcgcctgccaccacgcctggctgatttttgtatttttggtagagacacggtttcaccatgttgtccaggatggtctcaatctctcaacctcgtgatccgcccgcctcggcctcccaaagtgctggggttacaggcgtgagctaccacacccagccaactcctgctttcaaatcttattaggagctgtcttctgcgatgctctggtttttattgcggtcagctagaaaagtgaacttttaaggaaggaaagtttcagagagtctaggatagaatacgatgggaataattttccttaagtcctcaaataggaactttctgccgaagggcagtccatttttcaggtcgaggaggagaaaggggttgcattttagctgaaatcttgtacatcttctaaagctaccctgatgtgtttcctgctcatcatgactctggtgcttgtcagaggtgtgtgcgcgtgcttgctcacatacgtgcttggtcatgcacgttttaggggaaacaatagggggggaaacaatggggattttcttgctgagcctcctgaaactcagttctcagcagtatcctactcaccttgggattctgagcaccttataacttctgagccccagcttaaagctgggaatttctatgaatataatatagcattttaattctcattagtaggaaggcttacatagggaagagcaaacaaagctaaccacgtgaataaggtagggccagggtttccccgtattgctgacaaggtccttcagtaatttgtgaaaagctaatggccgtatgaaatctttctccctcattttgttctttcattagattatatatgtctcttctgtttgaatgttgtaaggttttgggtttttttttttttacccccagaggacccccatattttttaatgaaagaacagtgggaatattttgtagtggaaacattttcacttatgtcaattttaaaggctgtacttgaatctcagaagagtcaaatgcactcttgagcatccagtcagcctcccctgatcacaggaaggatgtgatctctcattctggactctgagaagaaacttccaaagtgaagtttgcctcatgtatgatcagattggtgcagtacagtaaatattactaagattgtgtagagctgcatggtaggagagcacatggttttgcgtgaagttgtatttttttcttgtttgaaaaatgagagggtttctctatcatttcacagcaaaggaaacagagtaataacatgtacagcctttcatgatttgtgttttagttttcgcttgcctgggatttttgtcacctgccaaccgaggagcgctgatgacgtgtgctgtggtcctgtgggtgctgctgggcacccctgcaggctatgttgctgccagattctataagtgtaagtcaaagccactgtgactggcgtctgatcaggaagggactctgctgcggctgtggatctgacctgggtatcagatggtgatgctttgtaaatagtgtgcctcataggggtctgttcttagttaaaaggagcctgcttggtgattccttttgtgtcatgagttactatcccaaaatttatttgttcgaaaatgtttagtgaaacaagcaaattgtgccacttatccactatcccctccctctttttttctttaagctttggctaacaggttgggctgaacagcttagatttgctgtgttcatagaagcacatatagactaataaaggagaaaagtatacaaatgagtatcactgatttttttcactaaaacaactagtatatctaggtgtaccttttcttacatatgagaagtcatacttacattgtatcaatttaatatttataaaaatacactgtttcaagtaaacaaagatctcattattttggagacctggaaagttacttttgtaatatcattagtcacaatctcttgtgttcttgcattctagaagtaaaataaagttcagtgaaacaaaaggctcacggccacagagtaaggctgagatgggactggatggcttagaaagcagctggcagggtcagcagggaccagagctggcctcctcgggaatgccacagtctcgtctgggatatacagtgattccccacggtctagcaatgtgaaaaagttttgaggtgaagcacagtagagttacgtggacaaccttaatgtggggttgggtagtctcagcccccagtaaaagattaacctagaccttgtcagacacagttctctcttgagtatgtgaagccctgtatgtatgtgtgttttaagtgtgttttaatttctgtgaattttgtcaagttctttcttcccctttactaaaggaggtaggattagggccatcatacggattttaatgcatacaaaatacagtcagccctttgcctgccacaccagccttacttcatgccacactccccctttctcaccatttcagccacacaggctttctgtcggttcctcggacaggctgcctgctttcccacaccctgctcccatctgcactccactcactaatgcctccccatccttcaggtctcccagctgcagatcctgtattacttgaattttgactgaaattatagtaaacccagaattaatcatttcataacagtctgtttatcagaaacattgtgagttcaaatcatgatacatatatatgatcttatgtgtatatgtaattttattattttcttttagggcaagtggcacttaaacttgcctatcaactatgttaaaacttttttaaaaatcacagctgttctgagatctcagccagtttcatttctgacttaaactgggagcagacgtgtactttcatttttcactctagctacttcagtatttgaattctttaaactggaaaaaaaagcaagttggagaggggcaaaggagagtaaaacatatattagcaaacatggtctgtcaaatggtcataacccttctactcttcttagttgcctcatctgacacacgcacctcctaggaaccacagttcctcctagaaaccacagtgctagaggaagagttggcctactgtggaagtgtaaatgtgttgcacatcaggcttgacggttcccagttttataacaaattctgaaactgactgcaagataagtgagaatcccgtgtgcccttcctgtgcctaggcccattgattgatactggctcaggatttaaggattcttttggttgtgaggggaaaagaagaactgatcttgatgacttgcctctgattctctagagcaggacttacctagggaatcccatcctgtatgtctcagatttggattatttaataaaggaatatcatattatatttgctagtaccattttctaggaatgagtactcattgctgtctgacagtttggcaaatatcagacttgtaatatggatatttggtttgctttaaagaaaatctgtatttatacaacttttgttttcttctatagcctttggaggtgagaagtggaaaacaaatgttttattaacatcatttctttgtcctgggtaagtgaatttttcaagaattactttcttaacatagttacatgttagtccccaaattttcagtcgttgagtctttaatcctccgtgtctctaaatcatgtacctaagaaagtaaatttaatttttgaaaaggggtaaaataaatattttataaacgtttgccaaatgattaccacatgtcttatctggggaaagtacctttagacatgagaaatgttttaattccttctcttcaaagtctttctgtttcttggtttttagtggtcagtctgacatgttgttctgtaggctgcatttaaagcttttgagccaggcacaggaaggaatcctgaagatagttcaggcaagcatatgttttcccatttttatccaaagcattgccattttttagagtttattccattaagtaaagtaatatacaccaaaaataaaaaataagcagccaccacaaatccaaaacaaaacaaaaatccttcactctctggaactgcttctcctctcgattatctgatgcggttctggtcctagaagcaaaacccacttcctcccaaacctgcacatttctggtgggcaagaactgacacgtgaacaggctacagcaataaagaaagccaaggatgatgaagtctagaaaccagaactgttccatttgcaggctagaaatgcaagcgtgatggcagcagcattttaatacacatttgggataaatattctctctatcacctccactgaagattcacattcttctcagttatcggttctattcaaatttctatgcttttctcaagccatgtcctttgttttctttccctctgtcaactcacaaaggtgtccgtccttaccaagactgtgatttcctgcagaatctccgaatcttgcttttcaggcacctatccctctagtctcacacatcttccattgctcccttctcacatgttctgcttatgtggttcttttattcctccaaataggctcatgtctcccctaaaaagggatcataaacatcttcccttcttatttccatctcatttcttttctattcccaacaaaatgccttgaaaaaaatagtctctactcctttcttctcattttctcagtaaacatttgcagtgtaaagccacgtcattcgtatttttctccatcattttactgaaacttttaagtttgccaataatgttcccattttcaaatccagaaacgattttctctgtattgtctaacattggaataccttcttgaaactccttccttttttggcttcataaaaattatcctgtgctggttcttcttttatgtctctgatcaacccttctctgattgatgttcttcatcctactcttaacagtgggtgtttaccagcaggtaaatagagcgtgctaagaactcaagtattcaggggcagggggacttggtgttcacctaggaatagaaggatcatttaataacaggaaatctagtcatacaattctacataaataaacacctgcatataattactgcaacagatgcagtaaaatggcctttgataatattgagcattgttttcaggttttaaaaaaaatttatagagaaatatttccttgtattaaaaagaatcttatctctaattcagaaccaacatcactgataataaaacactagggacattctcagtaaatctctttcatggcttgttgtttaagttctgttcacagtaaaggaggaaacaaaaaggtggatttcatcttattatttatagataacattatttgtatacaaagaacaccaacacattttaactgtaaaacttgtagaattaataaaaagagtttggcaaaatggctaggtatcaactaatattccaagatcctaaacagcaccattaaccagttaaatgttttaatggtagtggtagttgtgctggaagagggctctattcacagaaaacccatacagtgcctgaaataacctctcaaagtatgcacaatccatatgacaagcctacaagattattaactcgaaagagatggaaatttgccatgtttcttaatgaaaagatcaagcattgtgaaggtgtttggaaagtccaggggctgctgggatggagaatacagaagcaggccctgtatccatggcagcgtgctagatgtggcaccatgagccagaggaactgttagataagtgatgctgggacagctgattctcttcatgaagggagaaagttgtcagtcctaggtggagtcaaacctaaatgcaccaggcgtaactactgtgtgaaaatatggaagagcatcttcatggtcccaggttagggaaggctttcttctcttaagcagagtgcacaaaggataaaagggaaagtggttgcgcttaaaaactgtgtgggggaagtacagtgattattgtatgattacaaccatatttttaaaaatgtattcagaagaaagactgaatggaaattaactacacacatttagatgtttgggttcaaaaaaagccacagactgtgacaagatatttaacaaggaattagtaagtagaatatgtaaataactcacatacatgacttggcaagacatgcaggtcaaatgaaaaccaagcagtggatgtcagtagcccgtcacagaaggtaaaaccaaaaaagccagcaaacaccagacgcctgctgcagttttcaatagaaaatacaaattaaaacaacagaattgacaatcccaagtgtaatgaaaacatgtaaggaactgactttcataggctgctgggaggagtttaactcaggcaaacccaatctgaagagcaattgggtagtttctagtcaagttttacattcagacatcctgtgatgcagcaattccactttctttgtatatatatattagaaacatagaagttgtcatattaattacatactactgttgcattttgttatctctggttttacccaaaagcctgttgtgtctttcaggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgtaagtttataggtgttaacttattcaggtgaattttagctgcagaaattagcatatgccatctcaaaagataccataaaagtgtgtaaagatgtaaacttgtcctttaggatctggatttcatagaatatttttaaaatagtagtattatttaggagcgtggtagagaggttacagatctaaacttaggtttcaaagttttttaagtgaatagaagctaatatagattaattgggaaagaaatgctgatataaactaatgaaaacattcattcattcattcattcattcatttagagatggagtctcattctgtcacccaggctggagtgcagtggcgccatctcggctcactgcaacctccaccttcagggttaaagcgattttcctgcctcagcctcccgagtagctgggattacaggcatgtgccaccacacccagctaatttttgtatttttagtggagacaaggtttcatcacgttggtcaggctggtcttgaactcctgacctcaggtgatccacctgcctgggcctcccaaagtgcacaaagcttagctaagtaagcagagaagaagtcactgtaagaaaagtagctgcagagtaagagtagcaaatgtttgtggttgatatgtagctttgaaataaattgtatctgctggaaataaattgtatctgcttccctgctaatattggattttaaggaagattataatcaggtttcagtccttcctccagtttccctctcaccctccagtcggccttctctcactttgctgcccactcctgccctcaggctaaaagaaaaacaaaaacgagatcttattcttctgtctcatcagtatccttctctaaccgcacttcagtatccctgtcctctgaaaatatcaagtccacagggtaaaagaaagactgtgtggttagtacactttgtgagcaggacccggaaggccctggcagaagctggcactgttccacagcctccactgcactttcatgcctggctgctgaaggatttttttaaacttcttcggcattttgtttaatttatgactttatacctcagaagtagtgaactgacagggtttgaattttttaattacattgattaaacaattacttgaaattccaaaactttgctggtttgaagtttatagtatttctatttaatatcagccttggaaataaataaaagttgatatacatgattctctgcctgtatactcatgcatctacatgtaaaataataatctagtctgtggaagtatggtcttaatgaaaatatcaagttttaaattttggtttatcatcacaaaaactatagaaggatatttttgaactttcttacaaggaaatgactttctacatctgtactgtcttcccccctcatgtggctgcttgtgtcctttaggttccagtgatttttataccgccatgtagtgtgtcatgaaagggagaatagtcgagaacatcaccaactccttatggtcgtaaagcttcatacagccattcattgttgttttcatgttcttaagtcttagtaaaattgagcaattttagtaaagatgacattgcgcacctccaaataaaaatacatggaccaaaattccagaaccagctgatttcttacagtacatgtgtaatgaaaatgaaaagcctaactctacctttttattaactattattttccaagtattctcttatctcctgtgtactttttcctgtgtctaaagccattagtcagtagatcactgctggagacagtattaacttgttccagtagacagactgagtattgtacctgatggtacctggatgatggcttccaaagacaaatttcagtttgatgtcttaagtagactttattgccattagtgacaacatagaagctgaaaaaaagcaggcaaataatctcgtgtagagaagaatatttgagacagatacgtaattatgaattcttccttcctttttttactgaaggccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtaagctaaggataaagtcctctcattctcattaccattatatgtaatatttcctttttgtttgtttatatgggttactatttgtatcctgtaaatgtaagcagttcttcagtaaccagaaatcttaaaagccaaaagcttatttttatcttttccatgttggaagaagaacaatagtgataacagctagtataatatgaattcaaggcttgttaattcttactcttccttaattcttactacttcattctctgtgaggtgagtgttatccccattttacagagctgtaaatgaggctttgtaagttgagtaatttgcttgtgttacacagcaaccctgtgacagaaaattcaccgaagtttctccaaacctatgttcctaactaatctgcactgttcagagaagatcctctgagcacttgtcggaggggattggtgaagggattggtctaggtgacctgcagagtcctttgcaattctcagatgccttcattctccgattgcttgttcacatgtaaaaactcataatagtcattttgagccattctgtgtgtgtgtatatctatatatagtgttatatcatgattgttattggatcacattgacgtatgttacaggaagtaccaaggttggaggttacagaaagttagaactaaatttgagctttttaatgattagaacatatctttgcttcttaatcgttatactaattttccaaattcaactggttttattatatgtgataagaaacggttacctattcttagttggctctgccttttcagtcactttttatcaaatatctctggctcaccaggagacgagtagtctagccatatgtaaataagtagaagtttcaggcctccctgagcaggaaggtaaagtccagtgatactgacatatccttcctactcctccccttccccaccccatcaccatcccaacctgtgataattcgtcttgtttggttagttgagagaaaaagcaaaccttttcagttcaagaagaatgaaaagattgtgttatgtattgtgtcaaattgaaaatatttatagttccttcttgacgtgtttgattataggtcacaccagatgtattacatgtttggcttcctatttctggtgtttatcattttggttattacctgttctgaagcaactatacttctttgctatttccacctatgtgcagaggtatgtattagcagtattcacttatgttaatttgtagacagtaactttggcatattgcaatttgtatattattaattaaaataatttctgtagatgtatgtttattatgatagacattgacctgtattcctaaatcaaatgtaaccttctttaggattaagatatcccagttcagtatatttagttggaaattactattagagactttaacttgttaattttctgagaatagtatgttgtgctaactttttactgttgttttttaactgacttaaaaattaatacttttgtgatacaaatatttatatcatgcctgagataaaagaatataaaataatctattaaaaaatacaaaaaaaattttagactgaaaatttaataaaagtaaactagtaagaaaattcattaaaaagtttctataatcacattgtaatgagttctattcatggcagcaccaaaatgatagtatccttatgtaataggtagaattgaattttaaagatttaggttgtgttaaatctactatttaatatttattgtctatattggagaaaaagctaactttattaaacttagtgtgttattcaaaaaatggaggttaaatttacataacagaaaatgaaccattttgaagtggacagtttaatggcacttactgcatttacagtgttgcgccaccaccacctctgtttagttccaaaatatttttatcacccctaattaaagccctatacttgctgagcagttgctcctcattcctcacttcccccaggccttagcagccaacggtctgctttctgtctgttttgcctgttcagacatttcttacaaattgaatcatataatatgtgaccttttgtgtgtggcttctttgacttagcatgttttcagggttcatcatatcgtggcatgtatagtagtacttcattccttttttttttttttttcctttttttcttgagacggagtctcgctctgctgcccaggctggagtgcagtggtgcaatctcagctcactgcaagcaccacctcccgggttcatgccattctcctgcctcagcctcctgagtagctgggactacaggcgcctgccaccatgcctggctaattgcttcttgtatttttggtagagacggggtttcaccatgttagccaggatggtctcgatctcctgacctcgtgatccgcctgcctcggcctcccaacgtgctgggattacagacgtgagccaccgcgcctggccacttcattcctttttatggcagaatgataaatttgtttatccatttatccattggtgggcatttgtattgtttctactttttggctgttgtgaatagtgctgctgtgaacattcatgtacaagtgttcgtttgaatacctgtttttggttttgaggtatatatctaggagtggaatcactgggtcatatggtagttctgttcaattttttgaggaactaccaaacttttccacagtggttgtgccgttttacattcccaccagcagtggtgtacaaaggttccaattctccgtatctttgccaacacttaccttccatttttgaaaaaattgtagctgtcttcgtgggtgtgaagcggtgtctcattctggttttgatttgcatttccacagtgactaatgatgagcatttgtacttgtgtttgttagccatttgtatatcttctttggagaaatagctattcaagtcctttgcctatttttaaatttgtttgtctttttgttgagttgtaagagtttatttatttattctgaatagtagatctttatcagattgttatttgcagttctggttctataggttatccttttcactttcttgataatgtcctttgcacaaaagttttaaattttgatgaggtcaaatgtatctgtttttttttcttccgttgcttatgcttttggtgtcatatctaagaattattatcaaattagggctgagtgtggtggttcacgcctatctctaatcccaacactttggaaggctgaggcgggaggatcgcttgagcccaggattttgagaccagcctgggcaacatagtgagatcttgtctttataaaaaataacaaaattagctgggtgtgatggcttacttgggaagctgaggtggaaggatcacttgagcccaggagggcttcagtaagccatgattacaccactgcactccagaacctgggcaacagagtgagaccctgtctcctaccccacccccgaccaaaaaaaagaattattgccaaattcaaggttatgaagatttacccccatgttttcttctaagtgttatagctttacctcatgtatttaagtcattgatctattttgagttagcttttgtattttgtgtgatgtagtgtccagctacattatttgacgtgtggatatccagttatccagcaccatttgttgaagaggctgttctttcctcatttaatggtcttggcaatcttgtcaaaaatcaattgaccatagatgtatgggtttatttctggactctcaatactattccagtggtctatatgctgcccttaggcctgtaccacactattttgattactgtggcttcgtagtaagttttgaaatcaaaaaggctgagtcctccagctttgctcttttttatgattgttttgactatttggagccccttgcaattccatttgaatttgaggattaacttttccaatctgcaaaaatggaatcattggattattggaattatgatagggattacattagatctgtagatcattttgaagagtattgctgtcttaacagtgttaagtctaatagtacgtaaacatgggatgtctttccatttgcctaggtcttctgtcatttctttcagcagaattttagagttttcattgtgcaagtcttccacttccttggttgaatttattcctaggtattttattcttttgggtgctattttaaatggaattgggtttttaaattttcttctcagattgctcattgctggtgtgtaaaaacaaaaccgacttttgtatgttgatcttataccctgcaattttgctgcatttgttgattagctgttgcatttttgtgtgtgtgtgtgtgtatgtgtgtgtatttaggattttctagtctcagtttgcttttcgaatatatttgtttttcacatattccaaagggcaagagagatagtgaagtgttctcttttaaaagatcttctgttaagctataagccacttaaaagcaagaagagctattttaatcatctgccttgtttaaattatgttagtaatagctgaaattggattccaaccaggccttagtagaataatcttcttcctaatacagagttgaccagactttaatacaagtagtattaatgtcgagccctgtgagtaagttgtaagctatttgcacatcgcttttctttgggaagaataaattttgaaatacagcctaatgttttattattcataaacagtttaagctgcttccacacatttttagccagtttttaagcagccccaccaaagacagtgggtgcttcttagcacctttagtgaggagagtggaatgggtgaagttcaataggagaaagagcctggaactgatagcagaaattagattgggggctgtctcatttattatgcttgctttgaaccttagtaagctacatcttatctattaattggaatgtaattcttgttcttttttctttactacctaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggtaaaattataatttaagtgattatttttattttgtaagtttttagacaaataacttataaatgtttgtcttttttaaaacccatgaaggcttattctgttagtgctcccatatttagtcctcagcacaactaggcatagttgggtctgcccacctgtgagttgcataaagatgatgaaacagaagctggggaagaaggctaaacagggtcataattgtggtaaaggttcagggacgcatgggccagtacagctcatggttttcgtctgttaacctcttaaaggtacacacagtccttttttttttttttgccacttcagaaatagggtagaagctatagtgacttaagtttaggagtaagtagaaattgaggaggtgaagtcaagatgaggctgagagtaggtaggggatatcaaggaaagataatgggacattccttaatctagaagcttttatctccactttaaaattcaagcattgaacaggatatagtgtgtattttattggtatttattttatatatgtatatatcttctctatccaactagatgaaagttttcggtatctcacagccccgggtgcttggtaaacatttgtcgcgtgagtgactgaacttaggaattatagcaccttcctttgtcacaagtaacgctgcccgaagcgtgcatctaaaatgttagctcctcacgcatgtcatggaagaaaatgcaggagccaaaaagaaaaaagaacaagtttttttcctccaattaaaactgttctacttttcactcatctgttagcatttcagagcctggagtcgggttttgaagggcctctgctgctctctcaggcttaaggcacttccatcgattctgtattccaggtcattgatcagacatggtggggtgcgtgtcttggtgctacgtgataaatttaggtccagagctgtaaattttaataaatcatctataaaacagcagtagccagtgaaacaaggaatgactgtttttgtgccctgtgtgtccataaatgcatatacagaataatttattcctagcctacacacaaaaaataacgatcattgtgaatatctgttgtttttccagacatatgatacagaaaatgatagcttaaccatcacctaaattttatttatttttatttattttatttttatttttttgagacggagtctcactcttttgcccaggctggagtgcagtggcgcgatctcagctcactgcaaactctgcctcccaggttcacgccattctcctgcctcagcctcccgagtagctgggactacaggcgcccgccactgcgcccggctaattttttttatttttagtagagatggggtttcaccatgttagccaggatggtctcgaacccctgacctcagacgatctgcccgccttggcctcccgaagtgctcggattgggcgtgagccactgcgcccagctgattttgttttttaaagtgttatattttcattcattcagagttgaattttgtaatctgaattatggagtcatatcaaatggaaccaaccagttaaaccagtaacttatagtgtatttcactttcttcaattgtatttttcctttagtgaacaggtggaagcattctggataagggagtagtgagccctttaaatgccttacctttctctaaaatagggtatggtctgtatttgcttcagtactccagagcaatgccattttattgtatttaagtcaatccattttacaaaacagaagtaattattctgtcacaaaaggaaagacgccacttttagtacgtacatatattccatattaagaacaaaattaagtaactaaacttaagtttcttagagttgcctggatagtgattaaatgttcttctcatcttaaaatattgtttgtcatcttgaaatttatgcaagtaagtacaaagttatataaatatactgagttttcattattgcttttctgaaattaaccccagccctagcctgaataattatccttttgactatgcaaaaggtatatttgtatgtcctccaaaacacacattgtgctttgcatatagtagggcctcaatacatgtacaatgtaaggatggatataatgatgtttgtaatttcccacggtaatgtcccatgtatagtctcttgatttagaaaatctcctttaatattttctcagagtactgcatttaaaacaatggtgaaaaccattgggactttaaatgtaaaatttatacaaggattatttatagtcccttatgtgtgcatgtgcaaggagtactatgcttgaagtcagaaaaaacgcatttgatttctggccacaagtaccatccatgtgaccatgagacagtcacttaacccctttgaacctcatttttgtctcattgaaagagtgtccccatctagcattcaaattctttggaatctagactgatacctgaaaatcaagccatacattgttttcatgaattatctcatttactctacataatagtctatggaggcaatgaggacagataaatttctccctagttaatatgataaatgggcttggagatgtcagtggacttgcccaaggatgacacacacagtttgtgacagagctgctctgttctctgctaccatgctgtccctcattttcagctaggatgcatttttgttactatctaatcatgtcacttttaacattttgtaaaaacttactgagttattttattataattctttgaagactgataacttccaataactgtacttagaaaatatccccatttaatcattatttgaacctgttttaatgtattcatctcataccttaaaaaattctagtagcgttttccattttgttgtaaaatattcttaaataggaaaggacagttgacatccttcagtcttttctatgtagtaaggaaaataatgtgtattgtagaaagcttaggtaatcttatagtagaaaaaagttctaccaatttttgtaagaaacttgatttgaggtggtcgtatatttttcagacgtgctcatagatctgtagtatattcccggtgggtaatagtttatagttttgcgacttttttaaggaaccagtcattgtaagtctgtatttttgtgtaaagtatgaaacttcctttgaaaaggggtttatttttattttttctcttataggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatgtcttcattgcatcattacctattatatattcaaggaggttctgtaaatacagatctatttaccaaggtgttttgaaatgatttatactattttatcagattttactggattttgttaatgtaacactttctgagttttgatctgaatggaatttcactgtgtaaggcattgtctaaaatgttcactgtgaggcagtagaggaggttgaagtcatgcatatctagacagatgaattatctgcaagtacttaaggtggagccttactacattgtcattaaggagtttctatttttgacttgtttttcaaaatacagtgttttaagtcaggttttattacctggacattagcaatcactagcaagtcttcatctttatgatttcattgttttaatttagatttcacaaacagttttacttctaagagttaagaaatgcactgtctttcacattcatctgactaattgaaatccatttatgtagaatataggaatggggggtgattctgaagtatcggtctgcttgtatctgtgagcatattcatttgtattttagggtctctctgcttgctgcttaggagagcaaatcagatactgtcattaaacttacaactaaaattactagctgtcacttatatgatattgctgggttcttactgaataatttttttttttttttgagacagagtttccttcttgttgcccaggctggagtgcaatggcgagatctcggctcaccacaacctccgcctcccaggttcaagcaattctcctgcctcagcctcctgagtagctgggattacaggcatgtgccaccacgcccggctaattttgtatttttagtagagacggcatttctccatgttggtcacactggtttcaaactcctgacctcaggtgatctgcccgcctcggcctcccaaagtgctgggattacaggtgtgagccactgcgcccagccttactgaataattttatgtcactgtccttttttaaaaaaacggacctgttggttttgaagagtaaaggaggagctctgttcatttttaacatggagtatttaagatagaagagtttctttcagttttatgtatctcttgtatttattttttatgggtagagttgtcccttagtatttatgggagattggttccagaacccttgtggttaccaaaaatccatggatgctcaagtccttgatataaaaatggcaagtatttgcaaataatctatgtacatcctcccatgtgctttaaatcatctctagttgactcacaatacctcatacaatgtaagtgctctgtaaatacttgttatactctattttccatttgtatttttattgtattggttttttaaaatttattttcgagcatttttgatctgttgttgcttaaatctgcatatgcagaacccccagataaggaaggccaactgtaattctcttagggagctgttgagataggctggttgactcaacaaagagaaggttttagtttttaaaaatcctgattgagacaccagattagtttttattggccaaagttaagtttcttcaattttatttttcctttagtgaacagttagcttagtgatttaaaagtcagctgatagagttggtgtaactttttcttcgtttt

SEQ ID NO: 15366 - DNA, 20221 bp, Human
cgaaccaagaaacacctaaagttcagtcagcatcaggccttattttagccaaactgattttgcagtaaatttttctattaactagactatttaattaaaaattattccattttaaataagaattattcgatattatctgaggatacatattttttaactgtatgaaaataatatttttaaaagggctaggagcccggcgaggtggcttattcctgtaatcccagcactttgggaggccgaagcgggtggataatctaaggtcaggagttcgagaccagcctgaccaatgtggtgaaaccccgtctctactaaaaatacaaaatattagccgcgcatggtggcgcgcacctgtaatcccagctactcggaggggtgtggggagctgagggaggatgattgcttgaatccgggagacggaggttgcagtgaaccgagatcgcgccactgcgctccagcctgggcaacaggagagccgtacccccggcaaaaaaaaaaaaaaaaaagggggttagggacttaacaatgttgtcatctttatttaaaatagtgtgaaactgttaagtaaatatacttgcagaatgcataaaatataaagaagcagttctaatttttgaaaaccattagagaccatagacatttgcaatgtaaaaggctgcagcaaaccaatttacagtaaaagttgaaataatatgaattgtaaaaatatttctaaactgaccatgataaaatgaaaaactcacaggaagacaacagaacaatcaagatgaacataaagtaattcttgagcgtggggacaagactatgaaagaagtgagaaatgtacatgcactggtcgctgtgagatggggagagactgctccaacagggtaaatcttagagactcaagaagactgactacgtgataagtgactctcagacgagaagcattcactgatgaaaactctggcttccctttcctttgatgttgcaacagttctattttccattctttgtgaaacctggagattactcttcacaattgtattttaacaattctgctgacgcggcaatcaggtgggcaaagggaaagatcagtggcgaagcctgggcagcaagggatactggaaatagactatgagagagattgagagattacagtcagcagctatgtgtcaggagggatgaggaaatccgagttagaagcgctgagcagtggtgcggcaggaggcagggagggtccggaggaaaacagtaaaagggggcaggagtggcagagcaagcgtgtgacccacaaccaagggaggtaaaccacatgaggagctggtggggagcagactgaggcgctgtgagggtggttaggacaagcccgccctcccaccctactttttcctccggtggagaggcagcgaccagtcacctggagtgtgagttccggagggactcgatcaggcgctgcttctgctgctggaggctggtgaggccaccgggggacccagccgcggaggaggaggcgctcttggtcaggggaaaaagccagctcatcctcctcgggtccacgggccggaggccctggaaggctctggcctgcttctcccagtggctcggcccggcggttctccagcgacagaggagcggggtgggacgtccgtggcccaagcgctggggaccgcgtcttctctaagcctgtcctgcctgcgctccccgagttctgggggacatgctacgaacggcgggcggctggagagggaaacttgcggcccggaacaggaggtcccaccttcacggcccagacgcccaaaccggccagccagggagcctggccgcccagcgctccaccacccgcgccgccgtcacttgcgtgccccgcccccgggggcgctctccgccccctctgcgtgtcgcgtcatcatctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtagatcttgcatccgctgcagccttacggggggaggggcgggttagggaagtagaaagggggcggggacgatgaacctgagagggtgcgcgatggcgccagctggagtgcggctggcggaggaaggagcctggcggcgggttgggggctgggtaactggggctgggggtttgtcaaggggttggcgcgtagtgatgacgcaaaggctttgtacctggggcttcgcagtgggacggaaattgggagtggagggcggtggcctagatcctcacctcttcgtattgtttcacgcggcagtgcttgggagtcagtgtagctccagtcagtgttatcagcaccttcgcactggcgctttgccagggaagagagttatctatggcttgaatacctcggtgccgtcctctcgtttctctgggaaactgcagtacggagatgctatctccagtaatgagaaggcctttggtgtctcttcggggcttctgggactgcagtagagagagaggtggaggaaaacaatgttagactacagggtctttccaagtctttgtgtttttgtgcttatgtgtgtgtgtgtgcctatcggggtgggagagttataaaggaggggtgtcctggatctcctttagtttctctacttggagaattggaagttacatttgtgactcttcagagtttagaagacagtcataagaccctctttttactcttgttttttttttttccaatttgtatgaaaaatgcagaaggatttgaaatttccctgcccaagaatcaacaggaactctgtttatagaccagaaatgtgacatctatctttggtaaccatgcaatatgctctaagttttagacgttctattgtgttctttttccgttctgcaactgcgaacattcagataattttcatggccgttacttttttctcagagcatttacaaacatttttgacccctctagtctagttagaataaacgccggtaaagtagatcttgttatcaagtcggattttggttgttttattaatgaggaataaaaataaacaccatctttgccatggtaacatctgatcttgtcacatgtaaataagtaatttttcattttttgtctggaaatggatggctttataaagttttatgcagagtagttgaactcagataaataattagtggaaagttataaaatatgattagtatgtatgtgtaaaaaagctattttaaaataactgaaattaggaccaggaaatctgtactgtagtcctttttttcctatagactagctgtgtgaccttaagttactttctaaactttgattttttttttttatgagtcaagaactttgaataaataacttcttaggttcctgctggatcaattattctgtgattcagatttgatatatctggtcttcatattgtttttttattttgacaggtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggtatgcccacaagcagatctttaaaacgcttcatataaaggaggaaaaggaaattttaaagtcttgaattcaacccttttggttgatatttttagggattaatttcaccatgaaaagtaaaatttgtcactgccctccagccaaaatccatcaggaatacacctgtgatttgacaggttgggtttatccctcattgcagtgagggaaaacgcactggaattcatgggaaccatgggccgtttgaataagagttaggaaggatttgggctcgtgtcaggtggtcttaggggaaggtaagggaagcagggctttactgtggattggatgtgttcgggaagctggggtaattctgtgattgggtatcttactaagtcttaaatgagagactagaatgaggttaaagctgcagagaaggaacagtcattcatttagccaggatggagatacttggtcattttgtggtttgacatttttatttttttgtccttgttcagacatgattacagagtggccttatttgaggttgaacttttgtgaaattgtgttcaacaggagaacattagggcgtggctatgagtgccaggtctgctcctagcaacaccaaagcctagctggtagtaccacatgagctcccagaagctagggtgctctttctcaaacaaaaaaatcagatgtgccagtgaaacgttgttggtctgcaatttgttttcataattaacactggagttctgtgaatatactgtgttactaagcaactctgcttttgcacgtgctgtttggtctgcctagattgtctatccagttaatgatttttcttctttaccattatactgtctatatctgttagctaccctactgttttctacatccactggattattattagctccataaaccaagtgttttaatcctttctctcccaacacctagcataacacatatagtattcaataaagtggctgttgaattgcactgaatttagagaaatattgatttctttactatttcatagtgacttgataggtagtttttattcttagctagccctagtttgaattctaatactaaaccgatgtatctttgtctcagtatttttaataaaaataaacaaatgcattactttggggaggagcaagttgattggttaaaatatgactgtttctttgtagatgacatactatttgataaaggtgtacttacccatgattagaactaaaattgttttcttaaccaatggaaattcatagtgatcattgatttctcagatgataaagagtggcaacatagagaagtgataacatcctacaagagtgagtaggtggcatgcaattcttgacagcatgctttctgtggactatagagagaatattgtttaagccagagaaattaggaagctaatgatgtttttcttagggttttggtgttgagaaaaaccttgtgtcagagaagcaattggaaagtacagggcgttttcccctcttttgaaccagttcttcaagaaacttggttttagcattggaatactgtgagcatcatttcatgtatcctttgggagacaggaatttatgattttcccccctttcttggttatagagtaagtatttggttaaatttatcacatgtatctcgtatagtaactttttggatatatttaaggaaaggttattaagtttatagagttttatggttctaaaaagtgatgttctttctagttaaaatatactttgtaattgaatataaatgtgtagaatatcatctgtaggattctttgatttgcatcaaaaattaaaaatgtgtggattgtagttttgactgtttagtacataatgaatcttaaaactattttacaggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacgtaagtgggaaataactgtataacccagacttttttttttttttctttaatcttaggaattgattttcctcaagtatggtgacatgctaggtgaatttggtgtagttatcctggaaatatataaaacgtaacatttcaaaagcatggttttcttttttactatgggaccaaaaaaaatactttgatgttaaagatgttatatttaaaatatgactgcagctttttttgtatttggaagactgggtattgaaagtacttctgatagaaaaaataatcctacattagttttactttcaaaaattttgtgtgcaatttgaaatatagccttttataatatttatccttcttgtgaagatttttgttgcattcatattccagtttatgagtagattacatgtcaaatgcagtaagacgttttctggaaccttgggtacgttttcctttcaagtcagtattatcattaggttgccacttcagcccacaaaagctctcttaatttacatataggagaagtagtagtatccttgaacctggtgtttatcatatgtcagaatcttcattctaactcaagccctgggtcttcacccagtttccttagttataatatttctgtattattaatagaagtagtcttgatagctaagggaagttttagatgtttttagagaggggcagattatttgcaaactaagttgggtaaataaaataatacattcttattacagcaggacctcaaatgacattttcttcaacattgtttcatggtaaccttcataaaaaataaaattgattcctgacccgggccactacctgagtggagtgtgcacgttctcgtgtatatgtggattttctcccgggtcctctgatttcctcccacatcccaaggctgtgcacgttaggtgaaatggtgtggctaagttgtcccagtgtgagtgagtaggtgtatctgtgtgagtgcactgtgccacggaacgacatgctgaccagggttggttcccacattgtgccctgagctgccagaataggctctggctttcttcacccctcaactgaataatggagcaaataattatcttgtttttattaattgttcttaaatttacatatagctcacatttatttcattgtttaatattagaagtattttggtctttatctagaagtttgatgatttttttgtgaccagaaatatgccgtaggaacttaactcttgtttttatcaattagcctgtggtaaaaattggtttcgttatccatcttttggcttaaagttgcaatttccaagaacttattgataacgttgagtgagtacttaactgtatgttgcaatattgcattgttcttctgtttgacatcctacatttgtgtcatacatcctaatatctggtaggtaaaatagtgaaagaaactgtaggcaattaatggtagtgccaatgtatgaattctttcttcctgttctttgtcagataaacaaagatatttagtatacacaattttacgaaagtagggcttaggaaaagcagagtaatgatgcctgtggtatagtagtgtggcttgtaattacactgtgtttagcctgactctccatttcactcttttgggtttaataatatactctccatttggagaccaaggcaggaggattgcttgaggccaggagttctagaccagcctggtcaacatagactctgtctctacaaaaaaaaaaaaaaaaaaatgaaactaagccaggcatggtggctgtgtacctgtagtcctagcactacaggtacaggtacaggtagctagcactacaggtacagggaggctgaaccaagtggattgctttaactgaggtgttcaaggctatagtgatctagattgcaccactgcactccagcctgggcaacagagtgatactttgtctctaaaaatacctgtatctatacacacacgcacagtctacagaaccttgtaaagtaaacttgtccaacccttggcccaggatggctttgaatgcagcccaacagaaattcgtaaactttcttaaaacattatgagatttttttgttgttgtttaagttagtttatttaatgtgtggcccaagacagttctttgagtatggcccaaggaagccaaaagattgaacacctcatttataaagggtgcaaagtactccactcaaactgaaaaccttttataagaactacatctgtgaaacactgaaaattgcctcctatcctttttctcaaatgataaacctttattaaaattagtgctttaccatttcatttgttccatgttaactttttgttcaagtgaattagaacattgtttttaaattagatactattgtgatctcagtacgtgagaaggaggtaacccatcagcttctcagtttggataaaattgacagtttccttttctagaaacacctttgttcgagtaacaactgctttcttagtacagcctgtaagtgacattttttctttcttactcaaaaatgactgctaaagtttactaccaagttttgctaccatttacactaggggtgtctaatcttttggtttccctgggccacactagaggaagaattgtcttgggccacacataaaatacactaatgctaacaatagctgttgagctaaaaaaaaaaaaaatctcaaaatgttttaagaaagttgacaaatttgtattgggctacattcacagccatgccgggccacatgtggcccactggctgcaggttggacaagcttgatttacactgatgttaggagatgtttaaggagaaggatacagtgaaaaacattaggtagaagaagtcatttggaagataaacgagtaatgcctaatatagagagagcaccgtgaagagaatcttggaaatttggaagaaagatcaaaattgactttttaatggggtggctagaatgagtgtcagttacagtgctagacactagggatttagtactgaggaaagttggtcgtggtctttataactcagtgttttgtaactcttctgttttctctctattgcctaagtctaagaattacaattgtaacgtatgggaattctctccaaactgaatttggagttgatacatccatgaaaattgaagtggagtactgatgagctgtgaagaagagaagcattctgtggaaataatgtcactgataaagaggattaaaacaaatttttaacaaattctcacttttaggctgggcgtggtggctcacgcctgtaatcccagcactttgggaggccgaggcgggcggatcacaaggtcaggagatcgagaacatcctggctaacacggtgaaaccctgtatctactaaaaatacaaaaaaaattagctgggtgtggtggtgagcacctgtagtcccagctactcgggaggctgaggcgggagaatggcgtgaacccaggaggtggagcttgcagtgagccgagatgccactgactccagtctgggcgacagagtgagactccgtctcaaaaaagaaaaatcacttttggtgattgcagtaattcaataggatagtagaaattacagggcaccttgggtttggtggtaacagaaaggatgctgatgcttcatttaaggaaagtggcagtgtaaagaaggagatagagagtgccataagaaggaaggctggatgcagtagcccattcctgtaatcccagcacttcgggaggccagttggaagccagggtgggcagattgtttgagctcagtttaagaccagttcgggcaacatggcaaaaccctgtctacaaaaataggaaaattagccaggcatggtggctcatatctgtagtcccagctacttgggaggctacaaaaggaggattgcttgagtccgggaggtcaaggctacagtgagccgtgttcaagccactgcttcctggatgacagccagaccctgtctcaagaagggaaagcagaatcaacagaatagtggtttttattttgttttacagataatacacagacatatttgtgtgttcatgagttagttaaggagttgtatgttaggataaagataggcacttgacaagtcctttgaggaatggcatggaatagcgtctaaggcattggtagcaattagctttggcgatgaggcaagctgtctttgtagtctaagtaagaaagatcttcacatacgtagatgtaaagaaagacaggaatattaatctgatgtttctttgtaaagcaggtatggggtgaagccatatgctgcaagtagacaggtgaagggtgttattggaaacttaagagaaaaaggtctaaactacttgtatacctataccttggcaaatggccaagaatgatgtgcacctggagaagaatctgttttttatccctttcattgcttatagttgctaaggcatgcctcagtgtgagcactgggacctgatgaatgagattctaattttttgaggtacatatttttagcataggaaagctgtggtttcactggaaaaaaaaaaaaaaaaagaaactacttcattgggtttattctgttacccttcctaaaggattttccaggggagactgacttttacgtgattgttgtggtttccttctcttttaaaatatttccattgttttgtaatttttcagacatttagaaataaattgatttctaaaggactaaccataacgatactttttggcccaagtgaagtgaaccccatggtttagatttgtcaagtgtttaataggaattccttttgccaagaggtagaaaccagtattcttacaatttaaaaagtaaataaaaaaacactttttcacgtattctcaaaaatgtatctgtattttggtaacttttttgttttaatatttcagatacagatatattttggaaacttttaatatttcagatacacatatttgtggttggaaatatatttgaggttggagatggctttctttttggcttaagtgaaatcttgaagaattggtttatatttagatttcctggcttgattttataaggcagtcttttaggaataggattgttggcagaagaaattattgctattacagtacagtcctttatacagtgttgcttattggaggcatttgcaaggctcatttgtgaaaggaggcatctccttctttaagatgaagtgtagtttaactcatccgcatgagacattttccactgggtctccttactggtgctgctgagagcacgggagatgggcatatgccccacagctatggctgcagctccatctgggagcattacagtggctgctgagactgagagtctctgaaaaaacttgtctgtcactttgcgacggtagcccctggtgaataggagacccttttccaaacccagttaaatgtatttaagtatgaaaggctaatagagttaatagaaaaaagattaaaattgcacctttggactctctgaatgattttttattcgaaacacttttctgaaataatgacctttgtatttaaattgcatttttcttgcatatatataaagcattgaaacaggtggactcaagccattcctctgtctcttttctggcactgtagttatagatgtaagcagaagaacagcttgtttgaagtaatggcatgtttgaatgttgtctttctctttcttctgccagggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcataggtaaaacgactacattgaaaatggcatttgtttttccatctcatacttgctccacacttacttgggtcactatgttagcaatttcaggtttaattctggaaagagttgactgccatatagagttgtctcctaactcttaggaggctaatgttggtctgcttaaaggttaatttaaaatatgggatccatttttgcctgtgagaagcatgttgcatagtggaaacagtacaggttctctaaaaagtgaaagaccctggtttaaatccagcggcgccatttggaattggtgttacccagggttttcttttactatttctacaccttagtttttaatgttctacgggggaaaccattcacttacatttacacaacgttattgagtatttaccatatggcaggcactgagatgagattctaggaactaaggtgtgaataaaacagatgaaaattattttcctcatggagtttatattctcatgggggtgggcagacagtttttaaaaatggagttcacgttgtgatttgttagatagtgataagtactatctcaaaacagcaaagaaaatgctagggatgggtgtggagatggattttaatttttttttaaagtgataaggcatcccttagaagaaatagcttgaagacttgttttaatggtcaccaaaatactttataaacagtaaattctcaataagtggtggttctaaattctttattgttatgaaactagattatttaagagtgtttctggtaaggaaactattccgattttgtgaaatagacttccacgtatgaaaaagagttttcccatctaagtaaactaaactgacgttccagggactaaaagtaaccttcagaatgatattggcttttgttaggttttgaaaaagcattgtgttacatagatgttaatactctcatacttggtccacttcacacatgtatcttaaatctgagtctcctgcatgtttagtttctgtctctgatctgtgggatgtttatagtgaaggactgttcatgtgggcaactttgatgtgtactaaccagaaatggttgagttgtaggtactgaacacactcattcttacctatcatcttttttgtctcttctgcacttgaacttgtaccttaggaaacataacttaagactcttgatacaaataccttttttttagtcatttttcttccctagatatgaaggtgcaaaagaactggaaagtattgcccttcccttttactgtatatgacataccctttcatttaaaaaatactctgacaaaatacagtgcactaggcactgggtattaagatgaacaaaaacaaacagggttcattcatgtcttcttggagtttagaatctaagttagactgatatatttgaatatttatcaagatagaagattttattccattaaatatcattagttgttttcctcatattctaatttcaagtaataaagaatagtttaagaagtttataaatcctaagcgctaatataatcttttaatgttagtgagcaaatgtcatataggcttcctgttagaggtccttggaaggaaaggtagacaagggacggacgtgtctaagtggcctgggagtgtagggagacagaaagctgtgcgaaaggccggacaaagggagaagagttctggatttgagagtgtaggagtttgcattttatgatcaagagagtagttatttttttactacccttcacttcttccatgtgcagcatttccattaataatgactcttagggagccacactgaaaggaagagaattgtgaaggaagaaaagggagagactacttaacacagtcatttaagagaagtgaaaataccttgttacagtcttattctttggataaagtatatgaccaccttatgtaaaagtgggatgacttgcattacttttgtctaccgaatgccagttctcttgctacctttgctaactcttctggccaagtttccattcatctttatttctccatttccatagttactttaaaaaatattttgagacatctgtgggcagcttgatactcttcttggtgttctctattcagatatcaacaaaatagtattttattgaccataggctggtttggtagtgtaggtctgtgttgatatctctgaataataaagtgataaagttcttaatactgtaagatgacgacattttctcatagttctcaatatgtttgttttctctgttcttgtgtgcacttctctttaatgtttttgggagggctctagtgtgacttgcttaaatttgaatcagaaaaacttttttttttaatctttatagtatttatatgtccctcttctctattcttttaacccttttatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaagtaaggcttcggatggcattatctacagcagcacactgttcagaccaagtgactgtcatgagagcctaggctgggatgttgttttaaaccatattttaaagtattacagtgaatgcaattatattatctggtcatgtgattttttttcttgcatacataatttgtagggaatccttttttcagagcttcagtatgtcttggcagaaggcagaattttcaacacatttcaggcttaggtccggttcttgtcactgcttgccagattgaaaatcacaaaccaaaacacaaatctgaggacattgaggctctcatatgcacgccattgtgagttgttactttctcccaagacgcatagaatctgttcttacaaggtggaatctaaggtggccagcgatatgcagatgtatttagtagtgtggcaaaagtttttctttccttttggcttatcttggctagaaattattttgtcagttctagtgataggataatgctcctaggattaaactatatagctaaaagatttttctgtggccaaaagatgtcagcttgttacagttaagtactatgggaaatgtgtaggtcctgcctagatagtagtaacattttgacgctgcataacatgtatttttaaattctaaacattaattctttttttgtttttgagacggagccttgctcttgtcgcccaggctggagtgcagtggcgtggtctcggctcactgcaacctccgcctcccgggttcaagtgattctcctgcctcagcctcctgtgtagctggaattaacaggtgtccatcaccacacccagctaaatttcgtatttttagtagagtcggggttttaccgtgttggtcacgctggtcttaacagataactgaagatgagaagctttcttttggccagtgtttacctttaatacatgatatggtcagcatatgactagagaaattttcaagaaagattattttatgtttgtagcagtagacttctgtgtaatttgaggggacttccaggaagtgaacttgcagtagggtatcccttgcttgagaaattcagcccaccctgtgaaagcactgcatgctgaggcctacatgttttcatctgactttttttttaattgacatgtctgtataatgatagttttcaggaacagggaaccaaattattgctcatcatgtggttgttactgggaagtttctaagtacagatattctgaatgtgtcctgagtaagctgctgtgttaaaattcaggttaacgacaaaggtgctttttgacctatagtcagccatgctgttctattcagttctagttctgttctcctaagcagctgctaacgatacctaatcctcgtgctatttttagcgcagaagcaactgctgtgcaaagccttgtttcaagctgtgatgcacagaagggccattttgctggtggaggccttaacaagttagagaagaatttttgttttgttgttggtgtttctttccttcacgctctacttattctcccctccctttactctccttgcctgtcctcccactttctttccttctgttactgtctttctctttctttctttccactctttccactctcatctttcttttttaatcttaggagtattaacataggtggattatagcagaccactctaaggagttgtgtgcatatactcgtcttaactaagaaaaccatagtgaagcatttagcatactcttaatgattattcataatggctttgttttgtaaaaattaagtgaaaactacaaatggatggtgggaagtttaagaaaatatgaaaaaaatggtgttatactagcttttcagttttataattattactggattgatagactatgagtgtacttgataaatattaccctatatatggtctgcttccttcccatatctaggagagtatttacctgtcatatgccctaaaacatgatgaaaatacattttcccaattaggatcttgttttctattaaatgatactttttccgcattcaacaaatacattagtaattcacattctctgtttcttccccccaatctttataagattcacctttacatactaaagtttatttttattttggtcagcgtctaagtttataatttgtgaatttaggccttgtaagatttttcttcttgacaagcaattttttattttttctagggtggattacaggaggtggcagaacagttagagctggaacggataggaccacaacatcaggcaggatctgattcattgctcacaggaatggcctttttcaaaatgagagaagtatgaagacatcactgcctttttctcagttggttgttaggttgagaacattaaaaatcttgtggccaaagattttgggcaacaagtacctactaagtaaagatataattagagataccatatgagtcacatccaccacacttaaaagtattcaaaaataagtcatcttgaaatgtagttcagaaggaactgggagaacatgttcatcatagaaccaacaattttaaaacataaactacctgagaagtcatgtaggtccaaccatattatttctcaggtgagaaaacaggctaataacttccatgattaaacacattactagtgggagaactccagagttcttttctgactcccattggtgctccttctacgaggcaaggaatctttatattaggtttattctagcatgaccccttttaaggtttaaactggtgataaatatattatttgctcatgtcattcttcagtgctttgaagattttatagagaagaactcaggctcttttactgcattgagtcttaaaaggggggttgaattccgaagggatcaaataaatccaacgtagtagttgcatcagaaaccatattaggaaaaccctccttaaacggcaaaaggcagagatcagttccttgagtataaagtgttagggatggaagaatgaaactaaatgaacccattatctactcctaagtaattaagtgatgtgcacagatacacctagctataggtaaacaggaaaattggttgtgcaaaaaacaagtgaggtttttcttgactataagttttcccttttggaaaaattcgctgtggatttgagtatattttctcttagacattaaattgagactgagaatttaaaactttttgtagcaatgtattgataatagaaagcattaaagctgttttgctaagtagtgttgttgattcagaagtgatttggactatccattcatgacacgtaaatattttgttttggactccttccaattgtttcattagataattgaaacaaccttttggattttttagctttgcattttaaaaatgtcttaatggtttatttaactaaaggtggatttctggcactaatttatctttatttttcttggcttcttcaaggacagtaatagagtgtgaatgtttggattttactgtccatgactttatggtttgatcatttatagccagctcagccttgcatacagatttaagacagtttatgaacctaaactttttttcccccaccatcattggctttcttcattcttgagtattgttaaattaatggaatagttatttttccatgatgaaaaattcttataaaaatggtctaaatggaaaagacatgcatttatacactttttttgtagtctctttctttggtttctgagctctgtacttttgaggacattagtcttactcattgaactgaaatgcgtagcctcaaaggaacaccatagaaaagagccatcattattgtcagtgaacagtcagtacttacattgctgaaatataaattacaagtggttccttttggttaaaattatcttttttttttcttcaaaattcctttttagatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttacccttttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataaatgttgatgactggtgattttcttttggaaatacttatttgggggatattgttcatttttatttgggcaactcaacagaattcagtaacttccttcattaaccctagatgattattagtccattaattgaaaaatcagtctgagttttctgcatttcaagtgttggcttattcttgttctttatgagtacctcaactagctaattaaggactgacttctgtttctcctttccaggaatgcatttattccgaaggatatacttcacaaagtaaatacatttggtataactgtggctttttaaaaaatctaacacaatgtagtaagtttctaactggcttcttttgtcttcgttaaaaaggaagtgaagcttcttttcgcttgtgatttgttagctgagaaaactaatatttaaattctgttcaactatttgagaaatcaatgctggatttcaaataggaatgataaagattgcctttttattagccacatagttgctcaatctcataacttgtatcatttctggcttctgtccctaaaaagtatagataatccctaacttactttcgacttaatgatttttcaactttacagtgggtgtattgagaggtaaccccatcaaaagtttaggagcgccttaggaccaaagatggggttatagtttctactgaatgtgtattgcttttg

SEQ ID NO: 15367 - DNA, 69924 bp, Human
cgcctcagccccccaagaagagcctctaagcggcaagagaaagagggacgactctcggctaaatgtagctgagccagggcagtgaagcttgacaataatggcacaagagaggtggacctggcacatgcatagtcagcatggaggggatactgcgaccgagaggaggaatctagacccaaccccaggctccaacatggagtgagagttaagcagtcaattcatggggtcagaatgaaaagaaatctcacggtggggcaacttaggcagatttactctctcctgtgtgcatgctccaagtcctttgctcagaattctccccagaacctgacaccacattgcagtggtctaaatgcttgttcactccttaaaagtagccatgagagatgatgtctcaaccttcatagccgtaatgttaatcacatagcaaactcctgttgaaataatcacctagttccctttcttaataaacaagagatgctaaaacccagaaggttaagtgaattctgagaggcatggagagtttgtgccagtgtcagcatctgaactctggtctttattcccaggcaactgctctctgcatcgcaaggcaagcgagtggcaaagctcgggctagagctggcaacagaatatagaattcttggttcctcctgcagaagtgactgagaagcattagtttgttataaatggcagcacttctttcgttgggtgttgagggacaagtccctttcctgttatttagaattgagctccctttaatagcagtgcctggtgctgaagattacaatgagatgggctgcttctcaccgggggaacacacataggcatctcccccgctagcaaactgctttgatcatgagagtctgcaagctcagaaacgcaggatggctctctgcagagggacttgtgaaagcccgtatcttctgccccactgttacctgatagagttgtccaggttcttggcctgttgaacaaaaaattgaacgaaatgcacggagtaacgaaagaaagaagcaaggaaaaacaaagcaacagaagggaggaaggaaaacgtagatttatagaagacaattcacagagggcgctgcagcaagccacaagagcctgacgctccccagggattttataaagcgaaaagaacttggcaacacccttgggttccctttagaggcctccaactggttacaccttacgaaggactggcctgcgaccagtccgaggctgaagtggaaacttctgccttgttatcagaggagcgaggatgtggcctgtgtgccgcctaatcatgcctagaactgtctgcacctgctgatcttttgcttctgcgaactggctgcacctgctgttctcctgctcataccctagcccgtgcttaccctaattccctgttctcctgcctcaccaccagaggcccgggttgtctgcacagtctcattttccacgttattcctgtaatgaacccgtcctcccacccccaccagcagttacagggctgggtgcggagaccaactctggccagacacagaggagcagcaagaacccggggcaacggtcctgtgagtgagtgcatgtgggggagagaaatggaatgaacagaaataatttaggaagcactttttacagagcactaaggttctgcctgaggaggtggggcgggcgctggtaacatttggacaatcgtggttaaaagtgaccccatcagcacccgctgatccttcttgaacttgataaccttggtgaaaacgccaagcgttggagaaattcaaggaatggctgttgtaatgtacatttcacgcttagcctttcctccccgcgctgggaagaagtgctgcgcaccgcggctccgccagggggcaggagaagtcacattacacagagaactaaaaaaaaaaaaaaaaaaaaaaaaaattccccaactttttcccccaaaccttgttcctcctcaagaaaccgaatcctcccgcttcggcgtcccaggagcccgcccctcgcccgccgcctcccctgcgtccccgccccgcgcagccgccgcgctcctgcgctccgaggtccgaggttcccgagatgaaggtctggctgctgcttggtcttctgctggtgcacgaagcgctggaggatggtgagtgactctgggcgcggggccacctagcttgtgccctgactttagccgggacccgaagcccccgccgccctcctgccagctcttggtctaacgttcggccctcggtggctcagcccccgcgccactgcctgcccggtgcacctgccccctcctggtggggtctcctttcctcccactctttgcctgcccggagagccctctaggggtggtggcagctaccccgacccttaggagcccaccaggacctctccaagtccccatctccgggcgaaccaagcatccccagccagcgcctggtccagcccccagtgtcaacgtgtcggtctgggaggtggggcgggagcctcggatcgcttccacctcccagcggcgtggctgggacctctgctgctgagagcgagtgccacctaagctcggcaatcgctgattcggttgcagagttccaggtgacctccccctcccctcgcagttctgggcgtgttttcgtctaccaccttttgcttgaatcctgcaagatctgcctagatcttcgaacaaaaatgtcagtgtatgaaacttcaaaacgaatcaaaagcccacggcttattatatttatctaattggatgggaaatggtgaagaaaatgcatttttttggtacagcgtatgggaccatgaccgctgcgcgtttttgaatgtgtacctgtcctgggtccaccctgtcgtgtacacccgtgaccacagggtctggtgttatttttctgtgtgtctgggtgtgtgtattactgtggtgtgtattatatattattgttagcatttaaatgttttgtttgctctattcactccatgggtgttatttgtacagtacatgtttcatctgggtgcctcctggtgtcctcaaccctctcttgaaattcctgggctacaacacaatttttgcttagatttagtggaaaagtagcttttgctgttatgcaacttcatgctggagccagctcgacctggctcacatttttatccactcgttcatcctgaccagttcctttctttcctaggaaactacatttgccaaaaaaataccgcattgtagtttgcaaaatccaagatagtcgtggtacttgaagttgagcatgagggtccttcagcctagagctttgcttaataaaacgtaggcagagcttctactgggagagtaacacttaactctgcccagagagaagttgccatgagttcagtttgtaaaatgcaatattaaaatgctcctggcaggcccttgtatgcaactgctgaaaaggcagaaatgtaatttgtagtatcattttttgaatagggcaggagatggccaggcaaaataatttcaaatcagccattcctttgtttatacccaacttgcgagtcttagaggctcagaaattgacttccattctgcctcctggatctcacccagcccatgtgagtttattacaaacatctgactaaatttaccctttctttaagtgtaatccatacaaacaataagcatttatgagacaattggagaaagtggaatacagactgaatgtaagaaatagttcataaattttaggtgataatagcacgaagattttgtttataaaagtacacacatctggccgggcacagtggctcatgtctgtaatcccagcactttgggaggccaaggcaggtggatcacaaggtcaggagttcaagaccagcctggccaagatggtgaaaccccgtctctactaaaaatataaaaattagccgggcgtggtggtgggcacgtgtaatcccagctacttgggagggtgaggcagagaactgcttgaacctgggaggcagaggttgcagtgagccgagatcgcaccactgcactccagctgggcgacaaagtgagactccatctcaagaaaataaagataaaaataaaagcacacatatctataatgtatggactatttatggatacaatagtgaacacacagtgcttcattaagttatgtaaccgtttggctaaacctattaagaatggtttttggttttgagttgtgttgtgagttgtggccaggagctactaaggagagtggattacacaggaggcccttccagtgctggtctcagattggcaggttgggaatatcctgccttcaaggccatcccaaagcacaaattacagacacaaggtccatgactcaacttgtttcactgccttttagtttttctgatcacatctaaaagacagtctttattattattttattattattgttattattattattattattattattattgagatggagtcttgctatgtcacccaggtggagtgcagtggcacaatcttagctcactgcgacttccacttgtgctagccaccacaactagccaaagacagccttctaagaggaaaagacttccctgcaagtgtgtatgggggtgaacatctggcctgtgacccaatgaagctggctgctcccaatgacaaaatgctttaaatttttggaagtaatgttctttctcctcatgaagatggggagctggaaaggcacataatacttcatggcatgaaactgagggatgaaaacaggtaataaataatccaagattccacgttgagatgtcaatcatagcacctgattttcagcatttatatggaatacatgccaccgagtttattaatagggtgcttctattttcacattgaaaagtataaaatcacaaatatttcctgacttttgattacctacatatttttattgaatgtcaggagcaaacactgaagtgttaatattgatttgtgcaacaagttctgttgaacaacatgagatccttgatccatgctaatctggtcttcagtaacctgggtttattttgcatgtggtgaaaggggtttctttcttggaggactacagacattcattattgtctgagagcaatatagccagatctctaagaaggtaaggacagagacacaatgacgaggattctctaaccaagagcctttgacactttcgtgtcttcgtttatttttgagaaaaaaaaagagtaaaaattagtacagaaatattttaatgaaaaaaagaattctaaagttccttattgtttatgaatgcacataatgaatgctttgaagcatttaggatcttggctggcatgtttgacatacaaaaccatttctgatccttaaaacacagaaagagaaaagtttgagggcaagagagagagatctggtggtcagaggactgatggttttcaaacctagacaaggttttaaaaccctttctttgtggtgctcaatgaagggagaggaaagataaagaagtaaagatacaatttaaggaagtggtaagtggcatcgagaatcatgaatcagggtctattaggttcctagggctgccataacaaagtaccacggaatgggaggctttaaaaccgcagaagtttgtttgctcacagtccagaggcttgtagtccaaagtcagtgtcagcagcaccacacagcttctaagatgcgggtagaatccttccctgcctccactagcttctggttgtggtcagcaaccccttggcattttttttagcttgtggccacatcactccaatctctgcctctgttgccatgtgaccatcttctccccgtgtctgtctttacatggcattttcatacgtgtgtgtgtgtgtctcctcataagaacatcagtcctattgcaggagagcctaccctaatgacctcatgctaacttgattacatttgcaaagactccattcctcaatgaggttacattcacagatacctgggagttaggacttcagcatatctttttaggggacacaattcaaccagtaagacagggtgagacatggagaggactgaggcggggtgtgaggatgccgtttgaatggatagccataaacctgcctgaaacgaggaagcaaaccccggaggtagctgacagcaaagctgtgcactccaggggcaccacaaaggcaatagcttcaagatgggcttgtaccggttgccagtgtggctgtggctgtgatgcgtgggacgggagctggccaagccttgtagggcatgggaagatttaggccttgcttctagatgagatgaaagtcactggaggcttctgaacgaagaagtacccataatttgatttatgttttcaaaggtaggtgctatggtttgcccccaccacatcttatgttgaattttgatcccccatgtggtggtggtggtgggaggtagggcctcatgggaggtgtttgggccttgggggtagatccttcatgaagagattaatgccttcccttggggatgtgtggattctgtattatttccagcaagaactgcttgttaaagagagtctggtccctcctcctcccatcgcaccatgtgatctctgcactgctagttatccttgccctctgccctgagtggaagcagcctgaggccttcattggaagcagatgttggttccatgcttcttgtacagcctgcagaacgatgagccaaataaacctcttttctttataaacaacccagccctacgtattcctctatagcaatgtgaaatgaactaacacagaaaattggtaccaaggagtgggatattgctataaagatacctgaaagtgtggaagcagctttggaactgggtactgggcagagaatcggaagagtttggagggctcagaagaaaacagcaagaggagggaaagtttggaatttcttagagattggttatatagttgtgactgaactgttgatagaaatatagacagtaaagttcatgctgacaaggtctgaaatggaaacagataacttattgggagctggagaaaagtcacccttgttaggccttagcaaagaacttggctgcattgtgtccatgccctagggattttggaaggccacacttaagagtgatgtcctagggtatcctaaagaagaaatttttaatcagcaaagtgctcaagtagtggtgggtgtggctgggtttaaaatcttaggatcagccgggcagggtggctcacgcctgtaatcccagcactttgggaggcaggcggatcatgaggtcaggagatcgagaccagcctgggcaacatggtgaaaccctgtctctattacaatacaagaagttagcctgatgtcgtggtgcgcacctgtagtcccagctacttgggaggctgaggcaggggagtcgcttgaactcgggaagaggagattgcagtgagctgagatcaggccactgtactgcagcctggtgacagagtgagactctgtctcaaaaaaaaaaaaaaaaaacttaggctcaagatcaattacagcagcaaaggaatgacctaaaggtagaatttattatgaaaagggaagcagagagtaaaagtttggaaaatctgaagcctggccatgtggcagagaatgaaagagcattttgggaaaagaatccaagggcacagttgagagactgcttgaatcatgctagtagctaagaaaataagagaaaggccttatagccattttggaaatctttgaggagcccctcccatcccaggcccagagactcaggagaatagaatggttttggggggcaggccctgctgctcttctgccgtgcaccacctcgggatgctactgcccctatctcaggtgcaccagctctagccttcacttaaaaggtcccaggtgtggttccagatgggcgaataagagcagaagaggccaataagcaggacagagaggttgctccagagggcacaagttataaataaaccttggaggcttccacatgttgtcaagtctgcatattcccagaatgcaagagtgatggaggcttagcttccacctagatttcagaggatgtatcagaaagcctgagtgtgcgagcagaagcctgctacaggggcagaactaacacagagagtccctaccagggcactgcctaggggagccatgggaacagggctcatgtggggatcccagaattagagagccaccagcagtatgcaccctcaccttggaaaacaaacagacattcaactccaacctgtcagatcagccatgtgggcttcacccagccaagttagaggggtggggagggcgaaggcttgtttttgattttccaggctcacagctgtaaggaacttgcctcaagctcagatgagactttggacttttgagttgatgctggaacaagttaagatttcggggactattgggaaaggatgcttgtaatttgcagtatttgaaagacatgagttttggggggccagaggtgcaatgctatgatttggatatttgacctcctccaaacctcatgttgaaatttgatcaccagtgttggtggtggggcctaatgggaggtgtttgagtcatgggggtggacccctcatgaatggcttgttgccctcctggaggtaatagaactaatagcgtgagttcttgctccactaattcatgtaagagctggttaaaaggaggcttgcacctcccctctctctctctctcgcttcttctctctccatgtgatctctgcatatacctattctccttcacctgtgccaccagtggaagcagcctgaggccctcaccagatgcccagtcttgaatcttctggccagcagaactgtgagctgagtaaacctctttcctgcataaatgattcagcctcagctatccctttatagccacatagacggccgaaggagtgatacagtggaagccaggggctgcttaggagatagtataaatgtctggatggtaagtggcttggcccaggctggtatcagtggatggaaggaaaagaggctgagttcagggtctgttttcaagatgaagtcaaaagaatttgttgctggattggatgtggcttaggagaggaaaatttaaaacaagtgcgacttggaggtttttgtcctgagcaattgtcatttgctgataaagggagcatcaggaaggagcatgtctgaaggggcattcagaggtcagacatgctaaatttgagatgctaaattttggagatgctaactttgacatgcctactagtctttcaagtggcggtgctgaataagcaacaggatatttagatctggagtgtagaggcggggtcaggacaggagctagggcagctttcagcatataaatgctgcaggggtcacgggattgtgtgaggtcacttagagagtgaagagtagttagagaggagtgatcaggcaggtcaggaaaatgaggaagagctgccacagactgaagagttgtcagtgacacaggaggaaaaccaaggcagcacagggtcctgcgagccatgtgaatcgagtttttcaagaagagcttcatcaactgtattctaacaggtgttctggaaaatacttcagattgaggcctttatcctggtattgaaggatctaattttcagaaactgcttttttttttttttaaagatactttaaacagtggtagtgttaccggaaaggggtcctgatccagaccgcaagaaaaagttcttggatctcgtgtaagaaagaattcggagtgagtccatagaagtaaagtgaaagcaaatctattaagaaagtaaaggaataaaagaatggcttcttcataggcagagcagcggcatggactgctcagctgcttatacttacggttacttcttgattatatgctaaacaaggggtggattattcatgagttttccgggaaagggacgggaaattcctggaactgagggttcctctcctttttagaccatataggatgacttcctgatgttaccatggcatttgtaaacactcatggcgcttgtgggagtgtcttctagcatgctaatgcattataattagcatataatgatcagtgaggatgactagaggtcacgttcgtggccatcttggttttggtgggatttggccagattctttaccacaacctgttttatcagcaaggtgtctgtgacctgtatcttgagccaacctcctgtctcatcctgtgacgaatgcctttacctcctgggaatgctgcccagtggttctcagccttattttacccagcccctattcaagatggagtctctctggttcgaatctctgacagtaggtgggttttttggagtggggttctcgaaaggaagagagaaagaaagggcttgctacatcttgctacattttcctctccatagtatcgctttcccaccttctcagctttgttcttggaaaagtgtgtgtgttcctgtggggtgtttcatgaaaaatggaaaaatgagagtggcatctctcagtgtatataactaattgggaagcaactgagtggctcagaagaatgtatggtgtggttaactgaggagctacttttagggatggcctttcccctttactgcccatcagggaggagaaaacccaacagctctagcgctttgatattaatgactgtgcttaacaagaaatctcatccaggctgcagtcaatgattcttctaatgaatttattttctcctccaacacagttctattgaattaggctaataggtcacttttgatgaataagatttgattgtgattctcagttgatgatgaataatcatggtcctttttcctgcttccttcttgctttgtaacatttgtttatttattttggatataagggttttggggtttttgtctgttttttcttttttttgagacagagtctcactctgttgcccaggctggagtgcagtggtgcgatctcagctcactgcaacctccgtgtcccaggatcaaacgattctcatgcctcagcctcccaagtagctgggactacaggcgtgtgccgccatgcctggctacttttttgtattttttggaagagatgaggttttactatgttggccaggctggtcttgaactcctggcctcaagtgatccaccttccttggcctctcagagtgctgggattataggcatgagccgctgcacccagctggagatgaggttttgaccaacatctcctcaccgaggggatccagtgtgtgccttggaaaagcacctccagctcttccaggaagaggaggctgtcatccccagcatcaggttctgtttggcttggaactccatgtcacatcaaacaaagaatctcatggtgcatgagatttgtgcaaataaagtgaaaaagcaacaatatgctaatctctaagtggatggagaggcaatggcatgagccagagaaagctctagacttggagtcagagggtctgttttttcactaccttcttgatgacctggagtgaactacttggcatctatacattaaaaagactaatatctgctttgtttccaccacaagttcatcatagagatctcatgtgacaaccataaaaaaacaaatagcacttagctagcaatcacttactgtaggtcagatgctaatttcagcagttctgacatattaactcatttaactcccacagtaattattacagttattatgaggtagttattaccatatcattctcaatttatagatgagaaaactgaaacagaagagggcaagtagcttcccaaggtcacacagccagtaagtggcaggcctggacctgaagctagtaatgatatttaatggttcttgaattttgccacctatttctctataaattatacgatgcaatagtctcaaaaattcaatggtaatggacgttcacttatagtatgaattcttgtattttttaagtctttgaaaaataaccaattgacatagttaggctgaagagtcatattcttttaaacagttagacatgggatttgggagtcactcaattccaataccgtctgggtatctgtggggacactaggctggctcctttagctttgcatcattgccatcaaaccacaggccaattctgtggtcaggcagctggaccagctatacagttagatcagctggtggggctatttggtcaaaaggtcaaattattttgcatagataatagcaaatatttggatgcataatctccaaaatcagataatctcatgttcctgagtaacatagatacacaagatgtgatagcttagaaggatcagacaagtagctctgtttgtctaaattccataggatttacagatggttattgtcatttctggtagcttgaattcctgttacatgatacacagaataccaaattagaccttaatccagaggttcattaatttcacaggcattaaagtatttatggggcacagatttcttgggcatgataatggtgggcttttctttctttctttctttctttttttgagagagagtcttgctctgtcacccagactgcagtgcagtggtacaatcatagctcatcataaactcggacttgtgggctcaagtctcggtctcagtctcagtctccaggcattggagtgcagtggtgtgatctcggctcactgtaacctccgcctcccgggttcaagcagttcttgtgcctcagcctcccgagtggtagctgggattacaggcatgcgccaccatgcctggctaattttgtatttttagtagagatggggtttcgccatgttgcccaggctggtctcaaacttctgacctcaactgatccacctgcgttggcctcccaaaatgctgggattacaggcatgagccaccacacctggcctacagtcccctattcattcttgttgagtggacacaactgtgtggctgcaaggggcttagctgagatttttagagtccggtggcccaccacaggcagaacagtgggggcactcttccctggatgcaggcaataagggtgccttacttatagagaaggcaaaaatgacaacaaaagcaacttaaagtcagttagctttttattatcactatttgccagcaactctcaatgttggtgataaaatactccttccccagagacattttgttggtgaaattctaaatcgttgctacagttacagttgagttttgataatttatatgtaagcttcagattagtatacacataatatttactctttaataataagcattttattctacctagacatcgcaagcccctgacaaatgtaatgtctgctttaccatttgttttgagagaaagttcactgtggttcaaaatcttggctgggcagagtggctcacacctataattgcagcactttgggaggcctaggtgggagggttgcttgaggccaggagtttgagaccagcttgggcaacatagcaaggccccatctttaaaaaaaaaaattagctcagcatggtctcacatatgtgtaggcctagctagtcaggaggctgaggcaggaggatcacttgagcccaggagttcaaggctacagtgagctaggatcatgccattgcattccagcctgggtgacagagtgagattccgtttctaacgttaaacacaaaatattttgcgtgcactttcagcacagtttgtgtccccagtctctgtggagctacagatttctgtgtttaaacagtagaatcaaaatgaatagtgacaacatatagactgcaaagtaaacaaacagccttgaatggcttcagttctgctgttttgtgtgactgcttggagactatgagacggtgtgaactacaggcagtaatatttttgttttctaagggcaaattttagctcatacatgaactgttgtgctgaatttgaataatatctttggagctgaaatattttttaatgttttaaaattaatcaaaagatgataattacatgacttttactgaaaacaatattgacatatgaggaggggaggattaaaaagttatcttctctagagttacctaaaagctatgagggctgggcatggtggctcactcctgtaatcccagcactttgggaggccaaggcaggtggatcacctgaggtcaggacttcgagaccagcctggccaacgtgctgagaccctgtctccatgtctctactaaaaatacaaaaatgagttgggtgtggcggcgggcacctgtaatctcagctactcagggtgctcaggcaagagaatcacttgaacctgggaggtggaggttgcagtgagctgagattatgccactgccctccaacctgggcaatagagtaagaatctgtctcaaaaaaaaaaaaagttattggcctcaaatattccaaaaatgtcattactacagcgcatttctctctccttacgttttgcagttactggccaacaccttcccaagaacaagcgtccaaaagaaccaggagagaatagaatcaaacctaccaacaagaaggtgaagcccaaaattcctaaaatgaaggacagggactcagccaattcagcaccaaagacgcagtctatcatgatgcaagtgctggataaaggtcgcttccagaaacccgccgctaccctgagtctgctggcggggcaaactgtagagcttcgatgtaaagggagtagaattgggtggagctaccctgcgtatctggacacctttaaggattctcgcctcaggtaagcatttttttttaaaactgtgtagggttgaggatttgtaatagttaacaaaattccttcttaactattattacacattgtttctgacatgttccattttaccctaatagatcataaaaatagaagctcaaagggcaaaagtcacagattttatttctttacccagttaataacaattgcaggccgggtgcggtggctcatgcctgtaatcccagcactttgggaggccgaggtgggcggatcacgaggtcaggagatcaaggctatcctggctaacccggtgaaatcccgtctctattaaaaatacagaaaattagctgggcgtggtggcaggtgcctgtagtcccagctactcaggaggctgaggcaggagaatggtgcgaacctgggaggtggagcttgcattgagccgagattgtgccagtgcactccatccagcctgggtgacagagagcgagactccatctcaaaaaaaaaaaaaatgatatatgaatgaaaacagaaaagaaaaattgcaaatcctaccaacatttgctgaaagagtgaaattttacaggaaaccatgtgacaaaaccatatgacaattttctatgaaaatgtatgatgtgtggaattttatgggaaaccaaaatgttatagaaaactattatgcatagagatggatgtttaaaaattcatattgtgtggccaggtgcagtggctcatgcctgtaatcccagccctttgggaggccaaagcaggcagatcacttgaggccaggagttggagattagcctggccaacatggtgaaaccccgtctctacaagaaatataaattagccagatgtggtagcatgcacctgcaattccagttactcaggcagagctgaggcagaagagtcgcttgaacccgggatgcagaggttacagtgagccgagttcgtaccaccgcactccagcctgggtgacagagtgaaactccgtctcaaaaaaataaaaaaaaatcataccatgaaagttaatggactcaatgttttatgttgtttttttaagtaatcataatgaaaactgaaatgacctaacaggagatttctgtgagcaacttgaccagatatcaacttcaactacttttcaactgcttctcattattattattactattaatttttttttttttttttgagacggagtctcgctctgtcccacaggttggagtgcagtggtgccatctcggctcactgcaagctccgcctcccgggttcacaccattctcctgcctcagcctcccaagtagctgggactacaggtgcctgccaccacacctggctaattttttgcttttttagtagagacagagtttcactatgttagccaggatggtctcaatctcctgacctcgtgatccgcctgcctcggcctcccaaagtgctgggattacaggcgtgagccaccgcgcctggctgcttctgattattttgatgttcataagtctatgactgttacattcagaggcctcaactggtaagaaggcccatgatttctcatgtttgaatgagtaccttcaggaggctaggcttctagaccaggaagagtggttaccatggtgacagcggcaagtgtgagaagcaagaaagaaacacgtgcttcctggggtgctgggaggaacctgagcatgggctctgcgtcagggggtgtgtacggggttacagtcctgtgcaccttggtgaagtctcctaaactctgccagttctcagtttccttatgtgtagaatgaagggtaggggatgacatgatttctaagattctttctggccctatttccgtatatgatggagaaataggatggacttacaatggagaaataccagatgttgtctgagatgacaagaatgggagaaagaaagcctgcaggcaggctgggcacggtggctcacgcctgtaatcccagcactttgggaggccaaggcgggcggatcgtcatgaggtcaagagattgataccatcctagccaacattgtgaaaccccatctctactaacaatataaaaattagctgggcgtggtgcatgtctctagtcccagctactcggaaggctgaggcaggaggggattgcttgaacctgggaggcggaggttgcagtgagccgagatcaggccactgtgctccagcctagcaacatcgcgatactgtgtctcaaaaaagaaacaaagaaagaaaggctgcagagggcaggtatctcagactctgcatgttcacaacgatttatatttccacacaaactgtgtttctgcagaaattcatctccctcaaggacatcattatccacttggttacccaaccagaagactgggcggcatccatgcctcctccctctcccccacactctccacatcccatcggtcaccaagttaagccagttcagccttcattttaacatttcaaaattctgagtttggtgcaaaaataatagctgttcttaccgtgaaaagtaatgatgaaaaaccaccattgcttttgcgccaacctaatacatgactcagttccctcttcatagcacttgagccttcttccaggaatgggaatctgtccatttgcattcctggagtcactgtcccctgtctgaggcgctcttctctcccatctctgatactgcggtgaccacacctgggctagggcttctcactgccgctggagcaacacttaaaagtcagagttcagcgtgtggcttccctgctcaccactcggtggatgcccttggggataaagtccagcatgctcatatggtagtgaggccctcgctgacctctgccgtcctctggagtcacctctaatctcgatcagacactctgctttcgctgccctgggctcctgtgagattctcaaaagcgccaggctcctggggacttcgagtttgctctttcatagccaggaacactcttgggcccctgagcaccgggctaacctcaggcatcactgtctctgggaaacccatggcaggcccccccagctatgtgttcccacagcacttgctgtttcctcttcccagctctcttcacactgaaaactactattattttctttcaacatctttgtttttcactgagacttagctgagtggttggcggttagctttctctattaatgtttgactgacaagcctccctgatacatttgtccttcttaaacccacatacacgcgcacacacacacacacacactactctacacacacaccttgagagtaaataaaaatagacgtataagtgatattaaactgtctacttatctctcttatcctgttgtattaagacatctttcacatttttattctgactctaccctctagcattgtggatataacaggatagagtccttcttaaaggtgagtgggctggatgtggattggagagggagaaagtgaatccgttcttcctgtttccctttccacacttgaagtgcgtaagagggaacgtatggatattctgcttggaagaaatctggaaaggcttaccactatatatatttatgtgcagtaaaaaacatataacataggtttatcctcttaatgattttgaaggccaggcatgatgactcacacctgtaatcccagcactttgggaggccaaggtgggcggatcacttgaacccaggagttcaagaccagcttgggcaacatgatgaaaccatctctactaaaaatacggaaaaaaaaaaatttaacctggctttgtagtgcattcctgtagtcccagctacttgggaggctaagagggtgggatcacctgagcccaggaagtcaacgctgcagtgagccatgatcataccactatattccaacctgggcaacaggagtgagactgtttcaaaaaaaaaaaaaaaattcttggcatagtgactcatgcctgtaatcccagcactttgggagggtgaggcgggcggatcaccggaggtcaggagttcgagaccagcctgaccaacacggcgaaaccccatctctactaaaaatacaaaattagctgggcatggtacatgactgtaattccagctagggaggctgaggcaggagaatcgcttgaacctgggaggcggaggttgtggtgagccgagatcgtgcctttgcactccagcctgggcaacaagagtgaaactccatgtcaaaaaaaaaaaaagtaaaaaaaagaaaaaataattttgaagtgtacagtattgttaactataggcacatggttgtataatagacctctagaccgttttcatcttgcatggccgaaactatgtgcccactgaacccctctcctagcattctttcctggcagtcaccttgctactggctgtttctatgagtttgacaactctaggtaccccatataaatggaacatgcagcgtattttttttttttgttactgacgtatttcccacagcatgatgtcctcaaagttctttgatgttgcagcctatgacgtggtttcctctttgtttaaggctgagtaatattatattaaatgtatatattacattttatttttgagacggagtcttgctctgtcacccaggctggagtgcagtggggggatctcggctcagtacagcttccgcctcccaggttcaagcgattctcctgcctcagcctcccaactagctggaattacaggcacacaccaccacactcagctaatttttgtatcttctatagagacagggtttcactatgatggccaggctggtcttgaattcctgacctcaactgatctgtctgcctcagcctcctgtaagtgctgggattccaggtgtaagccaccatgcctggcctatactacatttattttgtttgttttgttttgagatggagtcttgctctgtcacccaggctggagtgcagtggtgcaatctcagctcacggcaacctccgcctcccgggttcaagcgattctcctgcctcagcctctggagtagctgggattacaggcacgtgccaccatgcctggctaatttttgtatttttagtagagacagggtttcaccgtggtcttgatctcctgacctcatgatccacccacctcggcctcccaaagtgctgggattacaggcgtgagccactgtgcctggcctagactacatttttgtaatccatcatccagcgataggcatttaggctccttccaccttctggctgttgtgaatgctgcagtgaacatggatgtgcatatatttctttgagattctgcttttaattcttttggatgtatacccgcaagtgggatttaccacatacatttttttttttcctgatgtacatcctgatgttgattttactgtttgtgttttgaatacacaagccgggtcaggagcagtgagatttgccagcactcagggccctatgggtcttgggccagctctggatggagggacagccccacatgcccagagcaaggccccccattaagggactgcagccacctccagggactccgccctccactcacctgctcccaaatgccagagggagcctccttgccctccctccctgcccaccatcccctcaaccatcagcctggcattcaaagcctttccaagttccacttgagttttcctgctcccaaaggtgcccaggctctgggcaggcccagctcatatccctgatggtggcacattctctggaggaccctcctgttctcgggtaggggctatgccccacctaggtagccgccctattttggatcctgtaggatctctaaaacccagctctggccccaactttctgtctggcctggaggtttctcagcctcctgagaactctcctgggccctggtctgggcagaacctggaactaaacaaacaagagccagggcagccagggtctctgcgtggctgagcccagggcttgacctcagagctcccctgtccaacaggagaggagtgtgcctccaccttccctactgcccgcccctttttcagggtctcagggcctctagccctgtggtggtgcgggggtgctgggtaccccaggtagagctaaggttatggggctgttgaggagttggcgtccacctggagtctgtccagtgagtttaggtcaacaggtgtgcagcctgcccttcgaggctgagccacctcccaacagcctgtacaactcgaggggccttttgagggaggggcaggcaggcccaatgggtagtcaacccaaggtgaacccacccaccatggccagggttcctcaggttgagcctccagtgggtgaaacctgggagtcctcaaccttactggcagatggggccgttgacaagaggaggtgggtgaggcctccacagactccaccctgtggtatcacacagctggcagccaatgggaagcaaccagccaggaagccccagagttacccttgctgggtacccttgctgggggacctgggccatcccagtttgtgagaagtggccggaggcagttaggagcccacattcaatccaaggccgtccactgagccccgtgtgactctgaccgggctgggggtgtccatgtcctctctggacctcagttcctgtaaaatggcccactggccagatcggctgccaggctgctcacaggcacatgggctgcacgtaactccgtgggaagaagccaacgcgcccgcaggaccggccctgcctccaataccacgtacattttaaacgaccttattcaccaaagtcagattcatgcactttttataaaaaaacagaattgatataatttaaattattctgaacatttagtctttgacttcctacacaaagcatcttaagcttagaggattccatgcttgaagttttagtattttctaagagtattttcaaatatatctaaattatatattaaaatgcatttgaaaacattttaaagactctaaagtgagcgttaatctgaagagaaatattcagcatgtgaaaaaacaaattttgactctttgaatagtgttcattcgaagcacagcaagagccttagaagaaagtaatgacagatgtgggcttccaaaaacttatgaaacattgtgaaaaaatgtgaaaaacatctagtcatagctatatcaaccacagatgtgctatttgccctcaagggggcacgatgtatttcacaccagagattcaagaaacggactcttgacatcgttcccagaacgtggtgcctttggatagagaagtattcattctgtgttttcttttttccgtagaatgagttctttccagggctatgacagagttgggtttggaagctccccaggtgttcatccaacaaagccttgtagttttttttgttttttgtttttgttttttggcaaagtcttgctctgtcgcctaggttggcgtgcagtggcacgatctcagctcactgcaacctctacctctcatgttcaagcaattctagtgcctcagcctcccgagtagctgatactacaggtatctgccgccacacctggctaatttttgtattttaagtagagactggctttcggtaagttggccaggctggtctacacctcttggcctcaagtgatccgtccaccttggcctctcaaagtcctgagatttcaggcgtgagcctcctcgtccagccaagccttgtagttataaccaatattgttggctttctggaagcacgaccacatttatccgaatgtaatcttctgactgcttcatcttttcctactaaattgtgaaatgttcttgacactcacctacaaaagcaggccaacagagagagcaattaatgaagaagaaggagatctaatgaactttagagctctaggaagtaaaatgcccaagtagagaaaaatgcagtatacattttttttttcccaaagtgctgggaatgtcacagttgcttactaaatacttcaatgaattgatgtatctggctttattcatcagtgattttggtaaatgattaaaacacaatatgaagaaaacattcatggcacccaaatataatttggcatctctctaggattggaggatgcagaaatccatctcttcttacggatttttcacggtggtgttttagcaaggatgctgcctcagtttcttagcctgtaaaacaagatggtctctaaggacccactcaactatgaatttgggatttgggaatttgtttaaagcaatatttcagtaagttaatgtgttgtaacctgcagtgatttcatatggatttttatgtagatctccttatgattttgatgacaatatggtattccatcaatgttatatagcattgtgttcttacctagttcccagcttgtgctttttgagtttttactatcataaatagtgcatttataaacattattatataaataacttgatctcatggttcatatgtgtaacacagagaaagcattcaatttactcaataaggataaatgtcttatcctatatgtttcctgcagtgagaataaagacaaagaatgttgtggaacagagaagccagaggctgaggcacagctagatttgaatcttccgtttatcactaaccagcaaagtggtgtgtgatcagtagtttccctagaacccagttgccttatctggaatgtgaatatattattgcttatttgtttatttaattgattacttctttataatctgggatctgtgtccttcttccctcctgaaagaataaaccccttgagggcaaataacacatctgtggtttatcatcagattcctagcacctagaacaatgtctgacacataccagagctcaggaagtatgttttggcttccacaggggtttaggccgcatgtcagaagtcagttcttagtcattcattcattcagtatttaaagataattactgagtactgatgtgtacactgcatgtattgggaggtaggtcagctaggcaaacaacaaagtattaatgtatttcatatctatggtgctgtgtcacctggatccatccccattgtctcagagcctgatatggtttggctgtttcccctccaaaatctcatcttgaattatagctcctgtaattcccacatgttgtgggaggggcccagtgggagataattgaatcataagggcagttcccccatactgttctcatggtagttaatacgtctcacgagatcacatggttttctaaggggaaacccgtttctcttggtgctcattctgtcttgccagctaccacgtaagacatcccttgctcttccaccaggattgtgagacctccccagccacgtggaactgtgaatccattcaacttctttcctttatacattactcagtctcaggtatgtctttattagcaatgtgagaacagactaatacagaacctattgttacttgacctcatagagccgttagtccattgactctcccttctccctctttatccacattgcacctttatgtctttacttctctctctcttttaaaattttatttttccataaattattgaggtacaggtggcatttggttacatacgttctttagtgtgagccatcagatcctggtgcacccgtcgtcacccaagcagtatacactgcaccatatttgcatatttgttatcttttatccctcactgccccaaactcttccccccaagtccctaaagtccattgtatcattcttacgcctttgtgtcctcacagcttagctcccacatatcggtgagaacttatgatgttttctattcctgagttactttacttagaataatagtctccaattctgggctctgtcatttctactgaactcttgaatatgtcctaagttcctttgctctctgttcttccttcatttccacttggaaacttgcgaccctaaatgaccctgttcatctactttctcttgtctgcacatggaccctgaggactgctggaaggagccgtacagctcgccacgtggccgtggctgccagtagatgtggccacctcacgtttgcttggcaaaatcaatacatttctctagaaaggtcactttttctctcttcttaaacctctcatcttcatctctctgactttcagctaatgaaattatcccctaacttattaagaaattggagctctaatcaccttaagtttctctgatcatatgtcctccttccctgatctaccagtgacgggaagaaggatgaggattttccctcctaaggccaaagcactatccgtgccctggatctcatctctacctactttcccaggaacttcgatacatcacttactgcctcttcattctggatcatcaacatctccttgaaaaggatttatgggtccttttcatcaatattcaccaaattaagaaattctgccttgacccccatgcaccctgcagccatcttcctctctgataaccttcacacccagttccctgggaggagtctctgtcctcattgtattcactttttttctttttcctattcattcttcaataactctacctgactcctggccccattactccacatgcattttttcaccaaggtcaacaagggcactaaatccagagttcgcttttccatgccttgagatttcctgcaccaactccatttagctgagtgaagcatcgtgtcttggcctttgcagtcctgtgtccttctggttttctctctgtctcacagcccttctggagtcctcttcaccagctctgaatcctccactcttccagacattgaatgttggttctatacactcctctctacttgctggcgaatgccctcgatttgtcctatattacattaaacgtttcttctgagctccagactgagctacctagctgcctgctcacaatatctgcttggatctttcatgagcttttatttacgctgaaccatctatcctagcaacaggggaggccaagatgggaggatcacttgaggccaggactttgagaccagcctgagcaacacagcaagacccccatctctaaaaaaaaaattgttttaaattacaggtgtggtggtacatgcctgtagttgcagctactcaggatgccgtggtgagaagatcacttgggcccaggagtttgaggctgtagtgaactatgatctgtgactgcgctccagcctgggcaacagagcaagaccccatctctaaaaaaaaaaaacaaaaaaacccctaaaaattagccaggcatagtagtgcacccctgtagtcccagctacttgggaggctcggatggtaagatagtttgggcccaggagctcaagactgcagtgagctatgattgtgccagtgctctccagcctgggagacagagcaaggcccatctctaaagaaataataaacaaactgagctcatgatctttctccacacctggtcatcctcctgtgtccttcagttcagagaatggcactaattccatccagttgctcttgaccagaggcccgggaatcacttgaaaaccactttcgttattcactcccgcatccaaccaatgatgctactatctaagcatttcttgaattgtcccacttcttcctatcacaacagcagtgactgtagtctctaaccttagagggtgtctgtttattccctgatgttttcctcacacccagcacagtctccagcatgccccaggtcctccatatgtatttctatgaatgaatggtgccagaggcactgagcctgcaggggatctaaagtcaggcccctgagatcatgtgacctgagactctgggagcaagctcaaagaactttagacctgaaagggaccttctgattgttaacttatacccccgtttttgtttttttttttttcctctttccaacttttaggttgagcgtgtatatgtgcaggtttgttacgtgggtaaattgcatgtcacgagggtttggtgtagattatttcattatccaggtaataagcttagtacccgataggtagtttctcagtcctcaccctcttcccaccctccaccttcaagtgggcccctgtgtctataattcctgtctttgtgtcgaggtgtactgaatggttagctcccctttaaaagtgagagcatgtggtatttagtcttcagttcctgtgttggtttacttaggataatggcctccagctgcatccatgttgctgcaaaggacatgatttcattcttttttatggttgtgtagtattccatggtgtgtatgtaccacattttctttatgcagtctactattgatgggcatctaggttgattccttgtctttgctcttgtgactagtgctgcatgaacataggaattcttgtgcctttgtggtagaactatctatattcctttggatacatacttggtaatgggattgctggcccacatggtagctctaagttcttcgagaaatatccaaactgctttgcacagtggctgaatgaatccacattcccacctgcagtatgtaaacttcccctttcctccatgaccttgacggcatctgttatttttggctttggttactagcagttctgaccggtgtgagagggtatctcattgtggatttggtttggatttctttaatgattagtatgttgggcatattggccatgtgtatgtcttcgaggaagccccactttttgacagataagggaactgagagtcatagaggagatgtggctggtcagagggacaagctggcaagtggctgcatgagtcccagaacttgggagccctagttcctgaggcagagcggctgccccacttcagagctctgtggtatgtgtgttgagataaattcagatcacagtacactctcggtctgatggaggtagcttcaggcaagagagagtaatcatcgaatttttttttaaagctgtagactaaactaacctgatttctaaagattcaaaacagaaatgaaaagcagatacccagaatgaggcattgatttttcttggtggaatagctttgcgtggaaagtggttgaaattccacattgatttagggtagctctttggatgccagagtgtgaaaacctgatactgggctatttggaaaggagagctctgttggaagagcgtaactgcaggatgctcttggagttctggtctgctctgcgatgcttgtttgcaaaaccctgtcatgagaaggtccactagatggcaggtttcagctgtgctacaactggcttcctatcaccagtaaatgaagaaacattccaaatgagaactgagtggatacaatatgtgcccacttatacctatggtcctttcagcctttcaggctacgtagtggtcacagtttcaagttgtattttaaacagtatagaattcattttacaaacaaattttattttatttttatttatttatttttggagacagagtcttgtttcttgcccagcctggagtgcagtggcacgatctcagcttactgcaacctctgcctcctgggttcaggcgactctcatgcctcagcctctcaagtagctgaggttacgggcgtgcgccaccaagcctggctaattttttgtgttttcagtagagacggggttttgcgatgttggccaggcttgtgttgaactgttgacctcaagtgatccacccaccacctgggcctcgctaagtgctgggattacaagcatgagccaccacgcccagcccaacaaacacattttttaaaaagggagcagacatttgtaagtgtatgtacccacacagggacaaatttattcatgcccctgtcccctgctgggtctttcaggagcagtggcccccttgaacagtgtagttgatcccttcgaggctaatataaacttgctgatgactgtattttcaggtgctgaaattgattcaggttttacctccagactcagtccatcccagatcccataaacatctcctgtctttgagatcggaaatagcaaaggtactgtttctgacaacagtaattatcatttgtcgaacactctgtttcttgactcctctgccctgttcctttcttcccactgttttgtcataagcatctactatgtttatggtccctgctaggcagatgatggagataagatggtgagcaaaatagataaaatctctatatcccatagatcttttaatcttagggaagacaattaaataagcaattttaataaaatattaaagtctgttagcaagtgccttgctaaccgaagtatggtgtcaaggaggaggaaactcaagctcatatttgaaagttccctgggtaaggaagggcatagcaggatataaggaaattccagaaagagagaagtgtttgaaggaagtacctagaagtgggaaagagcataaaacttggagcatggagggcaggtgggtaagatgtggcggtcagaggcgagggagtgggaaggaggttaggaggagagatgatgatgggaggtgaggcagaccatggagggccttgttggccacattaagaaatttagagtgctggagaggatgtggagtaataggaacacttttacactgttggtgggactgtaaactagttcaaccattgtggaagtcagtgtggcgattcctcagggatctagaactagaaataccatttgacccagccatcccattactgggtatatacccaaagagttataaatcatgctgctataaagacacatgcacacgtatgtttatagcggcactattcacaatagcaaagacttggaaccaacctaaatatccaacagcgatagactggattaagaaaatgtggcacatatacaccatggaatactacgcagccatgaaaaatcatgagttcatgtcctttgtagggacatggatgaagctggaaaccatcattctcagcaaactgtcgtaaggacaaaaaaccaaacactgcatgttctcactcataggtaggaattgaacaacgagaatgcatggacacaggaaggggaacttcacacaccggggactgttgtggggtggggggatgggagagggatagcattaggagatatacctaatgctaaatgacgagttaatgggtgcagcataccagcatggcacatgtatacatatgtaacaaacctgcacgtcatgcacatgtactctaaaacttaaagtataataataataaaatttaaaaaaaatttagagcaaaatttagggcaattatgagtcgaggatttaaagcctttctaaatatgtatacaaagaaaatgcatggctgggcatggtggctcacgcctgtaattccagccctttgggaggctgaggcgggtggatcacttgagctcaggagtttgagaccagcttgggcaacatggcaagaccccatctctacgaaaaaaggtacacaaattagcagagcatggtggcgtgtgcctatagtcctagctacctgggaggctgaggtgggaggattgcttgactctgggaggtggaggctgcagtgagctgagatcatgccactgcgctccagcttgggcaacagagtgagactctgtctcagaaagaatgaaagaagggagagagagagacagggagagggaaggaaggagggagagagactgaaagaagatgctgagtaatataaaccgcattgtgagggttggccctcctcattgccttcagaagaaagacagtgtctcttcctgtgtcagttgcctccatccttcctccccatgccccatacccatttcactccaactggggtctttagatgtgttcttggacctcatgcttttttgcaataattttttaaattttttcttgcattttgttgataatattaaaaactttgtgtaagaatattctggattatctgaataacccctgctgggagatcaacgtgacccatttgcatcttctctgcacacattttgtttcttgaatctcatcataacacacttccagggtgtaaagccagagaattcttggcaccgcgctgagccagggaagaaaatgagatgaaacggagaataagtgggtctggacgaaggcttaaatataaccaatcaatgctggtaggaacaaggagacgttggagatttcagctatgttgtcagcaacatcacagcagtaaaaacaagataggctgatgtggtaataagccctggtcctgctccctaggaaataagagtccaggcattgtctttcaggatgtttttctggtatctggtcggatgttagcattttttcagtcaaaaactgggagttgggaggagtgcgtggggcacaggagatctctttgatggctggctcctcggaaaacaataaatagcttttagagagaagggagggcatcgggcttttcatttggccacggttggcaacagcttactccacccacagacaacacaaagggagggtgggccgatggagcagagagtgggctcccagccaggctcatcatgtcatccagcatctggagggagagtctggaagacattttaaaagaaaaggagaaatatcttaagtggttatcaacagaagaatcccaccattgagaaagaatctgcacagactttggtaaatgttgtggacagtactctggtgttatgctgaggaaggtatttttttttcaaataatttatatttttggaaaatacacagaacgtacaatttaccatattaaccatttttaaggagatagttcagtacacttaagtgcattcatatcattatgtgagtgtcttttgtatgcgaactcactttcctccaaagctcgttttattttattttctgagcagaacaaatgaagatgaggaggctctcactttgccttcattcttatctggagcatgggtccaattggggtctaatttgcagtggccagtcaaaaggaaacgccacccccaaactctaatacttgccttcaaatggtcttccaccccagaaatgacaaatacgtgacctaaccaatgctgaaggtagagcgttctctttccagactcactggcaccagctgcaggccctccgtatttccccagagatgggtaggtggaggctgcaggatacaagacttcccccagtgtactcaatgttctgagagcgttcagcttgcagaaaaacacagctatgttccattcaggacatgggtgggggcaggtaataatagaacgaggctcattgtgctgttctcaggatagaatgaggtcatgtgtgtaaagctcttggcacacatagtaagccacctaaatatcggtgagctatttctgttcaccatactgtacccaaaggaggtaaatcataagaaacagccagtttttcgttttttgttttttgtttttttttttttttgagatggagtcttgctctgtcacccaggctggagtgcagtggtgcaatctgggctcactgcaacctccacctcccaggttcaagcaattctcctgcctcaggctcctgagtagctgggattacaggtgcatgccaccatgccctgctaatttttgtattttgattggaaatggggtttcgtcatgttggccaggctggtctcaaactcctgacctcaagtgatccacctgccttggcctgcgagtttcgttttaagaaacgttttagacgtgtgtctcaatcccctacaaactctttgtgtccatagcactgtggagggctcactgatgctcatactaatggtcccaaggttctctagatcacccattgctcgtcgatctagtcattagagtaggggaaattggttgaagcacgttctatagttttggggaaaacgtcttctgctaactcttacttaaaaataatgtttctacctacaccaaatatgtatttaaaaaaacaacaaaaaaagtttctttcaacaaaacatttcatttcttgagcatttctggtaagtctaggattgattatcccagatgtgttgcacagaattaaaatacagtaagaaaatgacaatacagtcaagctagtgcattaaaccaaagacactgtaggaatatcaccaactatgttagatgataattttggggcatcttgcaagatggagcattgtttatagtaccagtgattgcatgtattttatgagtgaaatgttgctttaacaagtaagtatacatgtgggtgacgtctgggatttaatgctcaaacgtaaaaactggtgtgttagtagcatgatttttgaccaagtatttgaatatagaagatgtaaataaaacagctttgaaagatatgtcaaaggagggtgcaagaaaagaggaataaaggataagatgtaaaatgggaaattttatgtccactagtgtataattgtgtagaatggcacatttataaaaaagcaaaacgaagatgtcagaggtttgcctccagtgtccgggcttggctgccttggcggctccgtcccacccacacagccggctgcaggtgggcagctgctaagttgctgccctggggagtctgcccagaaccttctcttgtcacttcccgtcctgcattcccaacttgtccactctgtcctggggcctcaggggcctgtctcctgcctcgcttggtgccttcctgctcaaagactttgcttggattgcctttgggagttcatcctgatttgcccctggtctctgcctttcagaccacatcctactgtccaaagcactcctctctctccatcccactgcctagaaaccagatgagatctggtgtctcagttacattggagcagaggtcagaaagcaccagctcaccctttcctgtaacagcactgttgtttgtgaacttgacttcatggctgggaaaaggtagggggttgggggccctgtgagtcaaccaacattgatacaagtgaatcaatgttgaacgtgccctcaagcgtttatttactcaggtggctcgtgcattggcacaatatatcacatcagctggtaggcatcctggggaaggaggcagagggaggcactgtcccatacaagagccggaggggtgaccagagcgagtgtgtcacagccttcagttcattgttggtctgctgaggagaatgcacgctaaatagcattaacgtttgcttaatgtatatataaaggcagtctactaagccagaatgcttatgagggggggaaaaagacagaaatagtcccaatgacaagcagcttaagaactagtgagataaaagacaaaccagatacaaggacagagcaacagaagacagtgtgtggtcaagtgtgagtgtggagcggctgataggaaggagagaaggcagctgtgagcaggcgttggtgaggcaaatggaatcattgagtaagtgatgacctgattgtaggagaccaggccttgaagataagatagagacttgtacaaagcagagccaaggaggggccaggcaaggcagctcatgcctgtaatcccagcactttggcaggctgaggcaggaggatcacttgagcccgggagtttgagaccagcctgagcaaaatagtgagaccccatctcttaaaaacaaacaaaaagttttagctggatatagtgctacaccctgtggtcctggctacttgggaggctggggtgggtggttgaggctacagtgagccatggtcacactgctgcactccagcctgggtgacagagcaagactgtctcaaatagtgataataaaataggagccagctgggcacagtggctcattcctgtaatgccaccactttgggtggctgaggctggtggatcacctgagtttgggaattcaagaccagcctggccaacatgatgaaaccctatgtctactaaaaatacaaaatttagccaggtgtggtagtgggcacctgtagtcccagttacttgggaggcgcaggttgcagtgagctgagattgcaccactgcactccgacctgggcgacagagcgagactctgtctggaaaaaaaaaaaaattacctgggtgtggtggcgtgcacctgtaatcctagctactcaggaggctaaagcaggagaatcgcttgaacctgggatgtggaggttgcagtgagccgagatcacgccactgcactccagcctgggtgacagagtgagactctgtaaaaaaaaaaaaaaaaaaagagccaaagagaacagcatcaaacctcccccaaaagattgtgatatgcagccaggttggagaaccactgatgtggcttgaaccctacattttaaaaagtgactagattgagccacagagcctaagagacttgctcatgttgcacagcttttagtaaagtaaactcaaataaagccatattcccaagatctctgtagtctctacaccaagaaaacagtttgtttatttaggtttctgatgttactcagaagatttaccatcaaagtggcattgttatgagcgattaccttgaaaacgttggcagaagggagatttggtggatttccccgcagtgaattcactgtgctgggtgcaaatgggtccaggccccatggctgttgcattcactattctgacttggccataatacactcactgtgcctgcacgcctgcccattagtaattcacagcttgttctcctagcaagggtggcagaggcttgctcctttgtcctctgtcctcactcatcttccagggccgattcttcccaagtatgtggctgtgagcgttcagctgagcagagctggggcatgtttttctgatgttacccacagagaagtgctgatgagcttctgctacatggtaagattagaattgccagatttatagtaagggttgggcatcctaatccataaatccagaatccgaaatgctacaaaatctgaaactttttgagcactatgacattcaaaggaaatgcttactggagcatttcagatttcagattttcaaattagggatgcttaactagtaagtatgatgcagatactccaaaatctgagaaaaatctgaagtccaaacccctctggttccaagcattttggataagggattctcaacctgtagtgtgagtaacccatatacatctgagttatatggtcacaaagtttgaaagatgaccttgtcaaatttacatgagaagggccaggcgcggtggctcacacctgtaatccgagcactttgggaggccaaggtggcaggatcccttgagctcgggagctaaagagcagcctggccagtatggtgaaaccccgtcactactaaacacacaaaaattagccgggcctggtggcgcatgcctgtagtcccaggtactcaggaggctgaggcgggagattcccttgaacccaggaggcagaggttgcagtgagccgagatcacaccactgcactccagcctgggggacagtgagattccgtctcaaaaaaaattacacgagaattgatgatttcgttgttatttccatgcatttctctacatggtgagtgcctatctggaaagtaatcatctgtaaatttcctccaagtcattcatttggttaggacttacttacgtatttaaaacagtcaactcatgtttcttttgcggtacgcagtgggaggcatgccaaactctcttttctcaggagtccccagggatttcattcccagctctgcctctagctggccttgtaaccttggatgagtcagttcatctctgtaaagtgagacatccaaccagatgatctttaaggtccctctcagttctgaaagtactcttggcacttgtacttaactcacattggataaaaaagggaggcaaaaagtaaggactcttagataagttattcaacccactttcactcactgaattctcttctattctgtacactgtcacctttaaccgtagttcaaggtcacatagccagtaactggtagaggcaggatttgaaccaaggaaagctgactcctgagtgcatgctcttaaccgcccttttacaaaggccactggacatggtcggcctccttgggaataggaccctgacgagtaaccacgttttggtcagatagaagaagagagcgcttcagagggaaagagatgcgtggagggctcagaggtgaaaatgagccgatgtgtctgggtttggtgaggagctagatggctaaagacaccgggttactcagcttaagggctgggagagcaaaggagctggaataccaggcagaggtggtaacgtgcaattctgtgtgcaatgggagaagctaatatttagaactggaggtaatgataaaatgattttcaggaaagtatatctgatacgtgatgaaaggcatctgaaggggatgggggagacatttctccagaaagactgatttgtcagctgacagaggagaaatgagagagtcaatggtgatagcagcctgggtgacaggtggagttgcagctcggtggaaagaactagaaatgccgagagtgggaaccaagtaagaaggaaggcttgctaagatctgggagcctgggttaaactccaggggaggtggcacagcctcggcaggtccacacaggcaggggagcagaatggctaagaaacagccatgccgcactccaaatgatgtgttatactccagttggcagtgtttccattaatcagaacaaaataatacacagtagttttaggcctctaaaggaattcttggtggccctgcctgttggaaattcacattttaaaaaggcaacactttgtaaaactaacctccaggtatttaaatacacatgagcccttgtgcttacgcatttatgcagtatctgtttcgcactttataagcagttttacttgttttgcttttattatagcttttcttttcttttctctcttccctcttccttcttccttctcctctcttctcctctcttttctttttttgagacagtgtctcactctgttgcccaggccatagtgcagtggcatgatctcagctcactgcacctctgcctcccgggttcaagctattctcctgcctcagccttctgagtagctgagattacaagcacctgccaccatacccgggtaatttttgcatttttagtagatatgtggtttcaccatattggccaggctggtctcaaactcctgacctcaggtgatccacctacctcggcctcccaaagtgctgggattacagatgtgagccaccacacctggcccagtttttcttttcttattataaaataacacatacttatttgatctagaaacttaaaaactataaataagcaaaaaggagaaagatcactgaaaaccccaagaaacatggttaacacagtaatgttgaatcttctagttttgtatttagtataaaaaaggtatcaaaatctgcaaactctttaatgactaactttccccctaatctgttgtgaatattttttatgtgtaaagttatcaaaatattctatctcttttatgattaacttttcccgtaatctattgtgaatatttttatgtgtaaaattatcaaaatattcaaactctttcatgattaactttgcacctaatctaccatgaatattttttgtgagttatggctgtaatactgtagtaggtttagctaaatctcttgggtctctccatctcttagatcatgccccattttttacgatcactgtcattgcggtagctaacatctaggtagcaaggatctcttcctctgggtggaattgttgggcgtattttaaggcctttgttccaggtggttggaggggattttctgttgggaggatcgctggtgtgtcaggtatggttttggtttgtggtgtcaaggggatatacgcttctcattttctcagagtctagagaatatctgaaggaggaagaggagcttttcctttgtaaaggacctggatatgctggacagagggtcaaaaagaatgatgaccccagcaggtgacagaggggaaatgaaaagggaagggggacttcgcagtatggcgggcagagtccaggcagtgccaagaataggacctgcaggggtgagagtgatgccggcagggctggagggatgtagcgtgtgcagtctcccgtgaagtagtggggaagtgcttagggtgacttctttttcaataatccagagaaggccaggcgcagtggctcatgcctgtaatcccagcactttgggaggccgaggcaggtggattgctcaagctcaggagttcgatgccagcctgggcaacgtaggaagcccctgtctctacagaaaaatgctaaaattagccaggcatggtagtgtgcacttgtagtccaagctactcagaaggctgaggtgggaggatggtgtgaaccccacggaggtcacaccactgccctccagcctgggtaacagagtgagaccccatctcaaaaaagaaaagctaccttaaaaataataataagataataatacagaggaatctggcataagtgattgcagtagagagacctgagccacatttcacaacgtaactggttgttgaggtggaaatattgtatcacattgcaaggattttgaatagttccttggatagtatgcaaatgtggagatagatgatagatagatagtagatgggcaacagacagattgacagatgatagattgatagatgatagatcagtagatgataggctgataaatgatagattgattcgtaatagatagattgatagatgatagaggaatagagctattccagcctaatttctgatacaagaactatattcactttgaagtcctttagtttgcatatttgtttccctgagatcatcatgcatattttttctttcttttttaaagaaacataaacagtgacagtttcagtatgttttacccagctgtctgtttcccaggatctgtactctgttcatatggcacgtttcctgcatatcattcagccattcttctctgacacgttctgagacggagacttacaggaaatacaggccctgtgtaaacacttgaaacacagacaagcaaatacccacgagtctttatcgctcttgattcttggcacagttccttgcatgtggtagaggcctaacagtttttcacatgaatgtagaataaggaggatatttatgttttaattttgtaaacttgtttagagacaaggtctccctctgttgcccaggctggagtgtagtggcacaatcctaggtcactgcagcctccagctcccaggctcaagtgatcatcccacctcagcctcccaagtagctgggactataggctggcatcgtgacatccagctaatttttaacatttttgtagagatgggggtctctctttttccaacagaggcagcacagagcgttcaaagcagaaaatctttgtttatctacctgaggcaccctgggaaagttgtttgaactgagcttcaaattcttctctggcagctccaacacttcctgtgtagccttgggaaagttacctaacctctccagcctgtttgttcacctgccacgtggggttaataatagcacttatctctcagggcttcatgaggatcaaatgagtcaaaatgggtaaagggcttacagcattgcttagcacatattaaacactgcttaagtttcagttattgttataagtctcatcattgccatctcacgggattgagaaaaagtaaagtgtctcttccgtattgccagttatgaagtcgatgcttaataactgatgggtgtcccattcttgtttcctttaattaattaccggatggtttagtgttgacttaatagaaaacagtgtaccgtttctactatggaatttaaaattctgagctcatttaactggatctctcatatttttgtttgtgatttgggagtgtgtgtgtgtgcatagctatacttagcagattttacaagctgttagaggtgccatcactcagtcaaaattgcttcatttcatttcatttctgtaggatgaaaatccatgccctcttaatttataagtgtttgtaacctgagtctgtgtgacactagattagatgctctgccactcaatagctgagtaacttggacaagttgcttctctatgtttcggtgccctcaagcagtaaaaggggaaaaatagtacctccaacttaatgtagctgtgagaaccagggggaccataataatgacaatttctaaagtgtttcgagtctgggtgtggtggctcatgcctgtaatcccagcacttggggaggctgtggtgggagattgcttgaggccaggaattcaagactagcctgggcgacgcagcaagaccctgtctctacaaaaaaatgtaaaaaaattagccggatgtggtggcacatgccagctactcaggaggccaaggtgggaggatcccttaagcctaggagtttgaggctgtagtgagctatgattgcaccactgtactcaaagcctgggcaagagagcgagaccctatctctaaatgaataaacaagatgtattgagcacttctctgtggcagatgctgttctaagtcctgaacttgtttacggagcttggcagcgtgcctgcactcaacaagcattagctatcattattgttactacaagtctgaagagtaggtgaagccagactgtggaagacgagctgtagctaaggactctgaaggtcatggtggagctgggatttgaatctggtcagtagggttccaaagtccatgattttattttattattgttattatttatttatttatttatttatttatttatttatttctgagagggagccttgctctgtcaccaggccggagtgcagtgccgcaatctcagctcactgcaacctccgcctcccgggttcaagcgattgtcctgcgtcagcctccccagtagctgggactacaggcatgcaccaccgcgcccagctaatttttgtattttcaatagagatgcggtttcaccatgttggccaggatggtctcgatctcttgacgtcgtgatccacccacctcggcctcccaaaatgctgggattacaggcatgaaccacttgcgcctggcccaagttcatgattttatgcctttcaccacagtcttcagccaacttgtcgtccagaataacatcgctttgttctgcacaaacttgccttttttcttctctctggagacctccttccctgggactgcatgccctcgatttgcgcatgttgacatccttcctttgtaccaagaccctcttggcctagaggctcttgctggttactctcctcggagttctcatggcatgttgtgtaggagaactcgggagcagggacttctctagacatcattgcatccctcctgtcctctccagcacctcccatttattttgtacttactaagtatgtgtgggtataataccaatgaatcattatcttgtaacccaaggctcacccttgcccttggcttgcagagtcttcaccggggcagacaggaaatggaccccactactattaactggccactgccccaagtaagatgcaccggtccctatatctgaggactgtcagctccctcctctgtgccatctcatgacttaggccacccccaggagagagcagcctgggctaaatacaggaagcttcagtcctccactgatgggagcaagactctgtgtgtgttaaggccaggggagcgtgttggaagccatgcacacacatacacatacacggggtcttaaaatttgaacactttcactttgaaacatggacttggccatcactgagatctctgtgggtcagggctagaactcctagtttagaaagaaaaggccagaggcaagctgatgtgttggcgtgttcagagctgcttcctgttaatgtgaattctgcttctcttaggacgctttttcctggcatttggtcatgacaccttctttttgctccacttaaactccccattcgccactttctccatccctggggatggtgttcagcggttacacagaaaggaagggtctttgatgaagcatctctgtacagacactggctctgaagggctcagggaatccttgtctcccttgcgtgacacggactcagcctccagaggccctcggtcacttccaaccccttgcgtagtctgctgcctagacgatgagataccattggtagaaatggacattctaaatccaggccctgaaactgtaatcccactaaataatttgtttcctgttttatattgtttgcgtagaagagggggtggaaaaatgcagaactgttttccagtgcgtttccttccttccgcccccaaacctactaaagatacagcatgcagattgcacactggtggtagggttattcccaagtgttaatttcttacgtgcctaattactttcccagtaggaatggcatcttatactttctatcactacagtgctagcaaatgctcggcccagagaagatgcgcagtgaatttactgattgcctgctgatttggtaccctggttctgagctctacgggaatgtggccagaaattattgtccacatggggagactgtcgcctccattttcccttcccttttcttttcttttttttttaatttgctgaaatctagcttcatccttaaaactagcattgatctttccatttttattttttattttttaagtcagggttttgctctgtcgcctaggctggagtacagtggtgggaatcatagctcattgcagcctcgacctcctggactcaagagatcctcccacatcagcctcctgaatagctaggactacatgcacactaccatgcctggctaatgtttaattttttgtagatatggggttttgctatgttgcccaatctggtcatgaactcctgagctcaagcgatcctcctgcctcagcctcccaaagtgttgggattataggcatgaaccaccgcacctggcctgggtcgaccattttttatttgctgtgctaactatccccagtgctgcatgtgtactatttgtcatggctatagtaatcttcatgattactactattcatctgtaattaagatataattgggataacacaatgaatcaggcattgcacaaggggctttgtatgtattttcttatctaatgagtggtattcagaacatacttaattgacttaaggaagacttgctcacaagcgattcacaagctgtgggtttcagggaagtcatttctgctgtctgagactcagttttccccctctgcaaaatagggagctggatgcctgcctctccagattctttccttttccatcactggtttaactcaattcgctcatgtttagggagtccttactgcatactctgcacagatttgttgcttagagaatataaaacaaatacagttcagttcctgcctcaaagcttgtaccatctagtgtaatgacaggaagccaggggtatccgaggggtagagaacaaggaagtcaattatgtcaggcaaaagtggggagattcctgagagtcgatcctaattagaagcttcctgaaggaggagagatttccgttcagggtaagggaggcagttgatggcgtgggagtacagaagcaccacttggcagaactggtggacaaaacaagctattccgcagtgaaccagaacagggctgcgttcaggaccaactcacctgacattttccctatgctaaatgtaaactggtcacggtattgattctgctgcaagataaactgcagaatctcagctacatcataaaagtatgtggatctcagaagagcgaagcatttggatgttcgagatgagtccccagattaaaactgcttattttggcgcccccatgtgctgaggctctcagcctcaggggaacctccagtgtgaggatgataaatctgatacatctggatttgtgccacaatataatagaattaattaccattgaaattggctaatgctagtgtttaataataaatatgtatgcccctcttcatttcagaaagaaactgaaggggtttgcaaatatatttgccatgcaacaagttacaaaatacaaaagataaggaagaaaaataaaagaagaaataatagagtaaggtcagaggaaaagtcgaaatgcccaaaccctttaaatactttattagaagtgggctgtatgcatactttgggctcaggaccttatcagccaatgcgttttcttcctaaaagaaagtttttggttttaacatgataatgtagcatgtgtaagattctaagagttaatgcagagacttatctttattgatgaaagggattttggatattgcataatgctgtgtgctttcatttatgttgactgcttacaaacgattcatgagacacaggctgaaagcaaaacaccaggccaaggctttctggctgaacttctgaggctgcatagctattgcaccaatggttttacttaaggaaaccgcaggtctgaggacaattacattctccaagaagaggaattctctttgacatttattatttcctttgaggagaggcttttctctctgcttcccccacacacccatttatcagaaacgtactctttattttttagagacagggtcttgctctgtcacccaggctggagtgcagtggcgtgatcatgactcactggaatctcaaattcttgtgctcaagccatcttcctgccttagcctaccaagtagctaggactacaggagtcagccatcatgccaggctcattgtttaatttttgtaaaaatggggtcttgctatgttgctcaggttggtctcaaactcctggcctcaagttatcttcccatcttggcctctcaaaacactgggattataggcatgaaccactgccaaacacattcttttttttgaaatttattttagtggtgacacattggtttattaaaatatgtagcaatgtatggtgaaaataatattcatattttcttaaaacagaatatttcagtttttagtgatagattttgctttttagggtggatttaggttgcagagaaatggagaaaaagatacagggtggccatttacctcctcccctcctgcacacagttttcccattattaatttcttacgttaatgtggtacatttttgacaaccgatgtaccaatatttatacatcattattagctaaagtccgtagtttaagttagggttcacatcttgtattgctcattccttgagttttgacaaatgtataatattgcattttcacgattaacatttctatgtatttgatcactgcatgaaatatgaaaacagtagtaaaatccagaaatacggttatgaataaaattttttgaattgttgcaaaaaatatttacctcattgtattacgctgaaaagccgaataatccatcatgttgctcaaattgttttagaatgaactttaaaatgtaaaaatgtcatttttttcctgatttcttttttttcagtttttatcattttttttttattatactttaagttctaggggtgtttgacaagtcaaacacattcttatattactctatgacatcggagaaagattggggcaagtctgcccagagaacagtggagccgagtgtgacagctggagggccccagccaggtctgacttgctttgagttcatgtgtcttttattcctagcgtcaagcagaatgagcgctacggccagttgactctggtcaactccacctcggcagacacaggtgaattcagctgctgggtgcagctctgcagcggctacatctgcaggaaggacgaggccaaaacgggctccacctacatcttttttacaggtaaaatacttggtgcattaatggaactcttcaaacttctggaccgggctgagagctgaaggttcccccactgcatgctgaatagcaaataatgacaatcagagcacttcctgtttgccaggctctgggctaaatgctttacatcagttatttcatgtaagtcttaccgtaacccttcagggcaaatactaatattattcctgtttttttttttttcagatgggaaagttgaggtttagagtgattaaataagtccttaaggtcacacagaaagtaagtggtggtaacaggatttcaacacaaaccatttggttccagggtctgtccctgcactccccaatacggtgaccactagacatgtgtggctacttaaatgaaaattaaaatgaaataaaattaagaacaagttctcagtgcacttgccacatttcaagtgctcaactgtagcatgtggctaatggctattgtactagacagcacagagagagaacattccctttatcacagaaagttctattggacagtgctgctgttgactttcatcactgtcttctcagaacctatgaccatcttctttttggaaactccataggatgcttcactaaagacctcccatttgtcctttttattattttgttttttgatttttcggtagaagtgaggtctcactgtgttgcccaggctggtctcgaactcctgaactcaagctatcctcctgcttcggtctcccaaattgctgtagttacaggcatgagccattctgctcagccctgtttgttcttgtgaatactatgagctgagatttcgggggcaagattcccaaagattgtggctgttgtgtctccagtccctgtccctaagcctcagtggactgcctcaaaatgttcaggtcagagtggagaactcttctctgcagtgcaaagtatgtttctggaagatggagcttgcattttgagaaacacgtgtgcagaataactgctcagcctctttcttctgtaatgttctctaagttctgaagtttaggggatgaagttctccagcaaggttcagaagtcagtaagagctttcaggaatcttacaaagccaccctcgtcctattgtcgtccaagacatttcaggtgaaaccagaatcctttgttagtgcctgggcagggactttcatgaaatttctccatgccttgaatccacctacctttcagacgtagacctagacataggcctagacctagacataggcctatgacccaaaggatgttatgccctgaccattaaagaatgttttagtacaatcttatgtatttgtcctttcctgcccaaatagctcctctctggcaaggagatgcattagtagggtatgctgcagttctggaagcacatgtatctcattttgatgcagactttttactccttagttcagagatccaagttcttgtctcatgccaggaaaacttaggcacacagacacttaaaagagtgcgtggagtagaatttattatgcgaaaaggaaagctctcagcaaaaagaggggtcctgaaagcaggttgcaggttgctctccacacaattgaatacaagggcttctatgttccctcggtagggctgggttccctgtttgtaagaggcgtgaattcctggcggctccaccccatcctttcagtgtacctgcaggcccttaatctgagtcactccacgttgatttatttcccttactgcatgtgtgttaagggatggaatttttcactgggggtatgtttaggcaagacccctgtgcacaatgaccttggtaggtcagaggttctctaaggacattcccgtatctgcttaggagagttctctgcctcctgcctctatcagtttcattccacaacatccctgggaaataagcaaaagctattttattatctccaaaatactagaagtactaatgctcatgctgagcctcaatgttccaggacctgtagtggcacaataaggagccaaacctgtttttctgacccaggatccagtgtttttactgccttgaaccttttgtaggacaaggtgaaggatggactgatagccagattctagctagcataactggtgttgtcaggagaattgctaataattgttcataggcaatctctttggatcttcattttggaactcgctacacaagattgtaaatgtgccctttgtattataccatgctgtgaagcaacagtggaaaaagcaatcaactaagatgaataaaagtctgttattcaagtcaatgactgatgccacatttcaagttgcagaaggaagattctttgccaagattagcactgttgtgtcttcccaaagtattggtcgaggttttgaactgcaggcttagcttgggcagaatatcctattaatattatgggctcttggccaggcatggtagctcatacctgtaatccagcactttgggaggccacggcgggcggatcacctgaggtcaggagttcgagaacagcctggccaacatggagaaatcccatctctacaaaaatacaaaagttagctgggcgtggtggtgcacacttgtgctcccagctactcaggaggctgaagcaggaggatcgcctgaatctcggagtttgtggttgcagtgagtcaagattgcgccactgcactccaacctgggcgacagagcaagactttacctcaaaaaaaaaaaaaaaaatacgggctctctttgagttttggaggcggaacctttttgttttttttttaactgaactaattttgggaaccaaagaaaagctaaaatatatttattccaactatcaagaaactttgatcaaaaaaaataaatgctgtaacacatttgacctaatgtgttatacatcatttattttttcttatttgtcaacactaagctaggagtccagttggatttttactatagggtttggcaatttgtcttttcaagcatggatggctttgagaaaccaagatgggctgttacagaagctgaggttctcactgctggctcaggattctttcagaacatgtgtttcctggctacccatgtggagaaatgtttgtcattcattatgtttgtatgtttcctagagtttgattaaaaacactgaagcttcttttgggggactgactgttgttagtgtgcaatttgtgattaaataattgccgtatgtatttcctctttcatcttgatccaggaggatcttggaaggttttccctgcttctctttcacttcttattgtagtataacatatgtaaagaaaaacattcaaattctcagaatacagctcaataaattatccttaagcaaacaggcacatgtaactcccacccagatcaaggatgagaacattaccagcagcagggctttctcatagtaaaaggctgaggctctaatttttatacgtaggaaaaccacattaataagtactttcctggctgggtgcagtggctcatgcctataatcccctagcactttgggaagccgaggcaggcggatcacttgaggtcaggagttcaagaccagcctaaccaacatggcgaaactccctctgtactaaaatgcaaaaattaggtgggcatggtggcacacgcctgtaattccagctactcgggaggctgaggcacaagaattgcttacacccaggaggcagcgagtcaaagttgcagtgagccgagatggcaccactgcattccagcctgggtgacggagtgagactgtctcaaaatactgaatttgttgtaatttggatttagtttatagcttgttaacttgcatttatttatttttttatttttatttttatttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccatttttttgtttttttgtcttttttgagatggagtctccctctgttgccagattggagtgcagtcgcaccatctcagctcactgcaacctccgactccctggttcgagcgattctcctgcctcagcctcccgagtagctgggattacaggcatgcgccacagtgcccaacgaatctttgtatttttagcagagatggggtttcaccatgttgtccaggagggtctcggtctcctgacctcatgatccgcctgccttggcctcccaaagtgccgggattacaggcgtgagccactgcacctggtcgagttttttttttttaatctaaaatcccatgtgtttagttttctttaagtaaaacatttgtcttctagatgagtggatataaatacatttgcaggggacatgtgtaatctataattattaaaacaaacttcaacactttgttattgttgatggaagctacggattgcaaatatatttttaaagcaactggtttggtcacatttcaaagtatgtattatagtataagaagtaaagtatatattatagtataagaagtaaggctgggaacattggctcatgcctgtaatctcagcactttgggaggccaaggcaggaggactgcttgagtccaggagtttgagaccagcctgggcaacatagtgagaccctgactctagaaaaactaaaaaataaaaaattagacaggcatggtggcacgtgcctgtagtcccagctactcaggaggctgaggtgggaggatcatttgagccctggaggttgaaactgcagtaagtcatgatggtgccactgcactccagcctgggcaacagcgtgagaccctgtctcaaaaaataaaaatacaagaagatatttttgtgttcttaaattcacacggttcacttattcgactaatggctctgcttatcgcttcagattattctacacacttttaaaacaaaagttgcctctaaatcttgcaatcataaaatcctaaagtgttgttgctaagaaaacatcttcaatattatccactccagattcttctcttgacaaatgtggacattgaagcatgaggaaataaaataatgcctttgaggccatgtagatggactctgtgtgaactcatgaacattaggcatgacgttgacaaaggtaccccttacctaagcctgaaagccaatttcttatgaagttgcacagacctcccagcctgatggaaacccatgtaaaagacggagactctctgagccatgatatactcttccctcgtcttagagtcaggaggaaggatctccgtgttagtgaacttggtacttacagcccaagaactcttggctcatgaaccatttgatgatgtgtccaggaattctgcccccaacctaaaacaccatctaactgtgacacaaagaaggcaagtggggaagaaagccaagaaaaattatttatttcaggaacactgtggggaaaacacaagaaagcatgtaatacgtattggggtatcactagctctgaagatttctctttgcaaatactgtaatattccctcacagaatgatccagaaaaacaaaggattcaatgtaccatgccaaaaaagaaaagccaccagcaccaacaaaaatacccccaaaagcccagtccagagtttcttgcctgtcctaaggacagaattggtaggccagtcctcgtttctcccatttcagtaagataaaaatgccatcatctgagcttaaagaaccaggcagagtaatttcagaggaaatggggggagataagagactggctgaggattcccagccaggtgctggccaagccgagagcagacctgagactgatgggttcctccttcaagccgacgccattcccctccgctaaccttggcaggcgccagatcctctgggctgtgtgaggacaggctgaggacactgtcaccgtgctggggctcccaggggagctctgatgtactgggaaatgcttcctggctggcagttactgactgtggctgtggggctgatttctccacccacaagcagcagatggtttcaaggttttacaactgctaagggtttaaaacttacaatcataaaatcacattagtaagtgctttcctaaatattgagtttgctgtaatttggatgtagtttacagcttattagcttgattttttgtggaaatctaaaatccaatgtgcttgtctactttaagtaatacgtgtgtcatctacatgagtggatgtaaatacattttcaggggacatatgtaatctataattattcaaatgagctttaacacatttttttgttgatggaagctaccgattgcaattttttttttttttgagacgcaatcttgctctgttgcccaggctggagtgcagtggcatgatctcagctcacagcaacctctgctgcctcctgggttcaagcaattctcatgcttcagcctcccatgtagctgggactacaggcgcgcaccaccacactcagctaatttttttttttttatttttagttgagacggggtttcaccatgttgcccaggctggtcttgaactcctgagctcaggagatccacccgcctcggcctcccaaagtgctaggattacaggcatgagccaccacgcctggccagattgcaaatatatttttaaagcaactagtgtggtcacttacttcaaactatatattatagtataagaagtaaggctgggcatgttaaactttaacttgttaaaggttaatatgttaaatcttaatttaaatcttgttccttgcttcctcatggtggtgatccatgggcgtcatctgggcttgtactgataccttttctgttttctttctttcttttttttttttttttttttttgagacggagtctggctctgtcgcccaggctggagtgcagtggcgctatctcggctcactgcaagctccgcctcccgggttcacgccattttcctgcctcagcctcccgagtagctgggactacaggcgcccgccaccatgcccggctcattttttgttttttttagtacagatggggtttcaccgtgttagccaggatggtctcgatctcctgacctcgtgatctgcccgcctcagcctcccaaagtgctgggattacaggtgtgagccaccgcgcccagccttctgttttctttaaggagacaggaagttagatcattcttccaaaaaatgaaaagcattaaagtaaaaaaagaaaacccggcctttcctactcctaaggactcagtattcagagtatgctgccaaaatccttaagggtgcttttactttgcgtctccggagtgaataagcctgtgtcttccttccctttgcagagaaaggagaactctttgtaccttctcccagctacttcgatgttgtctacttgaacccggacagacaggctgtggttccttgtcgggtgaccgtgctgtcggccaaagtcacgctccacagggaattcccagccaaggagatcccagccaatggaacggacattgtttatgacatgaagcggggctttgtgtatctgcaacctcattccgagcaccagggtgtggtttactgcagggcggaggccgggggcagatctcagatctccgtcaagtaccagctgctctacgtggcgggtaagcctggccacccctgcctagattctagttagtcccctggtcagtttcaggtactgctgttccctgcctgcagatggaataaggaagctccatgagtgccttttgtttcattgttgttgggttgttgttgtttttttttctcttttttcttgagacagggtcccgttttgttgcccaggctggaatgcagtggcacaaccattttctcactgcagcattaaagccctgggctcaagcaaccctccctccttagcctcctgagtagctggaaccacaggtatgagccaccatgccctgctaacttttttttttttttttttttgtctcatagagaagaggtctccctaccttgcctgggctggtctcgacctcctgggcttaaacaatcctttgatcttagcttcccagagtgccgagattacaagtgtgagccaccatgctcggcccacttatgccgttcttaaaggcttcccttctgccccaccacttctaggatggatgttctccttccttgttatgaccctgaccgaaaacccctcttctccattccagccaaatccttccatcgttcactctggtgctgcctctgtgttggatcaggtcttctatgtccccaaactcctttagagcatcctcccagcctcttggtctaaacccaaatctgctgtctcctaaggacatcattcattcccacgtcaaggctggcatccttcttgtacccattgccacctgccaaccctcattctctgcccttctgttgggaacctctgctctttgggggctctaccagcattctcatttcctttcctgtcactcccatgcattcatcgaacattttggcacttggttcatggccctgcttgtcactccatttttagggtgactttgatatcgacttggtacccactggccaggttcatggacccctcatccgttccacctcagatattcccaccctcatcacaatgtgaacatgtcaaccacaaccactgtgacagcaaccaccggggctgaccccagctccagtgacacaggcttgtactttcccaggattctgtgttcaatgactccctcagccacagtcctcacctgcacccaccctgttcttgagggctttctgccctccccacccatgaggcttagatcctgggtcccaccacatcagtactcactacccacacccggcacgccctcctctctgtactcccctctcctgtccaggaaagaaccaccccggatgaacacaactaaccttctccccatgcctgtactcagagagttaagagctgttgggacactcccatgggagggtagagggcatggccatgaatcccccatctctcgtctaccctgcctggtgtcctctgcattttgtcccgtctttcttctgttttccccaatgtgcacagaacacttggagttctcaaattcccgcctcattctcttccagttggccttactcccttactcttgacagaactgaaacatgatcagtctctcaattaaaattggaactacttctttcaatgtggccattttagtgaggagtttcatttcatagcatttatacatgaaatacttttttccctggtaactgccatccgttccattgtgttgaatcccccttttcctgagggtagggagatctgttggtcatgtcgagtttccctttgatatccaacaggcttgctgggtgagtaagacagcctcattctggtttctaagactgtttgtttaaaatcttcagtcccaacaattcatccaagcctgctttctgctcttcctgtcacatgcaggctccatggtgagtgcagcagctctgagtcggaggccacagttccctccgctcccctcccctcccctcccctccctgctggggcaccaggttaggggaagtaagtgagagaggtcagaggaagtaagtgagagctggcagtccctggtaataaatgctgacctggcttgttgtctgttagcctgatgggaacagatagtgactccagtggtttgtcacaggtgatagggactcacctgtcacaagcccccttggtgtcctaggccctgtcccatgcagcctcgccttctcctggaccctcagctggaggctgcctctgcttgtatgaacttctttgctctgagctgcagcatggctgaaagagcctggagtcctgacatctctgtgtctacctgatcacctgactccagagcacgtggccaccagaacatacagtggagacacagtctgggccctctttacttctcgaagtcccccaccctgccatcttgtccagagctcttttgccccgggctgatggcataggggcaggctaggagcagttgcgttgcagaacgctgcaacaccccccacattccttggcaagcagttctctgaggccgctccctcgcctttctggagtgaagcaccctcttgccagccttgcaagggaggaggggaaatagtttctcttctggcactgtagtccctcaaaggtgactttagtctctccgagaactctcaccttgaccaggggagagtggtacgtgtgggcagagtccatcccctgcagtggagcttctcagccaccctgtcggggggatcagtagccccgagagtgagctgctctctgaagttagaatttgggttctgtcatgcctcgtgttctcagccatggtgcttattcagcaggccatgccccttacaccctgttaccaaatccctctcacagccctgctccacctcccccagtgttttgctgagcccaccactcttccccactagaaccaagtccctgaatgaaagagctctccatgtccctctccacttcctttcctcccacacactcctttgcccactcccatctggccttctcccttgacttccaccaaaacggctattgccaaggtactcggggacccccatgccattaaagtctgtccctgtcctcctggattccacctcacctgcagggaacagcctctgccctggctccatttttcccagcttcccccacctcccccacagctttctcactcttcttggtcagctcttagccttctatcaactttgaaatgctggtgctcccccaggcacccttctttcccactccttgttctgtccctgggccagcttcacatctgtacactggtaactcccaagtgaacggaagtggccggatctaggagcatcaggtccacgtgtccgccgtccacctcaggtgtgcaatgagatgcttcggggtcctccatcctccgcgtgccatccctggcctcagtgccatcctccctggacctggttcttcctcctcctctgccttggtgatggcactaccttcacccacgggtcaggcctgcggctggaagccaagctaacctccctcctcctcccgatcctttctacttttttcattaaatcactttcaaatcctactgtttctctccatcctcactgcaaaaaagggatcaagctagcattgtctctgccctagacttatgtgaataccttctcatttcccctatgtccaccttttctttctccactccattttccacactgtagctgattttttttttttttaatacagagtcttggctctgttgcccaggctggagtgcagtggtgtgatctcggctcactgcaacctccacctcctgggctcgagggattctcctgtctcaggctcagtatctgggattacaggcatgcgccaccatgcccagctaattttgtacttttagtagagatggggttttaccatgttggccaggctggcctcgaactcctgacctcaggtgatctgcccacctcagcctcccaaagtgctgggattacaggagtgagccactgtgcccgttccctgattttaattaaaccaatcagtaggttcccacttctcccagaaacaaagtccaaatcctttgcgtggcctgaatggcctcacatggactcacctctgtcctcctccccatccaggtctcactcctccctcccctcctctccccagccctcctccactccgccactgcctctcacccagggccatgaacatgggcattcccagcctgctggtgtctccctgcttctcctgttcctgtctctgaagctcggccttgagattttagttcaaacagcgcttcctcaaggaagcccttcctggctctcagactgttctattctggccttttggagtactctgggcttctgcttcatagcttttaacacagcattttaaattaaccatacgatgactcactcagtgtcccgcccctttgctagaatacagattccaagggctcagagatcaggtccatctccctccctgctctaggcccacctgctagcacatagcatttctcaaggctgccatcaaaattgctcattaacacacctgtaatcccagcactatgggaggtcaaggcatgagaattgcttgaggccatgagttgcagatcagcctgggcaacatagaccaaaaaaactgaaaaactagccaggtgcagtggctcataccttaatcctagctactcagaaggcacaggtgggaggatggcttgagctttcctccaggatgcaggagtttgaggctgcagagagttaagattgcaccactgttggcaggcgcctgtagtcccagctactctggaggctgaggcaggagaatggtgtgaacccgggaggcagaacttgcagtgagccgagatcgcgcagctgcactccagcctgggtgacagagaccccatttctaaataaatagacagcttgttgagtgaattccccataatgaagaaatttgtttctgaaacatgatgaggcaaaggcactgcagacccaggtagcactcatgcccaaacatctttcacatctgtacatttagattttctgttcgtcttctgcggatggtcagccacacacctatctgctccctgccacccctgtggacaccaccacccagtacttcctccctgcttcttccctagggacttcttccccctcacctcttcattctcttcacatgaccactgatggacctctgagcttcctctcctaatcacagtcttggaggctgtcctgggagtcctggtgcctaccccattccagaccaccaaggtcaacagataaaggtggcttcaaaggaagccccaagttgtgggctcacactgtcctcgcactggtcagggagctgtgagaaaggcagaaaattccatctctctccatggaaaagaatgcatctgtaggtttgttttcaaggttacactcggggtctcactctgcctgtttcgtgcttgcttccagttcccagtggccctccctcaacaaccatcttggcttcttcaaacaaagtgaaaagtggggacgacatcagtgtgctctgcactgtcctgggggagcccgatgtggaggtggagttcacctggatcttcccagggcagaaggtaagtgttgtacctgcatctcagcccctgcgtctcagcctctgcatctcagccagccattttaattcacagcttcgtccccacccagtgctatatgccataacttcagaagtgcaagaaacatgtggggctatgttgggggccaggtcttgtttgttttttttgaagatgtttcggtatatttaaaaatgaatttcttttaaggacaggaaataagagattgagtttcattagtcagtttgctcaatgtaccctcttcatatgcaggtttttttttttttaaacccttaagtaagaaaggacagtaatgctcattgcagcgccattcacaataccaaagacatggaatcaacctaaatgcccttcaatggtagactggataaagaaaacatagtacatatacaccaaagaatactatgcagccatgaaaaagaatgagatcatgtcctttgcaggaacacaaatggagctggaggccattatccttagcaaactaacacagaaacagaaaaccaaatacctcatgttctcacttttaagtgggagctaaatgattagactacatggacatatagaggggaacacacactggggcctacctgggggtggagggtgggaggagggagaagatcgggcaaaataactaatgggtactaggctgaatattaatacctgggtgaggaaatgatctgtcatttcatgacacgagtttacctatataacagacttgcacatatacccctgaacctaaaataaaaggtttttttttaaaaaaaaggacattgggaggaaagggaaatgaaggatctccctctttcctcctgcccccacctcagtctttcaatcccatcttctgggccaactagagtctaatctaacctcctcctggggtccttcagagtgttctctttgtttttaatatattttgtcatttttgatttcaatcggtttttaagaacagtaggtgtgtgttacgtgaataagttccttagatgatttctgagattttggtgtatccatcacttgagcagtgtacactatacccaatgtataggcttttatctctcacccctccccccaaccctttcccctgaatccccaaagttcattgtgtcattcttaagtctgcatcctcatagcttagctcgcatttaacagtaagaacataccatgtttggttttccatttgtgaattacttcaattagaataatggtctccatccaggttgctgcaaatgccattatttaattcctttttatggctgagtagtattccatggtatatatactacatttctttatccactcattgattgatgggcatttgagctggttccctatttttgcacttgtgaattgtactgctgtaaacatgtgttcaaatatctttttcatattatgacttcttttcctctgggtagatacccagtaatgggattgctggatcaaatggtggttctacttttagttctttaagcaatctccacagttttccatagtggttgtactagtttacattcccaccagcagtgtaacagtgttgccttttcaccacatccatgccaacatcgattattttttaatttttaaattatggccattcttgcaggagtaaggtggtatcacattgtggttttgatttgcatttccctaatcattagtgatgttgagtacgttttcatatgtttgttggactttggtatatcttttgagaattgtctattcatgtcctaagcccaatttttgatgggattgttattttcttgctgatttgtttgagttccttgtagattctgggtgttagtcctttttcagatgtatggattgcaaaaattttctcccactctgtgggttgtgtgtttattctactgattatttcttttgctgtgcagaagttttttagtttaattaagcccgatctatctttgtttttgttgcatttgctttttggttcttggtcatgaactctttgcctaagccaatgtctagaaaggtttttccactgttatcttctagaatttttatggtttcaggtcttagatttaagtatttgatccaccttgagttgatttttgtataaggtgaaagataaggattcagtcttattcatctacatttggcttgccaattattccagcaccatttggtgaatagggtgtcctttccccattttatgcttttgtttgctttgtcaaagatcagtgtaagtatttgggtttatttctgggttctctattctgttccactggtctatgtgctatttttataccagtaccatgctgttttggtgactatggccttatagtatagtttgaagtcaggtaatgggatgcctctagatttgtttttttttttgcttagtcttgttttggctatgcagactcttttttggttccacatgaattttaggattgttttttctagttctgtgaagaatgatggtggtgttttggtgggaattgcattgaatctgtggattgcttttcgcagtatggtcattttcacaatattgattctacccatccatgagcatgcgatgtgtttccatttgtttgtgtcatctatgatttctttcagcagtgttttgtagttttccttgcagagggctttcacctccttgattaggtatatttctgagtatatatattttttgcagctattataaaaggggttgagttattgatttgattctcagcttggttgctgttggtttatagcagagctactgatttgtttacatgaattttgtatcctgaaactttgctaaattcatttatcagttctagcagctttttggaggagtctttagggttttctaggtatatgattacatcatcagcaaacagcaacagtttgacttcgctttatcgatttggatgccctttatttctttctcttgtctgattgctctggcgaggacttccagtactatgttgaatgcaagtgggcatccttgtcttgttgcagttctcaggggaaatgctttcaactttttcccattcagtatagacagttttcattaccttaaggtatgtcccttctatgccaattttgctgagggttttaatcataaagggatgctggattttgtcaaatgttttttgtgtgtctgttgagatgatcatgcgattttttgtttttaattctatgtggtgtatctcattaatgtcttgtgtatgttaaaccaccccagtatgaaacccatttgatcatggtggactatctatttgatatgctgttggatttggttagctagtattttgttaaggatttttgcatctatattcatcaaacatgttggtctatagttttctcttttttgttatgtcctttcctggttttggtattagggtgatactggcttcacagaatgatttagggaggattccttctttctgtgtcttgtgaaataatgttgataggattgataccagttcttagaatgtctgatagaattcatttgtgaatccatctgattctgggcttatttttgttggcagttttttaaattaccatttcaatctcactgcttgttattggtctgttcagagtttctctttcttcctggtttaatctaggagggtggtataattccaggaatttatccatctcttctaggttttctagcttgagtatgtaaagctgttcacagtagccttgaattatcttttgtatttctgtggtattggttgtaatatcttgtttcatttctaactgagcttatttggatcttcttggttaattttgttaatagtctatcagttttatttatcttttcaaagaatcagctttttgtttatcttttgtatttttttggttcaatttcattcagttctgctcagatctttatttcttttgttctgctatgtttgggtttggtttgttctggtttttccagtccttgaggtgtgaccttagattgtctatttgtgctctttcagactttttgatgtagtcatttaatgctatgaactttcctcttagcactgcctttgctgtataccagaggttttgataggttgtgctactattttcattcagttcaaataattttttaacttccatcgtgatttcattcttgacccagtgatcattcaggagcaggttatttaatttccatgtgtttgtatgttttgagggttgcttttggaattgagttccaattttattccaccgtggtctgagagagtacttgatataatttcagttttcttaaatttattgaaacttgttttgtggcttatgatatggtctatcttggagaatgttccatgtgctgatgaatagaatgtatattctgcagttgttgggtcgaatgttctacaaatagcccttaagtccatttgttttaggttatagtttaaatccattgtttctttgttgatgttctgtcttgattacctatctattgctgacagtggagtattgaagttccccactattactgtgttgcagtctatctcatttcttaggtctaacagtaattgttttataaatttgggagctctggcattaggtgcatatatatatatatatatatatatatatatatatatatatatatatataattgtgatattttcctgttgggcaagtctttttatcattacataatgtccctctttctcttttttaactgctgtttctttaacgtttgttctgtctgatataagaacagctactcctctataagacaggcctgcacctgtaatcccagctactaaggaggctgaggcacaagaatcacttgaacctgggaggtggaggttgcattgagccaagattgagccattgcactccagtctggctgacagagtgagactctgtctcaaaaaaaacaaaacaaacaaaaagaatagctactcctgctcactttggtgtccctttgcatggaatatcttttcccagccctttaccataactttatgttagtcctatttgttaggtgagtctcttcaaaacagcagatacttggttggtgacttcttacccattctgccattctgaatcttttaaatggagcatttaggccatttacattcaacattagtattgagatgtgaggtactattctattcatcttgctatttgttgcctgaataccttggtttttatttatttatttatttattgtgtttttgttttataggtcctatgagatttatgctttaagaaggttctattttggtgtatttcaaggatttgtttcaatatttagtgctccttttagcatttcttatagtgctgggtttgtagtggcgaattttctcagcatttgtctgtctgaaaaagactgtatctctccttcatttatgaagcttagttttgctgtacacaaaattcttaaattatgattcttttgtttaaggaggctgaaggtagggcctcaatttcttctagcttgtagggtttctgctgaggaatctgctgttaatctgacatgttttcctttataagttatctggtgcttttgcctcacagctcttaagattctttccttcatcttcgctttagataacctgatgactctgtgcctaggtgatgatctttttgcaatgaatttctcaggtgttctttgagcttcttgtattcagatgtgtagctctctagcaaggccagggaagttttctttgattactccctcaaatatgtctttcaaacttttagatttctcttcttcctcaggaacaccaattattcttaggtttgtttgtttaatataatcccaaacatcttggaggctttgttcattctttcaaattcttttttgtttgtctttgttcgattgggttaatccaaaaatctgatgttcgagttctgaagttctttcttctggttgttcagttctattgctaagactttccaatgtattttgcatttctctaagtgtgttcttcatttccagaaattatgattgttttctatttttgctatctatttcactgaagatttttcccttcatatcctgtatcttttttgatttaattaagttggagttcacctttctctgatgcctccttgagtagcttaataactgaccttctgaattctttttctggcaattcagggatttctttttggattggataaattgctggtgagctagtgtgatcttctggggtgttaaagaaacttgttttgaaatattaccagaattgttttactggttccttcttatttgggtagactatggtagagggaagatctggggctcaagggctgctcttcatattcttttgtcccatggggtgctctcttgatacagtgctctcccccttcccctatgtgtgtggcttcctgagagccaaactgcagtgattgttatttctcttctgtacctagccacccagcagagttactgggctctgggctggtacttggtggtgcctgtacagagtcctttgatgtctcaggtctctcagccatggatgccggcagctgctctgatggaggtggcaggggagtgaaatggatgaactctgtgagggtccttagttgtagttttgtttattgcactaattttgtgttggtcttctgccaggaggtggcactttaaagacagcattagctgcagtagtatagggaggatcaggtggtgggcaggaccctagagctcccaagagattatgtcctttgtcttcggctaccagggtgggtagaaaaagaccattagttgggggtgggctaggcgtgtctgagctcagacactctccttgggcgggtcttgctatggctgctgttgggattgggggtgtggttctcaggccaatggggttatgttcctcaggggattatggctgctctgctgtgtcatgcaggtcaccagggaagtgggggaaagccagcagttacaggcctcacccagctcccacgtagcccaaagggccggtctcactccctctgtccctgccaacagcaccgagtttgtttctaggcagtggatgagcagggttgagaacttgtcccaggctaccagcctcttggctaagaaagcaaacagggttttcagatttcacatctcctacctgccatggtttctgtgctgtgtctgcactcctgcttcaccccctcacccgagttctgtccaggaaactgtgtttggtcaaaattgttacaaagttcagctagaagtttccttctccctgtggtcttttcccagtttctctggtagccctctccagggatctctgtgagacaaagtcagaaatggcttctttggggactgagagagcccatagggctctttctgctgctcctttctattcctgtgtttcacttggctagagtgttctctatacaagctgtgcccatggcaagctgctgtgagcagacatccaccaagtggacatagaccacgccaaaaaggtgctgtgaggccagagataattttaaagtagacttctcataaaagcaattgcagcgtatttagcccttgtgcatgttctgcttgctaaaataacagctctgctcccagcacggaataatccctttgttgccagaagagatttggcctccacaagacacattaagtagctgacatccttctggcctatgggctgtgattggtagaaaataactgtctctggggaatagtgttttccggcatcctggtaccaggcacttgattatcaaacgtgttggtcatacttacaggacattgatgattttcaatagaggtccccgccccccccccaccccccgccacattgctatttggtattttatgagaaaaggtattcacttagtgatatattagttctgttacatgaattcagaaaatactatgttcttatcactggagttgggtggacatctcaaaagtgaccatcgcactttgtagaaataggggtcctgtcatgtagtacattatcttacccatccttggtacaacttttctcccactagagtcctaaggcacactggcctaatcatacttctccctctctcaaatctgagcaattgggagctcttagtcatttatacagtgggtgctttttcaggctactgactttcagttctgtaggtaagaaccacttagctaggaaaagaaagtgggcaatgtgaagaacggggccagtggaaaattttgtccctgcttatgcttaataccagttccacttccttggagttctaaaagcatacattttagattaagtaaaaccttacagaagaaaagggcagaaagacagtgccaaacaacgtaatgaaattcaagggctgtttggaaaaaatgcaacctaaaatgattccagtgtagaagcttccacagcttatgagctacgcatactaaacagtcttttataagcatgtgctttgctctctgaaaggaacgctcaacagtgttgggtgagtgggagctctttatagcagcttgtccctcttgcttcagtctttgtgggtgtcgttaaacaggatgaaaggcctgtgacgatccaagacacttggaggttgatccacagaggactgggacacaccacgagaatctcccagagtgtcattacagtggaagactttgagacgattgatgcaggatattacatttgcactgctcagaatcttcaaggacagaccacagtagctaccactgttgagttttcctgacttggaaaaggaaatgtaatgaacttatggaaagcccatttgtgtacacagtcagctttggggttccttttattagtgctttgccagaggctgatgtcaagcaccacaccccaaccccagcgtctcgtgagtccgacccagacatccaaactaaaaggaagtcatccagtctattcacagaagtgttaacttttctaacagaaagcatgattttgattgcttacctacatacgtgttcctagtttttatacatgtgtaaacaattttatataatcaatcatttctattaaatgagcacgtttttgtaaaaaataaaaagtgggataagtgttttttaagttaagttgacttaaaatacatccagaaagacttggtggtggtgatacgtgggtcaataccaagtattctcttttatatcaccacaatatattagaattttaaaatgtactagatacagttcaactacttacccacaagcaacaactccagactcaaatgcttagaaatgtcattttgtcttagtagcaactttaacaaatgtgagttaatttatgaaggtactgaaaaaattcaaggacacttcatttttttaaactgctgcactcaaaggtgtaattgtagattagtctattcaataactagaacaagtttttagaagtttagctttcaatatgaaatagatgcatagattaagaacattcaactttgtttagacattttttacgatattcaaaaatatttaccaagtttgtccaattttcttatacagcagaaattgttacagccagccaaaatttatttgtcaaacatagatagctttgaatttagagaagaagagcttacctctcactctagctctgtgagcccatgaccaactctgctgttgcagtggaaattcctgggaaatataaactaagaggagatacgacctttactgtgctgtcacagggctgtaaaaatgaagaatttgaagaatgaagtaggtcagaggatgcaattcttgagtattccagcattatttatttgatcagagtaaaatacacttcccatcactacaaactgagcacaactacagttgtctacacattcatatttttgacgtgccaacattttgcattctacatgaaacatttggtttaaacaaaatcttaagaattctctattttgtttcccatcttccctcctgttctctcccatcctccaaagatgttttatattaactgctatgagatttatttgccggtcacgtaatacggaggacagcagggaacaacacaagatttaccatgcctaggggatgaatggcaaacccaactttggctaatgtcattgagaacaacttggaagcgtgagcagagatatctcatgaagtggcagtgaacctacatttccatttatcagaagcaaacatggaaggttacatacatgatgaagtattggaagttaaagacttaagacacaaaatcactaatttaaaagaacatgcaacatgagtatcaacttgctatgtagtgtacatgtaaatgacccaaatattcacctctagcatcctgaatctcttcttactacagctgttatttgtacagccactgaatgcagattagtaaatactgacatcacaatgttgacacatgcagggagggggagataaagcaacagttcttccttccaccttttccaaagtctcaggattaggggaggtaataagttttggaaagaaactgaaatgcaacctggaggagagttggacaagccacattttccactcatgggaaagaagcggaccattctgctactttcccaaagacaaagggactccttaaagggtaactgaaaaatgagcgctatcctcccagactgttttcttctatcaagtactgcatcatcggtaagcactgaatcctacctttcttaattatactagccaatgacttccttgttctcgttctttattctaagatttcccaaaatttgtaatatcaaatccaggctttagtttatttggaaagtggtttcagcacctggaagatgagctggctctggggctctggaaaatcatattcctttatccttgtcccagagaaaagtaggtaggaggtagaaggtttgcttttgtggctctggatggtggagaaaggtaaaaggaaaatgagaataatgggagggaagaagacaggttaaatctgcaagggtagatcaaaggtaaaaataaggtggaaaaacccattggtacttccctttttctttctttacacagttagttagtttgtttttttatagaaaaattagggttctacatttacacatagcctga

SEQ ID NO: 15368 - DNA, 129327 bp, Human; identical to SEQ ID NO: 12257
  misc_feature (1)...(129327): n = A,T,C or G

SEQ ID NO: 15369 - DNA, 73757 bp, Human
  misc_feature (1)...(73757): n = A,T,C or G
gggggctctccccaccctccctgctcgcccggttccctcctccccttggacgcagccattggctgctcgtggatgtctctttgccaaataggtggatccttctctctctttctctctctctctctctctctctctctgtctctttctccccccacccctttttactggcttggcacaagcaaatggatggggattgagcctgaaaggagagagagagagggagtttgagagagagaaaaggagcaaaaaaaaaaaacaccccaaaaacccaaccagtgcgcacacacacgcgcacactcacacacacgccccatcccatccacgtcctccctcgatcctcgatctctccctcccccccttcttcctttcctccctccctcgctccctctctctcttttgcacgcgtctgccagcaacggtctgcagccggtcagaactcgtcctcttccccgggaatctgcgagctcccccttttcctccgatcaggcagctcgaagtttacacccctgtgccgctgccaaagccgaaagcctttttcttcagctgccgctttttccctcctgggttttgtttttgtttttgttttgcacgggggtggggtggggtgcgttgttggttgtggggagatggtgggaggctggttttgatttttaaattttgcatttttttctttttttttttttttaaactggaagaggatgcacaggggaagaaattgaaaaaaaaattttgttggcttttgtttacctggcgtgtgtggcagccggctcgctccctctctctgcttgctatccctgacctttctttctttttgctccttttcaaaaaaaatattaatttcccccttctgtgcaatggagcatggggggggggaggagggggaagggtttgagaatccacccaagcccggcccctattccccagaacaccaataataaccccctttaaaacatttaccttcctcccctgctcctcctcctcccccctccccccacccgcccccaactcacaactcttttgagtccagaatctcagaatcgggcgttgggctttgccgggtgcttcagatcaatggtaattatttaattttttccagttttatttttgtaaacagaaatcaattattatttaaacttcaaacaagcaaacaaccaaaaaaaaaaaaaaaaaccaaacaaaaccgagagagcccatccttctgtcacctgactgagtgggaaaaagggtgaaggggttgtgggaggctggggaaggggtcgcaagaagacccatgtagcttttaaccctaatgtggccgagacaagcaccttatttgtgctaacaagaagtgttttgttcattattactgtgattaacattagtattggtgtcgataacaaagctgaaatcacatatttaggatttaggtctgattaaaaaatgttggggtggatgttccaactggatcaggagaaaagaaaatgaaaacagcctggggagagggaagcctgatctgtttcctcactcgcttgctcgtggatgtcattttctgtcttcttgggggcggccaaaaatcgaccggtgtcggggaccagaggcggccccgcacgcccccgcgtgtgcgtccacgggcgtctgtgcagacggacactgtgccggggcgagctgacaggagttcacggctgcgatagaacatggagatgtcatgggcgcgacagagcctggcggggataccagcagcgtgtgtgtgtggacggcaacgttgtctgtgcgcgtgtgtgtgagtgagtgagggagagagagagagaataggtgtgtgtagaggctcccggtgcctctgtctggctgctgaggctgagatgggagcaagtggctggcgaagctggtggtggcttcaaaccacactttcgtagaacaatcgcaagagaaaattgttggggggagggaggaggaggagaaggcggttttccttgtgcccccccttctaacgctgcttttctccttctctctttccccctcatcccgtcttcccctcctcccgtcctccctcgccccgcatgctcccggcttgccgcctgcaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccgggtaggtcgttctcaaccatttttccctctcattttattttccttgctggcatttgttctgtttattgttcctctaatttccaagcgataactcgccatgggcctaactggtgtatgcccgtcctgcggggcctgcaacacggttctatgggcccttttcctttttcctgtcttctgtctcccccgacctgttctattcttcctcctctgccccctggccatggtatcgactttgtgcatctccatctttggaggacttatctgatcagaaagatgctgcaggtcttaggattggggacatgatgcccccagaattatccatgatggtgagagtttgagatgaacaacaacagcaaaccagtaattgctcttattaaaatgagtcagaagaagtattgaggggcaggtgctagttttactgcagcttcacctccagtcccaggaaaaactgggtttggtacaagcgggatgggcaggagtccggtggagagaaggggcatgtgaaaccctgggatatgagactgaatgaacagaaaagaggagagaagacagtagtgggcagattctgtggcctaaatactcaggcgggagctgttttggctgggatttggctgtcagtatgaaagtaatttgatttcatagagagtgaaaacaaggacgagattccttgagctctttcccttctccttatttcagctcaagtggcaaggcctcaggatggatgcccacagccctggcactggggagcagagaggctttctcggggcacaggcatggcagggagcagcgttgctgtggaagaggtcttaaacaagcaaacaaacaaaccaaaaaaaaaaaaaactctgtaaaatctccttttccttttgtgttccaagtagttctgcttctcttcgcttttccagttttaccctgcattttgggtcagggtggtttagttctcctcctctgttccttttttcccttaccctttccctttttataatttctttccgcttttgttttcttacaaattgaaacagagatggctggttaatttttagcctccactcagctacgcccaatttactgccgcctttgaaacctaaacgggcggcactctgtgattaagcaaggcagaagtgtgtttacattatgcccaaccaacttgtaatgagagggctaccaaacctttctctctctctctctctctctgtgtgtgtgtgtgtgtgtgtgtgtttcctttccaccattccagtattttttccccttcattttccttcttcctctctttatgcgaatttgagagaatgtggcttaacttcaactctcgcaaaggttgtttctccgcgagtgtgtgtctctgtgtctttcttcctgttcattcacaaaaaagaaaagtgattcacaatggctgtggtcacccccttgcctgtttgggaagttgggaggaatgatataactggatccagaaataaaattcgggtttgggggtgctttcagcactgcgtcaggaatgtaatctagactagagtgagccctgagtttacatgttggagaactgtggagaggagaaggtggtattggaattcttgtcctgagaggttgctttggtaactggttagaagcaggggacaccactctcaccccccaagtctctacctacttctgtggatctttctaggcctgcatccggccctgtgtgaccatcgtgacccgtcatgcagaagggccaggtgccagtcattccccctcccttcagcttgaattttttcttttgtcttttttctttttggaaaacagactgagagggaaaaaaaagttatcccctcattctctgtctatacagcaagccagatttgggagggtgtgtgcctggtagtattggaggtgactggtggcttgcagaaggctcggagcctcgagcttaccagtgtggccatcagatactcctgcacaaggggattctgcaccttccaattttagaaccaggggctcgagagcatctaagatgaaaatcaacactcatcttcctctgagctggcttcctccaaccccgctctctgactggatccttgtagctgagttgtttccctggcctcttttattttaggccgaattcttgactgctgccagtgtggggctaaggtaggatgaaaagtatgtgaggaagcagaccgtttcctggccagaagaaaggccccaccatgcctccctgccagcttaagagatcattcgcccaggaatatgagtgaattcataccccattccatgtagccgaggccacttctctgggctggggctgaggccgagtctcctctacaaaagcagagtagggaactaagggtgtattttatatcattcaggccccagactccagataatttcagtgaaggtaggatttttctcactggaattgctttagtttgagtgtgccttcctgaagtgagttgaggcgagttggcgcagcccgggccaccagtgggctgcatcacttgttcctctttggagttgggttgggtggtcttgagatggcacagaccaggcatggcttgcttcctccttgagctggcaagaaataaaaacatttcttgctttgctagaaaatgtcttctgtggctgagccaccaaagagcatcgatctgtgggcaccactttctccatgcccatgcctgccaggcacactcagcagagctgccacttgctccttccttccaggatgataaactggggacaggggccgggatggcacaggctcagacaagagctgctttggactctgaaataagtgtttttccttttcttaagacagggctgaagagccagatctgggctgagctgggggtcctgggtttcatgacagtaacggtgatgtggtggtaaatgtgggggtgtggctttgctcccaggtgccattgtcacccatggccttcctgagcccttgttatgtcccagatgaagcttcaagagatgacatgttcgagagggaataaaggacgtgtgtttggcgttgaaactccactcccagaatactgggtccaaatacagaatactaggtccaaaaggctgccatgcggctggccttcctgctgggaaggagtctgtctgtgtgtctgtctgtgtttaggaagggaggttgaggcagggcagggtcagagagcactgccgtggggaggagggtatccatttcctggtgatatccttccattcaaagcgggtatcccagaacaggtggccagggacgggtgagctggggagggccaggagagagatctctgcttgtgtgagaaaggatggccgagctggcctagaaccgctgctagactatctccaaagtttctgcagcaccctgaaggtgaaccagtgccttcagaccttccctgacacctaagccttggtcctaggaaagaaaaaaaaaaatccaaagctaacaaaatacttgagcgaatggaactgtcagcgtcaccctgtcagatccctcctgtgcgcctgcagcggaatccccacgaagtccaggtatttgagtggtggctcttttctttatctaaactctttaatgatggagagcttcccacatagaaagaactcctgtgtacccaccactagtgccagcaatcgccagatcacggccaatctcaattcaaccatcctcccaactgcccacccatgctgagttatttagaagatccaggcattatagcttttcatctgtaaatgtttttgtgcacatctctaaagatacggactcttgaaaaaccaaaccacaataccactattatacccattaaaaattcagcatttttttttagtatcatcagatactggttaatgttcacatttccctaattatcacttaattttttgtttatagtttgtttgaatcaggatccagatggggtcagtcctgcattgcgatgggttgatcagtctcaaaagactcatcataatctctaggtagtccttctcctcttcctcttccttagtcttggtttcttttctggcagttgtcattgttgttgtcgttgaaggaaacaggttgtttgtcctgtggggtttcctcagctggactctgcaggctgcgctgccccgagtgattcagtgagtgtggtgctctgagagcagattcggcctcccctccctccctaccttcaggtcccgggacagctgagcttagccttacctgtcgcaggaaatgggttagcacctgaagatttgtctaagtgaactttttcacctgtggggttgccttctcaggtatgagagcttcttggtttcggcactctagtttagggtttggggctttgtagcaggcactagttttcaggtctgagggagggctgcccatccacgtccttccttggcggtggagggcattgttcagctgtgtccatactgccaagacggggctggtgccagcgaggttccccaagcctttgctggatgcccaacccgactgttggctctggggtgagtatgtgggagggtccacaggagcacccgccgctttctccaggtccacccccaccatggaccctgtgccgcctcatccattgcctcctttttcaaggcccagaaatgccactggtctgcgtctttgaggcagcgccatctggtgccagggctgacaaagatcgcagggccctggaactgacgcctaaaattagcaggatctacagattatcttttaacccaatgtagggtcccctttagaacatcccagaagaggtgtcactgtcattcaaaggtcagctttggttgtaaaattcttccattcttccatgtctagcttgtaggatggttccagggattaaaccagctaatatgtaaagataccggcacatagcaggacggcagctgctgtgattgaggacaattgttatgatttagggagcccaaggctgactctctgtcacctttacttgttggtcttttttttctcttaagggatgacccaggtgaaagctgattttcctgtaacaggacagcatttgaaataccaaaggcagctcttatgtctcccttccacccttctccccaggaagctgtctcctctccagcctgaatatcaccagtccctaatgcctcccacatttcacatggctcctagtgcccttgccattttggtaaccacctcctggaagccctctggtttgttttggtccctctgattcataaaatttctgaaactggagtgttcagaattgaacacagaaactccaagcatgatcagatcctagccagccatggtggctacataattttcagggccttccagctacatactgtgcagggctcagtgcaaaatgaaaatgtggggctccttgttcaaaatttttaggaattacagcacgacatcagttagagcatttaaccaagcgtggggggcacgcaagttgcacacccgtgaagctggccctggccacctttgttttggacattcgtgtctgttaatacaacttggggtgctgggtctgggtgatgtggaataatgatggggctcaggctggcctcagagcggggcatgaccccaaagaggagaacagaaatgcccagacccaatccttatgcttgggcttggtcttattctcagactcctttgaccacctgctcttgtcccttttgttcatagtgctgtccacccaaccagtcaagagctcccattgcctacaacatgcagggggtttctcagtagagtgcttgctctgctggctgaattggaggctatgacatgggggaaaaaagagtcacctttgtcggagcttgagccagcaaagcgccgaccgtgaacaagccagaggggacctagaggcctgatcccataattatgggcatggtgaccagccgtgctctattgctgacccagaggaaacagggctactctgcagcagaagggctggggtccagacgtgcagaaggacttcctgagaacttggtttactttttggcgcttccaaagcatggtagaattccctttatccatgaaatgcacacttagtcaacttactgtgagcaaggtcctggcctaggggttcctagatctctaagaataagagaatcttgcgtgtacctggcaggctttgggtaaaggcccgatgatatcttctagaaggcttcctcccgtaggcgtaggcgtgaacctgcagtgacccatgctggaggggagggaaagcccaaagggccttatttgggggatagctcacagtgggctgtgaattgggaggcaaggtccttcttggccaccctctagtgttacagagacctgggatgccagaggaagagtgggttagaaggggtaatgaggccagtgctacgttctccctctgtcctggcttcctgtagcagctgggcagagaggggacagctgagtgtccccttttctgcctagggaagaaggtgactccctccccacccctttttctctttgccctgtccgtcccatccctccacccccgcccttctgtctcaggagctgccacgcttcagttattttatccttcagtgtccgattcagaagtcttttcaaaggccccagccgtgtcagcgcggtgctcgcacaaaaggcctctttgatttcttgtttgttttcatttgccagtggagggggaggggggcaggagagaaagagcttctgggttttaaaatttttatttgggttgcttcattctcagaggagttggctccctggaactcctttctgagttgggggctcagagttgaacggcagccttctgaagagagggctagtgtaggagtggagggttgggtggagctcccagggtgacaggaggaggtgtaggggtttaaatatagttattgattcatcctacaaacactttgggcagatcttatgtgctaggcctaagggcagccctgcctgttgggtagaggaaaggtctgaggtgtctggcacatgacattcccctgtgtgttgcatcgttcgaggactcctcacagctgtggatttgcacagttgtgaactttgactttgttatttttccttttttgtcccagattccgcctttgaagggattctactagcatacacacttcttggagactcagtacttcagaatacaggttggggcttcccaccctaaatcagagaatgagggagagggagtgagaggtttatagagcagctaggtgtcttcctgggaatggtgtgcagaggacctgggcccacagcttgttttggactttgagggcaggtcagtgctgctgagaccttggtgagtagggagttgaggccaaaaagaaatggaaggccatgtttgtccaaggtttcgaacaagagacacccaaaccagtgcctgttggggtgcgtaccttaacacatgtgggcacgtccctatatcccagtaagaagaggtgcagcctgctggtttacatgcctgtatggaggcctaattgtcagggcttgggaagagagtgccacagaccgagactcaggcaggtggtcacgggcatcagcaacagggaagtgtgcccattgggtgagggggggctcacagggcctggttggcagacgggaggaggaggctggggggctgagagatagataaatatagctgatggcatttctgatgataggtttttcttggcaccaagggcaccgtggaaaacagcacgacaaacgcccggccctgcaggccgccgtcgccattttaagcatgtttgagtttaagggttgttggcgttagaatagggtcccaggaggcggagggcctagggaggagaagtttggctggactggaccttaccccccaggtgcctgggtcccttactttgtctataatggatatctcgtaccttatttcctggccctttggggatttaaaaaatattctggggctgccctttatgggtctgtctcccaagtgacttatttcaccaccagctgccatggactatcagtagggggcatcttggctcttctctcactcctgatgccttactgatgacatggcatgccaccaccaccccagtacagggtacttattagctgttatttggggacacccaataacttaaggggcacctgtttgtccaggctcctaacaacttcttgtcccctgtgggcatgcccttggtctctatcccctgctttaattccatttttccattgaaggccctctatggctttagcaccaggctaagtcctctctatgtattaattccctgaattctcaccctgattctagttttaagcctgtgctcctggctgggtgtgtgtgcactcaggtgatgtgcataatatgtgtagtgaggaatcagcaaaccagacctggggaccagggaggcttcctagaagacgacctacttgacctgcaccttgaaagacagtgaggaattagctcgttttgtcagctgcctgagccttctcagtgtgcctggagctgattccctcctcacaatggttgagtgatatagacagggcaggtattattgtatctactgtacagaggaggacccgaagtacagagatgacaggggactctggtcacatgatgagtttctggcagaaggggccggcttctaggtcactgagtacctggagctcattctgagggcatcgctgctccttgaacttcatcaggattactggctttggcagagtctcagaggagaaaacctcaagggtccctgttggagccagtttcatcattgtggtctctgtcactctctagaagagagcccagcttgcggctcagctcaagggctcccccagtggctgagtatgtggggtggaaacagagaatgggcacctggccctgtcctgacactggcctccctccctcctgacaggccatggctccctggatccctgccaccaacctcgagaggcagcatgctagcatagacgggctgagtctagcatagacaggggccaggttggctggatgctctcaccctgctgcagccagctctgcttcttttcatatctccctggagcatgggggagggatcccacctgaccttctcaggtagaggaggcaggaagtctaggtgtgaggccaggcaggttctgctagaccttgggattcctgatccttgcactgtcacacccttttcctgggagtgtccttggaatcagtttgaaataaaaatgaatgtaattatcataattaaccaggtgatcgctggaagttttacaataatctgctactcattgcctttttcacttcttcacattgactctcacctttatccctttcttaaagttggaaaactctcggggtgtgtatataaaaactctcctagcatgactaaggctgggttcagggagaggctggctcaccgctctagattttcgtctgtgtccatgataattagacagaggcttacctctcaccattgatatcagctccccttgagcagcatttcccaactgcggaactgttgacattcgagtgagatcattctgtgtcttgggggactgtcttggacattgtagagttttagcggaatctctggccttgacccgctagaaatcagttgcacctccctccccaaggtgtgacaaccaaaaatatctccagacatttctaagagttccctgggaacagaatcatgcatggctgagaacctctggcctggaagaaacagggattcagacagaatgccacctgtgttcacctcttgcctcaccgccagtttaggtcctcatttaccttgtgttgaatgtcgactgaacctctgagcatcgtctactcctgtgtgtcctgtgttgttttcgcttttccggatagcagagccctgggctgaagcagtttgggggctttcccctttcacctccccctggttggaactgtaagcctgcctccaagtcccctactgagttattcctctctgattttttgcatagtggtctctgtgtgctggggctgctgatctggggaacaggacaggggatctgctactgggctgacccaggcctgtgcagcaaccggtaatcctgtcaggcccgtatcagaccccaaagaacagcagacgtttgtttctgcagcatgagacacggagaccagaactgttgtctgggtcttagtactactctttttaaatgatttgattttttttttttattatagtagtaaaacacattctttgtaaaaatttaacaatagagaatgtgagagacagacaggttccccaaactactgtcctgtgcctgagacaacttcacttcgcagatccatgttagttcttcgaatttttttcatcaattcatatatcaagtaacttttaaatatagaggtatctattttaagagcagatggtatgtttgggctaattgaattggctccgtcaagtgccattgtggtcttaactcttcccacccgctgccttttgtacccttgcccgcatcatcccaagtgcagagccaatgtccctgtcttcttttccctgaggtgacagtttcagcgtgtcattcctgggaggagtgaccaacagggcatgtactggtgtctgagtggttaggatcccactctgggggattcctgctggtggtataaccccgaccacagaagtcagggcctaagcctcagcctgccctgagatccccaccaagggggctgcggctggagggaggggcccctgggaagtatcctgcttggctgcacctggcttggcctctggagtcgacttcccaagtctcctaggaaggcgagggctctccttcgtgtggagtagacccttcgccaactggcctggcgtgtccgggaggcttcctttcttaaaatggggggatgaagcgtcagtcatgcttccaggatttatttcatcataattgtttgttttgggtttaacaatacagcagggagaagagtggcagaggaagaagagcgtcctctccaggccaggggtggggctgtggaaatgagaaaccggacgagacagagagggaatccagagagggctttgcggttgagtctgccagtctggagaaggctgctctccagacagctgagagtagggtgacacctggtgactcttgtggactgggcggagctgtgtggagcgatcgggagatccccggaggcgacctgcaggaggccagccgagtgcagcccttggggagtgtgtccttattatgcctgcagattatatccccattagcgcataattattatataatgggcgttattgcataatggcagttatataacaggtggcccagaatacagacagggggtgtaataagtgtatatcctctggctataaatagccaccagccccacaccaaatatgtggtcacaccagagccaccttataaatacccgtgctgggctataaatttctgagcagtgacgtcagcgggcatggtacctagttagggggtggtaggagggacctgcggccccacccggacacatgacatcattgtttccttagtaacaggaatgctcccgggggaccaagtgaagaaaggcctttaaagggaggaggcaaatggataggaagcttgagttgggggtgggtgctaagcctgggctgaacagggtgaggtctcctgggcagagtccttaatgggtgagacaggccatctgcccttgggtatttgacccaacgggaagcaaggcagtagactccgtttcctttcatctttagggggtctcaagtcccctttcctgtgtgtagcagattctgccagccttggctgtgtgtcagggagaagaggggagctacagagtcttccctgtccttctctctcccaggtgacctctacagggctctggggccacttgcttaagggagacccgacttctgcacccggtcatatcctccccagggcatgaccacttcccctaccagacgtagtaggccagtttcagccttagtaatctaagaaatatgtgagcaatttgatgcggatctcagagagcctcgtggaagtaatggcgctgagagatggcgcctggggaagaaagaggagacaaggatagtattctggccccagaagaaactatgaggtgggatataatctttttaggtgtatgggagattgcttcatatagggtggggaagaactagtcttcatagccctgagcatagaggaggaaatttgcctttggcagatgaggggattggaagaaggctggatgaccaactcgtcctggtttgctcagagtttcacagcccctcacctcggtaaacccctcagtctccagcaaactgggattgttggtcaccctagaacagtgattttcaaccaagggcaattttgtcccgcagggaacatttggcaatgtctgtgaacacttttggttgtcacagttgtggggggagggtgctattggaatctagtgggaagagtctactgcatatgacagtcccccaggaacaaagaatcatctcgcccccaaacgtcacaagtgcggaggtggagaaacccagccttagagggagaataagcagaccctgctgtgcgtggtctctcctcaggacgcctcttgcctctgctagcagagtgggctgcttggctgccttcctgaatttcttgcagctcttgttttctgtgctttgattggttgtgtttagggttctgtggcctggaaaccttttctaggaaatcgtgtggcttctgagagggtctttcccatctcaaagctcagagaccctttgagacagtgccatctcaaagtgagacagtgctgacagcaagccctgccaggcagtatggtattggtgtggatccttcatctgttatttaaaaaagaatggaaaaatcatcaaatacctatcccttattgcctaccaaagagtttctaaaaggcaaagcctgcctgttttccctgcctttcaggtcacctcttcccatatagacctgaacaggccactgcggctcctggggcttcctgagcgtagcagtcccagggtgagaactcacttccataaaagccagtttcccagacccagtgaccagggctggactctgccacccaaagaagcttcccaaatgaaacaaatgaggcaggagcaggagagagccaaatcctattctggcacatggagtttacagaaatctaggttctaagtgttctcatgtcatttatagaagtttccgtttagcccggcatatgtgaaatgtaatcatgaaagcatagcagacactgtttttcacctgcctttagtgcctgtttagtttactacctggctgcagttgacttggcgccctctggccttgaccacatgcatagcgtggccaactgggtcatcgtttctgctggcctcggacagggcccacagatgaaggccaggatggtggtggtggcgcagtggtctggtctgcaccagagatttggccagagagaggggatcagctgggctgtgggctacccgttgtgtgtgtcaggcccaacttttgagtttggacttgagattgaggcagctaataagcgtggatggggaggaagggcccaagggtctacatgcaaggtcctgcctgctgtgccaaaggggactctgtggggaacagtgctggctccgaacacaaaggccattgctccatggagcaataatcctcaggatattgccagcccaaaagatatggccaagagagaggcctctgccctgaggacaatggccagatttctctcacttatttatggtatcgtggtttacaaagtgggcccagcacacaaatctctgggcatagtttcaaatacatgcatttcttttaaattaaacacccccccacacacacacacatacacgtgtgtgtgtgtgtgtagggtctgttcaagccctgctgctgcccaggagtgttcccagccacgtgggacagtaactgaggatgatggtactgaagccactgtctaatattagattttgtaactcagagattcattaatataattactcagatgccagcctggcttggcaaggcctcttgaattgtgttcctcttcaacaaagtgctccggctgcagaaatgcccctggtgagcctgagctctgctaccttgcctgtgaatggggcagaaggcatgtgttggcctcctcactgcaccctgggagaggcagtgcatccccatggtggcaagtcttgcctttacatgtcttgtcacgaaaacagggaccttggagagtctgctgcagaggggagcaatctgctgggcgaggccccgtttctatgcaagttggccctgggctcagctgggggccagtttattttgctccgttgtgatacttagcatgcagtttttagtttctcttaggctggaatcttggagctgggactgtgttttatccgcctttgcatctgtctctcgcgcagcttatagttttatacgctccataaacccattttgaatattgaattaccttcagatgggaagcagcccatggcccatccttgagatgatgtaaaggctcacgatggtataaaaatcagaaagggggctgatgaaggaagagagccaagatgggaaagtggcaggtgtgctctctgagtgggcattatgaggggagaatcctgacagaggaggggcagtggaagcttccagaatgctggaaggagtgtggcaggcaagtgagaagctgtgggttaatgggttcaaagagacttggtttttcaaaatacttgtttttattttatgtgaatgagctctcaggaaaatggggaaggagcagccttcttctcagccccttccttcacccctgcccccgctgagtaccttgttacaggggctactgcttggtgggctcagcccaccccaccctctcataggccttttcttggtctccttggctgtccctgctaaatagtcatctttggggacatcctcccttttggccacaaagcacacagccccccagaggccatgtcctctccagacttggtctgcggagcagccaaactcactcgtgacagggtctcttcccgtgccagatcttccctgccacgctagcctggtggatgccctgcggcagggattggcagggatcagtcctgggcccactgggattgcttgccttttgctctgaggcttttcctcgcctccctccctctcctcaggagccctggcctccaggctccttgtatggacagactcatggctgctattcctgccctccatctcctggagaccccttcagtctgggcctctcgggtcagagatgactgccgtcctccagctggtacatgtgcttgcggctctggtagctgggtttggttattaacaatgaattattaaaggaatgtgaatagggagggaggtttgtctttcacacactcgcgcacacacacagccacttctcgaagcagatcttaaagttgattctgctgccgctgctgtacctttgcttgcctcggatcttagaactgtttccagtagtttttgagtgaattccgagcactccactttctaccttaagactctctagatagctccttcctcctctctcacctggtcctaaacctctttcctctggccccatgtgccagttcttgactttctctgagaccggttttcccctctgaagtcctccttgttcagtggaaaggtagctagaggcccaccaggcacccggtcttggtagtgtcacatgccacagcatgacagtaacatgaggacatttccctccttgctaccactctttgggctggagtccacttgagcatgaaagttcaggaggccaagcctgcctctcacaaactctggacacacaggggcttagtttcacgatcagctgattatgttgttctatgatttggggagtgtgcctggtacgtacagtccctcatctgtccactgttttaaaaaggttatttttcttattataagactactgtacattcataataaaaatacaaaattagcatgaagtcagggggtggaaattaaaattatacaattatgccactgaaataactgctattaacttttgttgcattttcccttacttattcatgcacatattttattttttactggaatttatagtatagacacttagggatgctgcttttaaaatttaatactgcagggcgcagtggctcatgcctataatcccagcactttgggaggccgaggcaggcagatcacgagatcaggagttcaagaccagcctgaccaacacggtgaaaccccgtctctactaaaaatacaaaattagccaggcatggaggcacatgcctgtaatctcagctgctcaggaggctgaggcaggagaatcacttgaacccgggaggcagaggttgcagtcagccgagatcgtgccactgcactccagcctgggcaacagagccagactccgtctcaaaaaaaaaatcagtaccattgtgtattctactatgtcgctatttttcaaaatctaatttttagtggtttagcatcttttctttttcttgtttgtttgtttgtttgttagtttttgagatggagtctcgctctgtcgcccaggctggagtgcagtggcgcaatctcaggtcgctgcaagttccgcctcccagattcacgccattctgctgcctcagcctcccgagtagctgggactacaggcgcctgccaccacacctggctaattttttttttttttgtatttttagtagagacagggtttcaccatgttagccaggatggtcttgatctcctgacctcgtgatccgcctgccttggcctcccaaagtgctgggattacaggcatgagccactgcgcctggccttagcatcttttcttgttagctgcattacccctaaattgtcaacttttctaatgacttctgtcccctattcccttttgaaaatgagaaattacctcttattataagtgtaataggtgcttactgaaaaataaaaacatgcttttacatgctttttttttttttttttttttggagacagagtcgctgtcacccaagctggagtgcagtggcactatctcagctcactgcaacctctacctccagggttcaagcaattctcatgcctcagcttcaggagaagctgggtttacaggtgtgcgccaccacacctggctatttttttgtgtgtttttagtagagacgggatttcgccatgttggccagcctggtcttgaactcctggctgcaagtgatctttccgcctcagccttccaagtgctgatattacaggagtgagccaccatgcctggcctgaaaaagaaaaacatgcttttaaacagcttcatgagatttcatcatgccagagctgatgtaaaccccacccccacccccactgaggcctttgagttgtgttgcgttcatccccattgtaaattctgctgggatggacatcctattacaccaagctttgtagctgtatttgttaccttcagctaatgcttcctagcagttgaattactaggcaaaaggtatggactctcttgaaggctcttcgtccatcctgttaaattgccatctggaaacttgacaccctcaggcagcacgcaaggatccatctcactctgtccctgtaccctgatcctattccccagagcctcagaaagatgttgccatcattgtacatatcgtgtacattgcacatacatgtcatgtcaggatgcacttttacaagtcaagtctcccatccctgtcataggtgtatgtcccgttcctgtatttattctctgcatcagctcacacattccttgatggacacatggtgttacccagtgtaaaagctaatcatggacatcagcccacattctcacaccctccaatccatgtttttatgaatctgaggtgcccccttccaggcctctgcagccacttcctgttagcactgctagaaggggagggacccttgggggtcaccgtggcatggcagtttcctctcagcttctggccttgggactgcagaagtggctcttgagactgtctggtggtgagcaggtgctggccatggtatcttaatggcagcagcccccaggtccacttctgaggtgcaagcccatgctggccgccagcacgtgccagagagctcctgaggaagcagctgctgctgacacctgaggccagctgcgcagtctgccacaaggcccctggggctgccaaggtcgcacatgtcctcccaggacttgaagggggaccaggggagggtgagctgttgctgtggactgtggactttgacatcactcatagacaccccctctctcacccttgcatcccagacagtgtcccccagggccatgcaggcagggacacacagcccccttgtgccctgccccaagtccctgtgtgtaagtgagcatgctctcatcagacttggtccccactgccatggcactcttatctgtgtgcctgaatatgcatgcttattcatctcgaaaactgggccgtagggccaggtgtggtggctcatacctgtaattctagcactttgggaggccgatgtgggaggatcatttgagcccaggagttcgagcctgggccacgtagcaagacccccatctctataaaataaaatttaaaaaaaaagaaaaaagagaaaatcgggccttatatcattttctacatcctattcggcccatggaagcgtaagtgtcttcagcctctgttgacccttgtcccccaccctttctctgtgatactccaccttacccagaacctgactgtcctcaggccctgggtagtgggagctgcctcaagactcctgaggccccacaagaggcttttgaattgcagcagtggatgtgggtagttgtgtaggacagagggaggcgacagcatcgtttctcccctttcttccttcagctggggctgtggcatggcagtgtgggccatccagtgtctagagggcttgtggccacgcagtcgtgggtgggatgcatatgttcatgaggtttgctctgttctttcctctgcagggtgttcaggatgtgctaacctgcgggtgtctgtgtgggtgtctgagtgtcaggaggtgggtgtctgtgtacaagtatgggttggggtgtgtgtgtataaatgtcagcttaattcacaccccaacaacgtaagaggaaacttctcagtcatgaggttcaagttcttgttactcctatgagctgtagtaggagtgcagtgagtagggggcacagcaggtatgtaacccctgggcccaactccaacctggcccctgtggcttgtagcttctgagtcagagggcgtgcatgcttgtgagaagtgtcaggcctttcccgttcgctcagcagctgagcagttcctttctggggttctttgtgaacctgcctcgctattaatctacctgttagtaaaagagattacaattgtcgtaattacagggcgctgcgtctccaccgtcaggactgagctgagtgagaggcaagggatgggaggaacccagccccacaggaagctgctattaaaagccctctgtttggatatggcacaaagacaacaacccttcccgggggctaaggagatctgggacaagaggcaggtcaggttccgggggtgaggagtgggctaaggtcccactgcaggctgtgggatgacacgggatgactgcagtactgaggatggtgagaacagcggtggcccgccggcagctcagatacctgggagcagcacagggctcagcaccctgaccacatgggctccatgctgaaggctgctttacttctggacaggccttcacctgcatagaatggaagagacctggtggcacttgtcatggtgagacagtggctctcttctgagggagctccacagccaccatggatttaggtggacaaacagtggtatcctggtctgtggctagcatgggccccagagctgtgtgtgatgcatgtgttcctgatagcacaggggttctcagtgagggtggttctgcccctagggtatatttggtagtggctgaaaacagttttggttgtcactacttgggatggggttgctactggcatctcgtgggtggaggctgggatgctgctagctgtcctacactgcacaagacgaccccccatagaagacagtatctagccccagcatgaggggtaatgaggttgagaaaccctgactgaggccaaggaaaggaacggcagcagggcaagccaggcccaaggagggctctaagaactccctgatgctgagtctggagaccttggcccacggtgctcagcagtctgttgccagggaggtaggagagaggggcagcaggcacactgggttgacaactgcactgtgttgaccccatggcgggcatcaggggaccacaggctgtggttgcgcctgtccgttctccctcccttttctcgtaggcttcttcctcctccagtgcaagagctggatccaggattggagaatttgctcttgcccacctctccatgtcctcgttgccgactgaggcacctgggagtgaggggcttggacattcttcctcagcttgagccccatggacccctccaggtgggaggagtccagaggaagatacgcagaaataggaagggctgacactctccagcttccatcttgcaaggacacaggccccaccctggcttctccccaacacacatctggcctggtttctgctctgagaaatggagctgggtggggcagaggcctggcaagtaaacctggatggagtgtaggaagcctccttccaccattcattcctgttgaccaaaggggcatccctgcaggcactcctgcctccttttccacttttgttttcaactttgactcccactaccaaggagttctcgggaaagagggtaggcctgtgggttaggagggcaccatggagggtagtctgtggggctgggtgagatgggtgtgggaacgcagccctgtgtttaagggtatgtgtgctgcctgcttgctgtgggcagggtggcttctgatgccctcccagcccttgggccactgtgtcttgtgttttctgcagacaaagcatggagattttcagctgttgtgaattctgcgtttcacaccgagtccctaatagtggaatcgcgttgccttccccccccctcttttttttgccttgacagctccaaccttataattttaccttctttttccttgcatacactctttttcttccctttcccgttcctggggcttttgccattcatcgctggggaccccctttaggagggattgctcctgacaagaggggaggggcttcctgtcaaacattgggagttgatgttttgtttggtaaaatgtctgtaaataggctgtgaggcagtcgttctacatggatccctgtgtatgccagcgtctttttgtgtctgagcatgtctccaagcatgtgaatgtcaggagcagagagaaagggaagggaagaagaagggaggagagagaagagggatggtgtttgggggcattgggatggctctcttccttcttggtctaaatcacagagcctgatcaggagagggtcagagttccagactcttgaagagtcaggaagaacatcagaagtgaagctactgccatctgaggtggccctgggttggctattcacagagggctggaatgggatgatggggctgtactccccactaaggctgccagatctggaacttgaccttgaagtctagttatccaggactcttaaggctctgagggtaggttgtaatggagactgtttctcctgcccagcatcaacgatgagccttggattcttgggatcaatatcagtcttccaccgtgaatgggaaacccatttctccctggagacaggttcctctgcaagaccactcccttattcttttttctttctttctttctttttttttttaaagtaggacgccttgttgctttagatggactcctttgttaagcttcaggtagcttacctatcctatgatttgatttacagcaaactcactaaaaacattggtcagtttgatttcaaaaacgtggccacatccattttcccgccatcagctttccagaccacagaatgctctgcttttgagctgctcctcagctgacaccctccttgaatccattttgagttgctcttccctggccccattagaaaatgtcggctctgactacaccatgcttgcgaacaaaggtgcagaacaattttggctgcttcgtccaggaaataaattcctcttcggtgccagaaaccattgagtggtgccatgtgttgagctctaggccccagaactgtgggcagggttattgctcagggtgaggagtgtggaagcataggataaggaggccatggggaggagacccttgcttcccggacatccccacgtactttgggtcaagaacctgaggacttgccatgtcccctgctctctctctcctggctttccatctgcagttgcccatggtatggctggtctgtggacttggggaagacaggcccctctctttgtcccatggtggcagcattccggcccggttaattgcatgccacccttcccaggtcctcttgttccgtctgctcgatgaaggtaaaggctgatttccctgggatctgcccatgctctgcttctcgacctgtgttttcacctgtaatcagcaatgccacttatcagtgtctctgaaccctatctcatttaagcccatgacagtccagtgaactcggcacttttataatccttgtgttatgcctagaagctggcagacggaagaatcttgctcaaggccacccactagcgagcagcagccctggggcctgtccccaccctgcacatctgcccctcactgctgaccaccctggcttatctcagggtctgatttctccttgtgaactctaaactcttctttccagctaccaggcagatgccttgtggacagcttgcccccgtatccacaaggtacctcccagtactcctggctgccctctgctccctgctccattccttgtcttggctgtgggcatcaccacctagccaagcacttgagccctcacaaccagactaaccacaggccggtgaaagggctgaagcctccctgccttttcaccaggctgagttttcagaactcagtgtcttctcctctctgttgtattttttttttttaattccccatctccccaggttggatttgtcttttattaagatataattcacataataaaattcactattttaaagtgtacaaggccaggcatggtggctcatgcctgtaatcccagcgttttgggaagccgaggcaggaggattgcttgaggctaggagttcaagaccagcctgggcaacacagggagacctcatctctgcaaaaaataaaaaataaaaaaattagcagtacttggatttgtattttattaagatttaaatcacataataaaattcagtattttaaagtgtacagggccaggcatggtggctcatgcctataatcccaacattttgggaggccaaggcaggcagatcacttgaagtcaggagttcgagaccagcctggccagcatggtgaaaccctgtctttactaaaaatacaaaaaaaacattagccaagtgtggtgatgcagcctgtaatcccagctactcgggaggctgaggcaggagaatcacttgagctcaggaggcagaggttgcagtgagacaagatcgcgtcactgtaccccagcctgggcgacagagcaagactctgtctaaaaaaaaacaaaacaaaacaaaaattagccatgcacggtggtggcgtgcatttgtaatcctagctacttgggaggctgaggcaggaggattgcttgaacccaagaatttaaggttgcagcaagcgatgatcacactactgcactccagcctgggcaggcaacagagtaagactgcctctaaaaaaaataaaaaataaaaaaataaactaaaaattaagcataggattcagtgccatttagtaccttcacaatgttgtgtaaccatcaccaccatctaattccagaacaattccattgctcccaaaagaaactccatacctattagttgttagtcccaattcctcattcctcctaggccctggcaaccgctaatctgctttgtttctatggatttgcctagttgtggatgtttcatataaatgagatcatacactatgtggtcttcatgtcgggcttctttcacggagcataatgttttcaaggttcctatatgttgtagcagcaagtgtcagtggttcctttttttttttttttgagacagagtcttactctgtcgcccaggctggagtgcagtggcgcgatctctgctcactgcaacctctgcctcctgggttcaagcgattcttctgcctcggcctcctaagtagctgggactacaggcgcccgccaccatgcccagctaatttttgtgtttttagtagagacagggtttcaccatattggccaggctggtctcgaactcctgatctcgtgatccgctcacctcggcctcccaaagtgttgggattacaggcgagagccactgcacccggccagttcctttttaaggccaaataatatttaattgtatggctgtgccacattttgtttatccattcatacattgatggatatttgggctctttccactttgtggtgtgagtaatgttgcagtaaacatgcatgtacaagcatttatgtggatgtatgttttggattctctagggtatatacttaggaattgccctgtcctagagtttcataactgcattccttgtgcatcttgtctgcccagcagtgctgtccccttagtgggcacccagggtctctctgggttgggcccctgctgacccttccatcactgcatttctttacttctcctatactgcatattccagcatttggagctctctatagcccctgagtgtgctgtgctattcctgcctttgggcctctgctcatgtgtatctggcatggtcccttccccttttgtctgacggcctctatctttttacccccggcctggctgtcacctccttggtgcagccttgtcccgcatcacttctcatcctctgaggccagtccctccctctgagggggcctccattttgtccattacacaccagctttcagctgcaggggggtgttacccaggcagcttctctggctctgtatctgtgtggttcctggcgtctagcaggtgccaacaaacacatgtggaattaactttaaggcactgcatgtgcttttccaagtgtgcatgtcacagatctgtgtgtgacccacacagatttgtatgtctgcccctgcagacatacaaatgaatatagaatcaaggtgtacctcccattactctctggacccctgggtgtcggtggcctcatatttgcttctctgtgacccagacaggacttggagagctctagagtgattctgaggaaacccagtcccctttaacccaaacaggtgacctaactgttccagactactggggaagctctggtcacaggggacatgcgacctgtcttttggctctttcccttcactcctctaagcatgtggctgagtagcctgcagacagatggcctgtcccttccgtccttccagaccagcccccttggagatggccctgggcagggagaaggcaggccccaaagcagcctccaggtcccgggagaaaagcatagttgctaccctggtgttgttggtaatgacttggcagtggagggaggagggtgcatacctccaggaggatagtagcaggggagccacggagtagctgccccatggcttgggtactgtgctgcagatctcatcgctgaaggtgtggctaaggctgtcccaccaggtgtttgggatgctgtctggcccctataccagccccactcagggccagagggctctaaatgagtcactcagctctggctttgccaggtggcccagggtagggggatgcctcaggtgggcacatcacggtgctgccaaagactcaaggaggaagaggggtgtgtctggccactacccagagctcactcagggtactagggatggaagggaagaggaggggaatgctgtctgacctgacagcattgcacaagtcagccgtcctgcaaggtggctctttgctgcttttcttctcgctggttctcccctgtccttctctagctgggattccagctctagtcagccagtgacatctcccccgtacccaggccagtgagccagatttttttccaagcctcaagtcaggcaggttcggggaggagacagcctctcaggcgagtgagctctagaggcccttcctcggagaagcccagccctcctcctcctcccttcttggccctctcctctccctgggcctcttccccacgtggctcattacaactccagttgttcaggtcttgacctcaagagccttccctattgacccctgaccagcgatactaatctgtgtcaacaggccccaggggttaaagaaacacaacccgccgctgccgccttagcaggtgcctggagggggcggggcggctcccgggagcagccgggcggctgcgggaaggcacttcttaggcgccgcctcctcctcacagcgcccgccttctccgctccggcttcatgctctccaggtttctccacttcctttgcagacctccctcctgccgattacccactcctctgtgccccatttcccttctgtctttcctttgctgtccactctgcttgcaggatttgggaccaaacgccctcaggcatccaggtggtgcccgggttgatatgcagctgcctgcccttgcacctctgggggcttgttaaaatgcagatcctggggcttgtccaagtgggtaggtctgggcagggctcgtgaatctgcatttccacctagtacccaggtgctgttggtcctccaggctttccccctgcctctgccagctgctgcctctctgagatgtgctcttttgtctccaggaatggagccatccttaggagacagaggcacactgctggccatctaggctgggggtagagcccagatgggagcccacctggatggcacgaaccacctgagtgatccccctgttctcagaacacaggtgggtcacctgaggatgtcctggtgacgatgcaggagctgccaggcaggaccaccatgagtcactgggggtcatgccagtgagcttcctgcgctgctggccctggctctgctgagggccatgtcagggtgaagggggcacactcctggcttagataagacaatccagattctctcagagaaacagtcacatgtcagacatgtgccctttcttgggctgaacctagagttgttcatagcctggccttaaccctgccgattccatatactgtgctcatctcgacccagttgaggctgtgcttctgtgcttcttggaacggctcggctccagggccgtgaggttggcaccccctgcacccgtccacacacacagaccagaggagtgaggatgatgaggacagggacattaatcacagttctgttctgcctggcactgcagcccaagtccccaggagtctgtgtcttcccatgttcccttcgtcctgttcacagggaggtggaaatccagacagaaacctgccttctcctccatccccacttgaagctgctggtactgcctctggccatccagccttaagacgtcccttccttccgtgtggccccacagccacaggctgcccctcctgcacagtgcacacatgtctggcaggagatggcccagagaaggtgctaagcagaatgcggggtagggcttcatcagggcctggtgtgctgggtggtttgacagtgttttgtgggggtctttcctgtagctccaggaaacctagatgggggtcaggctggctgagggagcacccttgggtgctgccctttttccgagtgctctgcttctctttgactttactctctatcccctagtcaccccaacccactccttttccttcttcctcttggctgtagctccctcacagggctggggagcaatagacaaactctccaaaaatattttttttaagtttcccaaacttttccagatgccaagaaggggccagggaaactgcaactgcagaggggggaaggggagaggaaatgttccaaggccttccctcccttccgcctggaggcgaggataactatgggagcagggtgactctggtgccctcagacagtccacctggaagggagaaaggcccctaaccatcccacccttgctaccctccagcccatcctccatcctcattcccaaagcccccagcagcatgtagaggtagaggcagagaaggatgtcagtggggcacctaggaacttctggggttcagaagggtggatttgggacatatacccccaccagttgagggaggtcaggagctgagaagtaggagaatctgtccccaagggctccctccctgggagtctggggcctgatagaagaacctgccactgctggggttgaggtgtgggggaacagacaggagggggtggtgtgtgaggacagtacagggatcactgccctcccccagtcccaccctcaaggggtgctgcccccacctctaccattctgtccatccactccctggacacctcctaaaacaaaggcctctttgtggtcctggcctactggcctgcggccagcggcattctttgcgtgtttcctgagcacggatcccagcttcgtggtcagctcctcccccacccagcctgcttcccggcctgactcctggtagctcagagcagtcccctctcctgtcctgcccagggtcctcccccagttcccgtctctaccgtggacagatctggacagagaagggaaactcccaggagcttggccactgggccttcggtgggggttgggggacaagtggaggttcaactccatcccagctccagctgactttggtgggtttcgccgagcctctgttgatatgttctcatctgtaaagatggggaaaataaccaccccttggggctatcaggcagattcaatgtctccaaaacacagagctcctgcttgccgcagagtggaagaggcagtgtgtaactcgagctccccatttctgcactgctccctgggttcctagggggctggaggtgggcttggtgggcggctgaggagctcagaggagtctccagagtcttgggtgggacgtttccctgcactcctgtgggtgccccaaacctatggcccactcctgggagtgctgaggccagtaccccagggagtcctactccaagagtcggagctgggtccgtagcaagtggcctgcctgtcctaggcctggtcttgctctgtgtgcccccagcccctcctggcatccatgtcactctgtaacagcagtggggtgtcctccctgggttaggcatacagggtggttggtgcctagagccctgaaaatagcagacctgaggagggcgggggtagggggaccaaggagggatggcccagcttttggagaacactttcgaatgtcagcagatgcacacccttcagtcaccagccacagtcacacacagagacacacacagtcctaatgaagtcctagatcactgctttggggggttttccccccctcttgttaaaaaatgttcataatttggaaagaaaaggagctttttacaagctggcggctctagagaactttccgtcggttctttctggcctcgtgatgggtggggcccacttttcccttccttctctctctcccccgctctcctaataatcccccctttccagcctcaccaaacacacacaccctttaggagacctcccgccggctgtcaccccaagaaagctggaggaaagccgaggacctgtctgtgccctcctgggccccatccaagcgccaggcacaaccctccccccctccccactcctccctcccacttagaggttggcccccacaggcctagagtcttcagattgctaagcttcccagaatctgtgcctggacccaggcccagcagcctgcctgcccttccccgagggcctgccccactctcccgcagggtgagggtcccccgagtccttcttgcatccgggggccccgccagggagggcagtgctgagctcaccgcctcggcatctgccctccccctgcctctggtgcgagggccggccgcactcccgccagtgccttgctccctaatagctttttaagtccaaccacatgtgtctgtggagtgaggagccgcccctcacggggcctcggctctcctcctccctcagccaagaccaccctccacttggagcagcctcagggctgggggaggggggggtctgcctcctgagagcccatctgctcgccccgggcctagctgaggaagaagggggcgggggtctcttttgggagtgtcgcgtgaggccagccctcaggctcggctggccccaggttccccagcctctcctctgggtcctgcagtctaggatcctctctctctgtagggcaggccaggagggactggcttctgggtgtgggagcctgggtgaggagtcctcatctcacctcgcgcctccctggccagggactttggccagcaaatctctccttgcacccagccccacggaggtgaccccccagtcgcccctcaactcaatatacgtgtggttccctgtgcgtgtgagtggtctgtggggaggcctgtggggtgcggtttcgcaggaggggagtgagggctgaaaagcaacgagctagcaggcttggggtcctaatgagaaaattgcttccagccagggagccctgctctgcggctgaaattgcatccagccccagccaactttgctgccgcagtacccgcccttcggaaggagttggggaagcaggcgggcagggggaggagcgggctttgcacatgactcaggcccccccaccgccccgttctatatgaacacaccttgaagagtctcttctgcctcacggggaggagcttgagggtcaggcttggctctggacccgaccgtttgatccttgggaggcagaggagggagtggggagggatttcctttctgttttgctcagttctgctgcacttatgaggtgctcactgtgtgcagagggcttggagaggtgagcttgcataggctgggcccacatagggtgggcccacccacccggtggtattcactcttactgttaaagggtgttaggagcactttgttttcacaaagatcctgcgtggagtcccgccttctaggatgcttcatttgaaattcggcctccctggagtggggtgggaccctcttgcctgtccttccactcgggagcccagtgcctacacccgaggccagggaacccaggggtgaaaacctggcttagctacattcttctttctgttcctcacttacttggaccattgagcagaatcagctgcagaatttgtggggcccagtgcaaaatgcaaactcagggcaccttgttcaaaaattaagaatttcaagacagcaacagtggaagtcaaggttatgaagccagccctgcttccaaggaaagctggtaccacccagcagcccactggttcaggggctgtggcctttgccctgatctgaaacaggaggttccacctgcttgtttcctggatcctggggaatctcttcccaacctgggacggtggtctccctgctgctgcatccctcagagactctaactttctggattttagagatgttgcttagggaggagggctatgaggggagggaacagaatgagaatggatcacaccttcagtgcttagagagtctcagggcaaggccgcacttgtcacccttaggtgaacctgacagtggaaccatatccctggtgaggtggaacctgcagcctgctgggcccagccagtagcgggtcagtgggaccttcccctcctcgggtggagcctcccccaccaatgacaagttctgacggctgtgcctgtgcagagcggggagcgagcaggagtgcttggagggagggaagcaggcaggaggaaggaaacaaccccattgtcatcccccaaattactggctgggatggcaggggaggaggcggaaagccgacattgtttacttaattaaaagtaaacaacaatttgccgctgccagcctcccattagctgtgtgcgaggagccctacgagctgcagactcggctttcgctcccaccaagccggctcctgatgccacacccccagcctcggctccccagggccccgggccctcccctgctcatgtcctcctcaggctgaggagaggggaacaagctattaaaagtaaataaatacataaaaagaaaacccactagtgtctcagagtcctgtgggtcaggataagaatgtcagaaactgtcatgtggcaggccagcatggggcctagagacccctgagtgtgtacactgaggtctggttgtggtgggctgggcagggcagggggcacttctttgtccagtaagccagatgttggactacctggggaaggcagcccctcccttcctccctccctccccgcaaccgaggccctagtctatactacctggaagcctgggcctctctgccccaactcccactttttccttttcccttttagcagcttataaacatccttctcccatctttttggctctgctcccagaagggggctgttcagggatcctggagggctggggagagaggcaagctccttggggcctgaggggagaaagacagctggaactggccccacccccaggacagtacagctacaagtgaccctaggaacaggggagggggttgccctaagttggggtgaggtggggaccctcccagctcctgcttctctggagccttcaagcaggaggggtggttggatggcaagaggggttttgcatgggcttccaccaggctccaggggctaagcaggacacctttccagggatctgtcctcaggaaagccctcacctctcctgtaggccctgcctgcaattatgtagagcacaggcttccatctggacctcggtaggcatgacctgaggcccatgactttaaaagctcaggatgtgcgctgggcgcaggagctcacatccgtaatcaatgccagcactaggaggcccagaccagagggtcgcttgagcccaggggttcgagaccagcctgggcaacatagggagaacttgcctnnnnnnnnnnnnnnnnnnnntagtctgggaccacagctgcatgctaccacccccagctaattttttaggagagctaggagggtccttaagcccaggagtttgaggctgcagtgagctatgatggcaccactgcattccagcctgggtgacagagcaagaccctgtctcaaaaaaagcaaaaaagaaacagaaaagaaaaaaagctcagggcccggatactgcagggagagaagtacaggagcacatgaaacgtacccagctttatgaaaccattgctgagcctccttctgggggccagacaggcaaggtggggaggggtaggtctgagaaaagagctagactgagtgaatgaaacagccccaatccccagggtgtgggggttgagaaccctggtctggagttggtccctccaggaagatgtaggtccccactcttccccggagccaccgtctcacctttctcttgtcccatcccccatcctcatttgcctcctctcatcttagtcctccaccattaggattcacacatccacatgcacgtgcacacaagcgcatagatcccgggattcgtgcacatcgggattttcacatgcactcacacacatagacaaatctgggaagtctgtcccatacttaattgaattaaaggactggggtttggcaggacattgtgtatctgagctgcagcctcttgcagccgtttcaagggctgatggttcagtctccctgtaattccagccgctgctgctccctgtgggcaggtggctgggtctgcgcctgtcgcctctccccttccccttctctctccttttacttcctaggccagagccccccagcacagggcctggggaggctggggacacccagtgtattcctcctcccttctcccacttgcattctgggagctagtgggaggttagggcctcctgaggaggaggtacccccagcgtgaggccaggggactgtcagaatagaacagtccaggcaaatccctccttccaggttttctgctgcccattcttggagtgggagctggaggctgcttgccactggttggaaagtggacacacttcttggccaagtgtaagccacctggctttaaaaggtggagagtctggtctaaggactttggggaaccctactggagtggccaggagccataatgattgggggagtggtgccagcagatggggtgtgctgcagggcaagagggatgctttttttttttttttctaatttgatttaattagaattcttttttttttttttttttttttttgagacggagtctcactctgtatcccaagctggagtgcagtggtgcgatctcggctcactgcagcctttgcctctggggctcaagcgattctcttgcctcagcctcccaagtagctgggactagaggcatgtgccaccacacccggttaattttttttgtatttttagtagagacggggtttcaccattgttgccctgggtggtctcgaactcctgagctcaggcgatccactcgcctcagcctctcaaagtgctgagattacaggcatgagccaccgcacccggccaagaggaacgcttttggcctccatttcttccctccacttcagcctctgctttggcaggctctggggtgggagtaagcctgttctcagctcccctttactagggacaggtaattccactctggctgctccttggagaacagagtggatgaactcagtccccacctctcagagggacctagtacagagcccagcccccactctgaggaagccttggatgggccattcctggcccagagcctgaggccattggaaagggcctatatctggaacgggtgaaggagagagcccgggagcctcactgtgggtgggaggggcgtggtcagccagccttgcctcctggggcatcagctcccagcttgtgctgcaccctctgaccacaactttgtggggcgcctgctgtgtgcagaatctaccccgaaacctatagcttaggagaagcctgggtaagctgctaatggctggtagtatgggtgtccaaggacctgttggaggagcccagtccagccctacatgtgtgacccttggtgcctggcaaggcgggggggtagggagcagccctcgcacagccagctagactgttttgctctggggcctgaggattgcggggccagggaagcaaccaggcccagtctggggccctgtgaagcgatctgcactgcccagggtcagggggatgggggggtcggcctcacctcggctaacctcccagcggaacaaaggggcctttctccacgcccgcccgggagggtgtgcccgcccggctgctgccgccactgcagagggcgctgattttttttttcttcctgacttttctccatttctgtctctggttcctgatctctgacttttattctccattttttcactttttatggggatggggtagagatcttccttttcaagtgtttaccaattgcagagacaagtctgcactgccaaaaggtgagggcatcctgggtgcgttaggaatactccgggagtcacgtggccttagacccccccctcccccccaaatcgagggcagctccgttctgaaagaagcaggcaggattcagagcggcagccacacagggtgggaccgggctcactggataacccccagtcaagctatgcacctggcaggtcccccgccttctattcgcccacccatttcgcagtcccctttccatccggcccatgcaccgcaagctgttcctaatcaatgcgaacgggaaactcggccctcatatcacgggatgtgtttggcagcgacagcaacaggagccgctgccacgggcagctccttccttggtgcataaaccagggtcccagtggcctgggcctgagtgggttcttctccttcctcttgggaccccctgggtatgcagagggaaccacatcccctggagctctgggccggtcgctggccgcgccccgccgcagccctcggagggcagctagtgttaactcgctgcgccacctagctatggcgtccaggagtgcagcgcttcgctccctgaaccgcgtcgcttcctgagccgcgccgctccctgagccgtgctgctcggcagcctggggaaaacctctttttggtccttcagggagctatgaatgaggaatttggcagctgtcagtcggaggatcagtgtcactttgttccttcagcagcctttgctgtccttatgcaagcttggtactttatagtatataaaactcaaagttaaaatatgttaaaaaaaaatctgtaaaaatccccactcacatctcatgttgctgagcaggtcttggttgtgttgcaccaagaagcaggagagacacactggaggtctaacagcagcaagtctaggatttggagcctaggcttctgattccaggcccagggctctatgcagcactcggtgccgtcctattcaacccatccctgcccaggctcttagggctccaagctggaaatttgcagtcaaaggcccagattcctcgtatttcctctggacagctctggacagtggctgccttcgggtctccagggcaaggagaagagcaggcctgcgagagagtgctctgccttcccctgctgtgctgttctcagtgaggctccagttccttcctctggtcattccagcccttgagtatggtgcaagtatgttcagtcctgtgtctggaaccagctcggctttgcaggaagattagcagcatcagggtttccacattaattcactggacatgagtgtcggtggttgggctgcaagaaagctattctttcttcaggagggggaagatgtcagctagctggtgcctctgttccctgggtggtcagtgtagccatggtttgaagaaggatctagaagggtctctttggagtcttatcatccactgcagctgtgctttgagatgtgggggatgtagcagcaaacaaaaccaacagagagggcttgtcctcaaggggctgatggtctagtggggtgttcctggtcaggacctcctggcctgagtggcctggtggccaggtctctggggctctcatgccttccagagctagagcctcccacttccccagccatggaccagccagaggttccctgtgtaggtgggatttggaggaaaggctgtttagtttccagcctccaggtgggagaagggccccacttaaacatctgattatggtgggcatttgtgtttgttgcttgtccatgagcccagggtcagtccctgctccaccaaggcaagtctctgggtgaaggaggcccctttggagtcaccagcctgggtactgagtgctctctcacaggggtattgagtgctctctcacaggggttgaggaagttagcacctgaggaggggaggcaggtggcttcagcctaactcccacttccccttccccacagggtgaattgaagtcggtgggttctacagttctaatcccaggccctgaggtttcctggatggattcttccaaggaaagggaacagtggagggaggcaggagcagaaccctgcttaaggccagaaagagagcagggggcagagagaggtggtgggggaggctgatgctccccaatccctgccgaccctctgtcctttttgatttcctcaggcaaataggcagagagcttagggaccttcccctgccctgggctaaagtgaatttcctgctctatagggtctcacttcttccaccttccttttcttagccagttgttccttctctgagccttctccttttccttttcttcttccttccctcccttccccagaagcattcaggggtgggtgagtaggggctccttgtcctggggtctccccagttcctcactctgctgagtgcccaccagacagatgctggcagctgcatgcagcccagcagttgtgcacacaaagccactcttgagtatctttaggaaagttttcctctttctgtttttttttttcttcgcccaaaggaataatttcctctctgctcttttttgtttttgtcccctttccctgcctctctcagaatcttgtactgtactgctctgattcttcttgccccagtcttctttctttgctttggccctgattctctactgtggctcctcctctctctccctttctctctatcttttagttttagttttgtcttttggttgctctctggctctggggcttcctgccttctcgcatccctcctccaaactcctgcttgtcccaggcgcatcccttgagtggcctgcagagcctccgcctcctgtttctcataccaggttggcattagagtctggaggactctgtccctttatgaataattagaccaagggcaagtgtatttgggggtaggaggagggtgatgcccagccctgggaggttgggacactattaatagccctaagagcagctgggggtgagggtgattgtctggccagcctgtcctgtcctgggcagctcaaagggccagaaagggcagtgctggaaatagagaaagcgggtgggggtggaagagcagctctgcaggccccttgctgggatgggacccccccctccccagggcccctctcttttcttgacatgtggggtatggagggcattctccactgtcagtttttcttcgtcaagttggggaggggatagaagcttcaggggctgggggccgcttgcctggaccccaccatcacatgactcttggccccaggccctctcagaaatgctggctccagctgccggctgaatcgtggcaccagccagcactgccaggagaggcgcctggcctggacgcccatgggcctgtgcctgtgctcctggttttctcagctctctgtattccaaggctgggctgggctgggcaggccttgggcctagcactcccagagtctagggggacaagctctatcctcccttttccctgttggccctctctcccccacccctgtttctagtatggtgactgtcttgagaccgttggatggctattgcacaccgatgtggggagggatatgcctgtacaggtgtctgcccaggctctgccattatatttgcagagaaacctctctgttgctctttgtagatggtagtgggccaggccccaagggagcccctctgttcactggcagtggtccctgggtcaagacaccaaaaactgcaatctaggacacactcaccatgtactcaagagcgtgagctcctggggaggggagctgagggtcagccacagcttcccccaccagggtgggaggtggcatttgaacagagttgagaaggaggaataagcattcagcaaatggagatgaagggaaatagtaatccaggtggaaggacaggcgacatttatgtagccccaactatgagccaggccctgagctaagcaccttattatacatgttttctcatttattccttacccaggaatgctaatggtaggtgttatctcccttttacagatgaggaaacagttcataacttgaccaaagtcacaggctggtaggttctggagcacggatgtgaattcgggggagccttggtatgccgttgctggccacccacctccttcctcctcctaccctccatttcagcatgcccccttcggcccctctgtgctggggcaaggccagctcacccaggatagggtatccacagtggtagagcactgtgttgtaccccctcagtggacacaggctccagaccaagggcacctccctgggtaggccaagggcaggctcagaggacaggggaagcagacccaggccaatggctcctgcccaagatgtttttctttgccttcttccttgcctgatctttgcctgtcatcttcaatctcttctgctctgatgggaattcctaccccaggtatctctgaaacaccccagacagtgctgctgccatgccctgggtccacttgttccctccatagtcaggtatctgaggtgctaggtttggtgctgggtcaccttgccatgggcagacacaggaggagcctgcaggcccactcgcatgtcccattgctgctgtggctgggggtctcatttattaactgttgggctgatcctggagtggccattggcaggtgggcctttgtccacctgctgggtgctctgttgtgcaccaggggcatatcccttctctctctcctttgctggccactgcctgtcatcccttggggaagagcaactgagcattcagttccccagtgcctcctggcttcttctgccgctccatgcctgggcccatctaaaggagttctccctgggctggggacggctgctaatgaacgggagccaagcagagaacgctgagtagctcacaccagaagaactccctggagggctccggggccacttgctggggatggaagggaggtgggagttctattgttttcctggaggaaaattttaagcttaggaacacctttctcattatatgagggaggcagtgatgggctgtgtggctggaaggcttctggctatgagtctatctccacatggggagtggaggcaaccaaggactgtaggagacaggccttcttcacctcgacaccgtgtggggcctgaggctttcagatgaagtgtgagactgctctgctggtctcctgggtacaagatgagctgatggacttgctttctcctcgcttcccgaagccttactgccgagctgtgagtcctgtagtagccaggcctggcacttgctccaggggcacccgtagaggccgggatgtgttggaatggagaaagtagttcttcctggggtcaggggatggagaggggaatgtcccatccagatgctggcccttcatctgccaggttcctgtgccttccctacccccccgcccccaacaatggcttttcttgagcctaggccctaggggcagccagagcaggcctagaccacatgtgggtgtcactcggtttcttcctctttcctgtcacttatcccctctgccatgtcctcttcccccatctccagcaggtcagtcaagtcaaaggcagaagcccctttggatctgtgagcagggagggaatgaggaaaggggagaggacgataatggggtgacatgttcccctgtccttatccctgcccccacccacagcttgcgggctctgcttcttgttcaggctcctgctttaaaccatgtgagactctagggatgacagaggagggaaaaacctgccacctcaggatgactccaggatgtgtgtgtgcatgtgtgtgtgtgtttgtgcacatgtgtgtgtgcacatgcatggtggctggtggagcagggtgaggaatggagagaaggagaggaagatcctagaagccccgtgggcccagaccctggccaagcctcatcccccggccctctggctgccctgcattctcaaggacttccttggtcccctgagtctcctgtctgctgagacggggagaacccctctgtgacccgtccccttagccccccatctatccaccgttcccctcctcagggtgtctcagattctcagacttcagtttcaggaggcacaatagttacattctccagctctgattgctacaggcagggcctctggctccccttgagattgggtttcctgtgccctggacgctccagaatctcagaggaagcgggagagaagtaggaggcgggtgcagtgctgggagggccagtgattggccccagaatcgcatcagcccttcagaggatggggtgttgcagctgcccagaggcacccccagaacagaatgtacccccacttgcttctggaatgtcaggcctgggagggccaggggatgggcaggcacaccccaagggctgttctccccgtttccaaaggccagcggttcctgcagagttgaaggggattcctctctggtggctccagatgtaccatctcactccaccctttctggacggcaagaagtggttagtggcacctcccgtgtgtgtgcgcgcgtgtgtgtgtgtgtgtgtgcgtgtgtgtgtgtgtgtgtatgtgtgtgtctgagtctgagcatatgagtgtatgcatccaagtgtatgcacatacctgggtatgcatatgtgggttcagctaaggccaaatctgtgcacacccctcagcctccataaaacttgttaggccaaagtccgtgggggcaattggccagcaaattatacatggcccctttcacagtacaagtttgtttcgagcaggagctgagggcagtgttggctgtagccagcaggaattcctccctcaccctagtgggagccataactacctccccatctgtaggtggaaaatatatatatatatattaaaaacatgcatccgggcacggtggctcacgcctgtaatcccagcactttgggaggctgagacgggcggatcaccaggtcaggagatcgagaccatcctggctaacactgtgaaaccctgtctcttctaaaaatacaaaaaattagctggtcctggtgacaggtgcctgtagttcccagtactcgggaggctgaggcaggagaatggcgtgaacccaggaggtggggcttgcagtgagccgagatcgcaccactgcactccagcctgggtgacagagcaagactccatctcaaaaaaaaaacaaaaacaaaaacaaaaaacaaaaacatgctgtcagttggagtttatgtgcaatcccaggctcctcctggctgctggagcttcccctccagagctctactgaagaggcagtgtcctcttggaaacacgcacaagcacacgtgcctgcaaacagcagaaggaagaggggggtgctgaagaggtgagggggaggcaaaggaaggacagagggaggggagccaagggagacagggaagtaagatcagaaatggggatccaaggggaaaggcagctgaataaaagaagtaaggtggggacttgttccaggggctgagaaggggagctggtgtgggtgtgagaagggcaattttgcaggagaactttgtggctgttccagaggttactgaggggcccccaaggaagagaggggcccagagtggccacttggctcagcctggctctggtctgggcactgccagaggcctccagcccacaagctgttgttgctgtggaatgaccagtggtgtgcagatgaatacagagtggccccagaacctggagccaaatcccgtttcaaaggcttcttcagcagagcccacttgggcccatgcggagggagtccagtcttattgcctgctccttcgtagccctcccttccagaagcctgcaaagtggccagaaccatgggcaggggaggcctctgcctcagagacatggatctcacgagtagcccaggtccccagagaaggacagcccgcagagctgcgtgtttgtgtgacacgagccagcctgacacccccaaacagcatcgagaatgagctgtgggctctgagatactctccctcccctagcctggcccagaaaccagggaccccgaatgccagcctggccaaggcacctgtcggacacagcggctgggctcaggttttaggcagctgcatttgatgggccaagtgggaagcagctaagagcacagaaagaactctccagcttccagcaccagcatggagggaaactctgagttggtgtggggcgaggggaagcagcagcacccactctatcccatctccaaccagtatctccagggagcgctgggagccacagtccctgaagagactgggagggtggttgggtggccctgaacttgggggtgcacagttagtgtccccactggctggcaagcaggctggaaagaagcctgaggccagaaaggcttccaggggacatggccccagaagactggggaatcagagagacagtcctcgggggtgtcggccgatgacagaggataaaagatgaaagatggagcccggcacctgcccgcgttgtgccagccaacactgtccctgcccctccactggcccataggccaccagctggcccattgtccccagtgagagagcagacactggagggggctcccttgtgggcaggggctcactcatgtacgcctgcctggcagggactgccagggcagagccaccccgggctcaggggcgaggaggaaagaagtgggggtggccaagagacagagcgtggagactgagtgggaggcccggccagagtccgggaggctgccctccaccttcagagtggagaacagagccctgctgtgctgcagtcaggtcccctcctgtggtgttggcagtgggcagtgtgcggggcctgcgaacaggagataaagaattcaggcagagtgttttttctcactaaccgtggatttgtgtatttgttcagctggtggctctgataagccccattctgccagataaaagcagagcagccacgaggcagggcctggggaggggcatcctaaaggggccttcctcctttctgtcccaaatcccagggttatcccctcccccggggaagcccagacagggaaggcagtcacgacatggagatgctctgcagctcctgtcacctgtccagagcaggtgtagacctcaaggcaaggctccccaaagagcctgccaggtaagaaagctggcccacgttgtgcctctggtgggcaggacgtctccttgcctccccaggagctgcctccccaggagccctttcaccatggacctagtggcctctctgggccctgcagccactggctggttcctgccagcctccttcctctatctatccaaggcacatccccgagctgacagggtgctcagagaccttcccccgtcacatccctggtgtcccgaggtgcctgcggccctatcggggcaggggtctactcttgctgagctagttaaggccctggctagagatggcctgtgaggactttagccacctttgagtagagctgcggtgtcccctgcccctggcttcagccttccctgctcctttcactgtgctggccagcggggagaaggagaacaccacttgagcagatcagtggggccctggctgcagctgccccggccgcaggcctggctcctgtgcctctgagcctgggtccagatttcccatgtctctgccttttgtcctggagctgagctgagcatgtcaggggccggcggtcgcggcattgtgggcctccggctgaggccgccagccgtaagatggctgccaaggtctaaaatggctgccagcagcgcccggagcagcgcccggaggcgcgtggcaggggctgcactcgcaccggatccttgctcccacttgctcctttacacagagctaatagtaataacagcaataacgttttggggctgtgtcctgatttagaaggatttcctgtctgtcgcgctctcctggagccctatttgtctctgcctcagtcgctggcccacctccatctctttgtcgggttccctctcggctgtccctgggctgggtacgcgcatgcgcatccacacgcgtgtgcacgggcacatgacttgccatctccacttggtctttcgcagtgggtaggggccgctcccatggggtggactgtgaagcttcctccttcttcccctgattccactgatccagctctggagggcttggtggggaccaagttgtccctaggatgagtggggttcatagcagagagacccctgggcagcagagtggggaccacgtgaccctcgctgagctctgcacatgggtcctgaggttgtgcccttcctgagccatgatttagagcaaccacaggactggggtctgaggaggccctggggtgggctgcctgctccgtagacctcttggctgtcactcccggactggctggggctcaaatcagacccagaaacccagcaatgggccaaggtgaaagagtgaggtagtatcaagaaagttcacattcacaccatgctatggcacagagaggctgccctctcagggaacatgggtaggcttcctccagagcagagagtgccactaacaaagagatggctcagggtgggaacctcttttgccaaacacaccaccagggctgagcgaaaggggaggtatggaaggatacaccccaaaccagaggtggtgaagtatatccttccatattaaaagcacttgttagcactttccgtattaaaaagaactactttttcttgactcgctacaatagtatttattttttggaattaaaaaatcaaaagttaagtggggatggggtggaggggaagtggagcctgaaacagtcacccttttttacccattacactaaggcaggcagcctggagcatggccagtgctttcagccccagacatggtggggccctcatgctgcaagcaggggtgccacccgggtgggctgcatcctgccctccagccccagaacccagctctgttccttgcctcccaagtgactgatggggtccctcaccccaaccctagggctgatgtcaccttttgtgaacctcctttatggtgggggccagcaggttgaatcagggtggtggcgagacccaggaggcaggaatgctctttaaagtcgggcaaagccctggccaataccaaggcacgtttttcagatgccacccccatgtggtccccctgtgagcagctgattcttcaccaaatgcctggcttcctcctgccccacaacctgcctggcccccctccaccaccctctcgccagctgtcatgcccaggcaggcattctggaggtccccgttgtgcccctggcacacaaagctttgaggaccagggggaccagggtggggggctttcccaagctcagcaaaatattcacacacacactccaccctgcccccagccctctgtgagctcccactgcacaatgagcccttgtctcggggctccctctgagcagctgtggcaccggggcatgagacagcccagacaggctggcacagagcgggcgacagcgtcagggcagacctcccccctctgggttgccaggcactgcctctgagcataaaggtgaggtgggggaggcgcaggcagacaggaatggcttcaattaaccaagttagggaaggggatgctcctctgggagctggagctgggtgggggatgggggacccttgggtctgtccccgctgtggagagagatggtctctgacttctctcttgggacccctctttgctcctgactcttggccggtgcttcttacctgagggtgactttgcccttaagggcacagtggacaatgtcttgggacagtttgggttgtcacaactggggtgctactgtcatctagtgggtggaggccagggatgctgctcagataccccacagtgcacaggatggtccccaccagagagagcaatccaggccaaatgtcagcagtgctgaggctgagaaacctgcactgggcctgtctttccttctctgctttgggtctcccggagcctcctggggctggtttggggagagggtggggtgaaggtttctgtagccagggtgggccgtccctgctcttgcaccaggctggaggggccaatgcttggctggtgcttatggggaactttgctcctgatacattctccccttttgtgtctcctgcagaatccggacaatcagatagttcaaaccagcaaggagatgcggacatcaaaccactgcccaacggtcagtgccccccacctgcccagctgcccttatccttcatgcccctccacttccttcccccaccctggctgccctggccaccctcacttcttccccttcattcagctgtcccttgactgagcttagcttgctgtcctgaggggatgggggcacacctagaggatcccccctgttcggtgtagacctgagggctagcctggagctggaaacgggacttgggagggagaagcaacagtgtggaagacctttggaaatagccaggcagcccccttctggccttgtcttgactcactcatcctttcccctcttcagggcacttaagtttccaggactgttttgtgacttccggggtctggaatgtgacggagctggtgagagtatcacagagtaagtgagtccttccttccaggccagggatggggattgaaagtgaggaggtgggacctcatgggatgtcctcctaatggggtcttagggcaggtggatgggaacagatgctttctgggacactctcggcttcactggtgctgggctgggtacaatagagtcttccagagaggcctgtctccagtctccattgctttggaggaaaaagaaaaagtcacaaccaaaggctcttctgtgacccactagctgggaggaggttcctcagcagcccagatggcccactttctcccatctcctggccccacagtaaactcaccctgggcttctgggaagctgttcatgacaaagaaacagaccccatcaggcctccccccacctccaaacctcatcaccctctcgttcttcccagctcctgttgcaacagcatcagggcccaacttctccctggcggacctggagagtcccagctactacaacatcaaccaggtgaccctggggcggcggtccatcacctcccctccttccaccaggtaagcccagtggccctgcctttccatcttctctccactccccccagggccagggccgtcccagtggctatagtcagctgtgtcactgaggctagggtgcttcagaatgtcacctctctcattgagggcactggctctaacactttagagtccaccatgcgcagtcacccactgagctgctttgtgctgtcatgaaggacccagccctggggacacaaactcgcacaaggcatcgctttgcctggaagtgggagtccaagaaggtctctgtcttggggaggtgacatttgagcccagacacagagggggttgttggggggtatggggaaaatgttccaggagaagagggtagcctgtatcccagttcagcctgcacaggctggcggggcaccctgcagagggctttggaggccagaagaaggcatttagacttcatccctgggtagtggggacccctgaggggttttaagcaggggatgctgagggtgtgtgttccagaaagctctctccagcaacagtgtgtgtgggcgggactgatagccagttaggaggccattggaaaggctagagtgggggagggcctggagggtggggtggatggagagggagggagctgcttgggaggcagggatgtgggttctggccagggcaagttgtgctgggcagggtccactccactttttttttttttttaaaacgggtgtttatattaattgcgagatttttggcattcattttgattttttaaaaatatgggactaggccaggctcggtggctcacgcctgtaatcccagcactttgggaggccgagatgggcggatcacgaggtcaggagattgagaccatcctggctaacacggtgaaaccccatctctactaaaaaatacaaaaaattagccaggcgtggtggtgggcacctgtagtcccagctacttgggaggctgaggcaggagaaaggtgtgaacccaggaggcggagcttgcagtgagctgagatcacgccactgcactccagcctgggtgacagagcgagactccatctaaaaaaaaaaaaaaaaaaaaaggaactaaaatattctttatattgatgactgagttttatggcatttttgtccccctgacatttttgtccctctgacatttttgtccctgtgagtacgtcattcacctcaccctagccctgggggctgccaggaaatcataggtgggatacaggaggcagctgagggttttgccgacttctctgatgtgggcagcttggaggaccgtggcatcacagattgggaaggggcttgaggaagaggagcaggttgaagctgatggcttgaggggccctagggctgatcttggggttgggcacgcagtgagtgcccagaaatgctgctgtcggccggcaccactccccacccagagggccatctatgcacagttctttagcctggactcttggtcactccctggagcctcagcccatccttggcccatgtgaccctttctttcttccccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggtatgggtgcgggggatcctgacccagagcaagggcagcccagagtctttttgtccccttctcagttcacctggtgagcctcccaccagttgtccccctgtcggggggcattacccatctgttttcttgcctcctgatcttccagggagggcagagcaggctgaaggaagggagtggaggtgagggtgaggaggggtgctgtgagagtcagcagcagagcccgtggtatggcggtgggaagcagagggggtgccaagcctctggtgccccacagtgggatggccgcagcccctcctggtatttctctagaggttgccccaccccgtggcctcatggttgaaagcagtttctcaccctgggggctcatcattctgtgtaggggattgttctgtgcatggcaggatgtttagcagcatccctggcctccacctacaagatgccagcagcaaaacccccacccccagttttgatgaccaaaaacgcctccagacattgtcagacgttccctagtgggatggaatcctcccaggatgagaaccactggtctcaagggcccagcttcacagagagaggctcagagtctagtgaagaatgagcagagtccttttgagaccaggtagggaagctagcgaaggggagagagtacagaggaagccagctcagaccttcccagtctcctctagggatcttcttcttgttgaacccaccccccttcacctccattcttgactgagggtgcagacagacctagagaggactctggaagacagcatgtaacacgtgcgtgtgtgtgtgtgcatgtgcatgagcacatgtgtgtgaggaggctggccgcaagagtcccccgctgacgtgccagtggtacagcccgtgtttatcctcactgtgggtgtgacagggcctgggagtgcagactcacgcgtgtgggttgtgcacagggcatggctgctctggacaggcctgggccctgggcatcattctcctcctccaaaaggtgagggtctgacctaatggtactttgtctgatgttttccagatatgcccctactgggaagggccaagtgggcaggcagagtctggggtggagcgaggtggggctgggaagcactcctgcttttctgctgccccagaacgaatgcaagttctggcagcttctcctcctcctgggaggaggaaaggagggctcgcctccaggcctcaggctgagggagtgggctggagaccctctagatggccagcagaggctggcctctgtgagaaggcttccttgcgtgactctggggcccctcccaggctctcctcgtggcaggcagggacttgggccagcatgggccacatgcttccctaggggagccttgagaggcagagagaggagttgagaaggcccgggagactcttgggctacatcctgggtccctggccggggcctcagtaggtgaccccttctgcaaggactgcccctggggtgcatagaggactgtgtctgcagctggctcctggggcaagggctcctgggctcctgtgcccagacctaattcctgaggagcccccctcttcctggctcctgctctctcctttcttggctgtctgcttttgcgcctgccatttctgcatttctgctccttccggcagtcctgccacgcacggcccctcaacatcctcctgcagcaccctccggctcccttttcccctcaccccgctgtgtgttgttttcatgggctgcaacaaattgccaattaagcagcccagctgcaggacagggaacagctggggaggcactgtgcggccatggggacagctgtgcacagctggtaggatgctcccccctccccactgtgccagctatcaggtggcacacagctgctgccagataacacctccgctggcggctgggagttcgcccttcccccgccccttccctctgcagttaagatggctctttatttctctgttctgcagcccctccacccctcacccaaactgacttgatttgtcctccaagggtggcagctgtgagatctgccccaactctaccttatccttcccagcctgggcacaaccttaaagctcagcccaagatgggagctgatctttccagaagaacctggccccctgggggccctgctttgtcatttggatgctatggccactgggcagagatgaatttctaaagacagacttcaaacaaggtgttctctgtgcccttgtttcatgctgaatgccacccacacctctggcaccagaagcagggcagagccctgaaattatccatcctatggcagctgagcttctgggtcccctggctgggggagtcttctcccctctggctctgcctgcacagcccggctaggcctgagcagcccaaggactctccaggtcctctggcctctgtccctgctctctcgctgggcattgtgtccctcctgagggctcatggctgtgtgctcccttccctaaacggggccctggcttcttcccaccagaacctcccatggccccgggcaccatggcatagaccccagcctgtccctcccaaacttaccccttcccggctctcaagctggcgccctggggttcctcctgcactcctttcccaatgttggtcctgcatcccaccctttcacttcattacctgcttgccagggcataggctggggcccttgctcaccccctgcctggcacacaccaccccacattacccaggggcctcgttttcctctctggttagaagcaccccttggctggcctacacacagggcctcggaaccaggcctagaacaaggcctgggactgggcaaggagcagcaggagggagcacagtggaggaaggggcagtggggaggggctgaggagagaaggagcgagctgctggcttcccgccttccccgcacccaccccagcccagctaaacctgccctgtgttgctgcttcctccccccaggcccggcttctctaaagaagtcaggaaagctggacttctgcagtgccctctcctctcagggcagctccccgcgcatggctttcacccaccacccgctgcctgtgcttgctggagtcagaccaggtgagaaatggggggccccggaggggggcagttggggaggtggctgagtatctaggggcagctggccaggtgaaggggccagagctgaccccgagtgacagccccacgctctccaagtgggccaaggtgcagcagcgggtgggcatgggagccggcccctgcttcacgtagcacctcatcgaggaccaggccgggcccctgggctgcccacctggctcctgagcaacctcccacttctcactcctcacgtgcatgggtgctacatacaacacaagcctgtcccgagtcctccccaactctggcccagttctccttttgtcctgccagctgtgagcgggaaggcacagccttctgctctgccttcctgccggctcctctctcccagctcctggctgagcccaggctctggatttttgccagcatgagcccaggttgatgtggggcctggatggagaagagtactcctaaggagcccaggctcctgcggcaagtagctaccttgtctgggcctccctgccgctttctagaaaggaagggctgggtctaggggacaggtggtacctgggctgctccccaggaaaaggaactgcccactgccgtggggctgctctctgacttcagtgtcccagttgagaaggtgctcaggatgagaacacctagatcgccctgaggagataggatcaggcaggaggctgtgggagctgagacctcagccctgtcactccttcactttcttcttccctctctgggcacccacctggcagcaagaggcctggactttttctggatatggccctatgtccgcctgccatctcctgggctcgtatgtaggacacagaaaatgaggaggtttacctcctggcttcctccttggggcctcctggctgggagcccagaggcagccggtgctggggcagggtgtggtggccgcgaggtgggggtggggagcccaggccctctacacaggcagcaggagggcgcaggcctggctcctccggctccacctcagcttttatgaactccagagagaagccaagtttcctcagccccctaatgaaaccgagagcaagagcgagctgattggaaacagacgggaggaggaagagctggggcctgctctgggttgggaattgcgtgtgcaaggacgcgtatgtgaggacacgtgtgtgagtgatgaggctgagcacatgagaacaccgcctaggtggcggtggctgggtgcacaccagctcgcactcaggagatgtgtgtgcatatgtcagacggccatcctgagcagatgctggctttgtcttcatccagagccccagggaaccctctgcctcctcttgtcccccacccagtctcccacccagggcctgaattaaggcagggctagtgaggcactcaccttaggtgcagagtgtcagcaagtatcaaaaactcagtcatcaagataaataatattttaatggaatatgttttaaaatccaaactattgcaaaaaaaagggtatggtaagcaaacaccagtttttttgtttgtttttctttttcttttttcaaagacagtttcctgctctattactcaggctgaatgcagtggcacgattatagctcactgaagccttgaactcccagactcaagtgatccctcctgtgtgccaccctggctaatttttaaatgtttgttgtagagacggggtcttgttatgtttcccaggctgacctccaactcctggatcaagtgatcctcccaccttggcctcccaaagcactgggattacaggtatgagccacagcactcagccatgtctttgtttaaaatggtttaaaatgttgaggctgggcacagtggctcatgcttgtaatccctgtactttgggaggccaaggcaggaagactgcttgaggccaggagttcgaggctgcagcgagctgtgatcatgccactgcactacagcctggatgacagggcgagatcctgtctctatttaacagatactggctgggcgcggtgtctcacgcctgtaatcccagcactttgggaggctgaggtgggcggatcacaaggtcaggagatcgagaccattctggctaacacggtgaaaccctgtctctactaaaaatacaaaaaattagccgggcgtggtggtgggcgcctgtagtcccagctactcgggaggctgaggcaggagaatggcgtgaacccgggaggcagagcttgcagtgagctgagatcgcaccactgcactccagcctgggtgagagagcgagactcagtctcaaaaaaaaaaattctttaggctgggcacagtggctcatgcctgtaatcccagcactttgggaggccaaggcaggcagatcacttgagcccaggagtttgagattaaccaggacaatatggcaaaatctcatctctagaaaaaaaaaaaagcaaaaatctaccaggcctggtggcgtgcacctgtagtgctggttacttggggggctgaggtgggaggattgcatgagcccaggaggattgcttgccgtgatccgtgtttgtgccactgcactccagtctggatgacagagcgagaccctgtctcaaataataataataacacttttttaaaaagccaaataaaataaagacaagatcctaccctgcctcatctgcctcatcctaatctcccagcgctggttgtgatcaaactttatttacaaaaacaaatggctggcctttggaccctagtttgcctatttgattattattattattattatttttgtattgcattaaaacatcatggatcctgatgactgacttttttgtgccgccttaacttttgtgcctgtggcggctgccttacctgctcaggatcctcaggaccctctgaccggcagctcccctcctctcctgtccctcccactggctgcctccttggccctgacgcccttttttccctgcccacgtgcatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacaggtgagtccagagggccccaggagcccggctacagcctcatctccacatctatctgtctgtctcagggctcacagggagagggcccaaaagccaggagcccacctggggctggagcagcagggagctggtagtaccaaacgcctcgattttctgggtctggggacgggggtctgtgtattatgccagggcttgtctatcatggtccggagaggtgggggcagcatctgggcccccttgctcagtcaggctccttgcctttcccatggtccttgccccctcagcaggagtgaactcatgatgatccaacccggatctgggccctgacctcccagcgctcctcttaaacctcggggctgcaaggatttgctagattctagaccagggtttccccagtatcagcactgttgacatttggggctgtttattcactattgtgtgagaccatccagtgctctgtaggatgttgagcaatatccctggcctccacctgctagatgccaggagcacctcctcctccccagtcttgataataaaaaaaagtctccagatttcagtgtgcccaggaggggaagaccatccctagtgaggagcactgtgtcaagggaaagccccgatccacatagctgccacggagactcctgctggcaggacttttaacaaagggttcccaggacggtcctggttctagagtgaaaccctgctgctcctcagccctgggagacacactggctccccccagagcccttctctgtcactgacagaaactcagggttgctcagcgaaagaatgatcccaggaggtggtgggccagagatgacccttcagtgggacaacggtccctggttggaatgtggaggtttctagacctctgggaaaaatccagagcctcagcagcatgctgtaataggagaagctctagctcctctgtagccagccctcccagcttggaagcctgctgcgagaggtcaggcagggaggatgctcaaagggctgtggtggggaaaggcatcccggaagcccacaccagaggctgcctgctgccaccagccccgtgctgccttggtgtgctctggcagagcgagcatttgctaagtgctggtgtattgatttgcggcggggccgtggctccgcctcctcactctgtccctaagggaagccagtcctcttccctccctcctgttcccctcctgctcctttcctcctcgtctcccttctccctttgcccatcgagggtttctcttggctgactctgcagctccttagcatactggtagcttcgcccacctctctctggacaagctctgtccacttttagggccatggagggaagagcagacctgacctctgacagctgctgtgcttgcatcagagatgccagcagagttcacggggagctaccagcctatgcccagcccccaaggggcctggggtctgggatatgccgcagagaggcctggaacattaccttacctgctttcttaactaccgaggcagccaggatttggagtcaaattcaggctggcctagagaccggccaaggttaggccaaggagccaaacctaaccacagaacccttgagaaagtgggtcatttagtcccctggccattctgagcctctggtcctgagggctgggtcctgagcctctcccttgacttgactgttcaagattgaggactctgatatagagccatagtttttaaaaaaacgacagaggactcattttgcctagaagcttctcttcctgaggcaggcacttgctccaagcagaccatggacaaaacaccgcaaacagccaccttgattaagcaaggagtgtggcccagctggggagcaacttctgagtttccttgtgtggcctgtgtggcctgttgtactgaagagagggagagggggctcagcggggagcctgcttgatggagcccacgcccggcttctgggaggaggctagagacagcactgtgctacacaagaggctgatgcatagctgcagagagccagagggcccggctccgccactgatccagtgggtagggagtggcagcgcccagctgtgcttgcactacagccactgttaagcagtgcttctcagacttggcatgcgcgagagtcaactagagccctggctaacacacagatggctgtgcctcacccccagagcatctgatgcagcaggtctggggtggggactaagaattagcatttttcccaactttctaggtgatgctgatgctgtttctaacctccttgagaatcagaagtcacagatcagttttgcaggaaaatgtctgcatagaagaattttaggctgggcgtggtggctcacacctgtaatcctagcactttgggaggctgaggcaggcagatgattgcctgagctcaggagttcgagaccagcctgggcaacacggtaaaacccctctctactaaaatacaaaaaattagctggacgtggtggcgtgtgcctgtagtcccagctacttgggaggctgaggcagaagaatcgcttgaacccgggaggcagaggttgcagtgagccaagattgcgccactgcactccagtctgggcgacagagtgagactctgtgtacaaaacaaaaacaaaaacaaaaaaaacccagaattttatagacaattgcagaagggttcccagggcacacctatagccatggccttggaccctagggtaataacagccaaggccatgtggagacactatgcagaggagatgcaaagggcagttaagaggatgcctggttagctgtgtttcagggagaaggaagagactgccaagtgaacatgatggagaaatcacagggcccaatgggagagcatgactccgggaggcaggatgcctggtcctggctcagtcttaccatcattgtctgaacagccaggcccacgtgtttatctgtaaggtgaaagtgaggagctggtcgggcgcggtggcttatacctgtaatcccagcactttgggaggctgaggtgggcggatcatctgaggttgggagttcgagaccagcctgaccaacatggagaaaccccgtctctactaaaaatacaaaaattagccgggcatgatggtgggtgcctgtaatcccagctacttgggaggctgaggcaggagaatcgcttgaacccgggaggcggaggttgcagtgagccgagattgcgccactgcactccagcctgggcgacagagtgagactccatctcaaaaaaaaaaaaaaaaaaaaaattgaggagctataccaccttccaggctccttctagctcctaactcctgaggttttaaggcactgcacagtcacaagaccttgaggtttttaaaacctcaactgtaccccagtcagagctgagacatgccagcctggttggaagttacatctagaaactgaatgttgtaaatcagcaggtttcaatgtctggccatatcaggcggggattagcattattgggtgggattaacgatttagatactcctcggggagacaggctctgaagctggaggaaggcagaggccgtcctgtggttgcttggaaggcctctgtgtcccagtcccctgggagcctgagctcgggacacctggagaggaggagtgaggctgtgatcagaccgtcccattccctccttctaggcaggcatggagatgaggggaggcgtcgcatcacctttctctgcagcgctgcaaacccccacgctctgacctgcactgttacctggaactgagggtccctttccaaaacacctgcacaaaagttctccagcccttgacacatatggggaccagcagccactgtttgcttttgtcaagggccactgagagttgtcacccttggagtgggcaggaatgggtcaaaggaaccatttagagggacagtgtgtcagacctagatgctggtcatcgtggtaaaaaaacagtgggcagagaagccagagttcagaagggcgtggctgcacaggccagcctgggcttccgtgactttaaagtgcagcaggaaggacaagtcgatcccacgtgcttagtggtacttgagtgctgcatgcttctgccgacttgttggggagctggcagggatgggggagtggcctgttttgaaggttccagtgagatcaagaatgtcctagagaaacagggcagagaaagataggttgtgattcaggggatctggctggtccccacagaggggacagcgttttttgagcaggtcttgaagggtgtgggaaatagtctttcatacagagagcttcgcagcaagccagcgtgcagtcctgcctgctcggcctgtgttccggaaaccccagtcagtttggaatgggaagtgcagaggggcggtaggggctggaccagtagaggcatccgtgggggccttgaatgcccaactgaggagattggacttcatgttgggtatagctggggccgtggaaggtttcagaggactggagaaacctgagctgatgtggatttgggggagaggattgatgagcctggtggaaagaatcctagcatccctggagtagtcaggcagacatggctgtgaattccaggtctggccagttgcagctgggtgacttaggataaaccatttaatggcccagagcctcagtttcctcagttgtgaaataaagagaatagagcttcctttgtggcaaggcttcccagggcaggcctgttaatgcttggactgatgatcctttgttgttggggctgtcctgtgcaccgcaggatgtcgaggagcatcctggcctccacccagcccctccagcctctttgttgtgacaactgaaagtgtctccagacattgccagtgtctccttgagggggacagaattacccctgggtgagaactgatgctttctggggtgggtcaggggttacacaacagaactaaagcacctggtccagggctggacactgagggtcctgagctgataagcacagtctcagcacaggggagccccatacaccagctcattgtcatcgtccagctgaaatctgtgaggacagaacgaggcactggctggagacatcaaggggatgggctcctcagggcttgctcaccgataggaggaggagcacacagcatcctctctgggtctcgcatccgggtgcccggaagggcggaactctatcccacaggagaggtgctggtttaggatgaagagcgcaggccaggccttcctgagcccacgctgcagtggtcatcagggtcctgttcagagcagcaggaggtgtgtgcccaaacctccagggaggtctctccaaggaacctgcctgggagaggcaggggcgcctctgtctgtcctttggcacctgtgtgtcctgaagccagaaggccaacccacgcaaggccatgcacagggcctggaggagaaaatccagttagaagcaaatgagggcataaaggacaaggaatgcatcctggcagccgagcatccatggcgtctgagggcgttgtacagggaagtcctcctgaagaacctcacgggcactagagctggcagcgatggattttcttccctggccattcttgagagaacaggtcagcaccctaccacccacaggcagtgaggacccaggctgctggagccgaggacgagctccccaacttctggtggcctcctgaggacatgttgtggggtgggtgctggcaggcctgccgtccttggttaggtgaaccagctcagcccgacagccctcagagggaggcaggcatgtgctttggggagccgggggagcagggtgagcgcgctcatctttcctgctgtaggagatggtcttcaggagtgtgagagttctaggtacagctgcacgtatttgctaggtggcacattttggtacctaaaacattttccctaagaagtaacaaaccacccgtcgaacaccccctccctccctcccacaacttcaaaagaggaccaaaaaaaaaaaaaaaaaaaaaaaagagaaacacctgagagaccaaatagaggccttacaccctcacccatcctgtgccctggaggagaggacccaatcctggatcttccaccgggagcgcccgctctcaggagcgagctggcgcggccgcgcaggggagcgtgtgtctgtgtgtgatgtgccttcatgcgtcactctatttatgttgttcgcagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttgtaagtggacgatgaaaccgaaaccacaacgcccagcgtccccggcccgtccaaacagtctccactgcaaaaagaaaagccttccccctccccaccaccaaagccccccaacccagagcaccatggacaagagcagagccgagccccccaaccacagcctccctcccgggcctcagtcgcaccagccagcaccccacgagccccctgcccgctgctcccagccggggcccctggcccaggcccctctggggggcgggagggagagcacagctggggcgcgcaggccaggggtgctggcgggggtgggagggggcggggaggcacagccatgccatcttcatgcctgattgctgtttttttttttttgttttttgtttttgttttttaatttttttgttgtttcgttgttccccccacaccaagaaaatcaaatgtaaccacaaggcgacgccaccaccatcccctttttgccttgcccctcacctccatccctgggcccttgggcctcaaagacgcagcaggccagcccgaccccttccccctcagtctcacatttggtttctcgttgttcctctttttttttcccccccttccatccctctcccgtcccttctccgcaattcctttcccaggttagatgttccaaggacgagggagggctgtgggctttggcttacttcatctctctctctgtctctctttcttttcttttcttttctttttttttcctcttaaaccaatgacaaattttgtcaaagggaaaagaagaaaaatcattcgagaggtcccaggtagacccggcgtgaaggacaggaggatggggcgggtgctgtctgtgggccagggtgggcagctctgggggtgggcaggccacaggccagggcagttcggtggcggtgggaggggtggcccatctcacactgctctccgctcgctttgtctctcctcctttctcgtggtttgagttcttttcccctctccatcctcttcatgccatcttcccatctgcatccaccataagacatgaagtcacagtcattggaggtgggcagggtgggggatgggagctgggctacagggttcgggggccacttctggagagaggtgggcagaatctggtgagcatggagtccctgggtgtgtctggtgcagggcagcggcgggccttccaggtaacctgtgacactccttgcctcctctgggggcatcttcccttctgggggtgcagggcctgttccctccagcagggctccatctggacaacctgagaggaactcagggctgttgagatcattttgtctttgggccccaggatggctgctcccaggcatctgagccctagggctctgccaggctctccagcctcctcctcctctattgccttggtcctggaaccacaggcctgttggacctggtgcatcagtcagaggaggagaatgccataggcctgagccttgccaccccctgggcccaagccaggcagccagctcctaggcccttctctgaccctgccctacctggctcagacctccattgggcaccctttgggttccccaagcctgcctgcctggtccttgggcctgcccagagtggtaagaggtgtagcatctagctaggccacccaggttggagaggtagcctggctgggaaggccttcccgaagcagggtggggccggactgccaaagcctccaccctcccctggccccctctcttcagtacctgagaggggccagtgggaaagcagggttatccactgagggtacctggggaccagggctatccccagccctgcccagtgcctcactagcgggtggaactgggtccaggagacttgtctcagcctccagggcctctccctcatcccagctgtgaaaaaggatgcctggctgagactgtggcttctgagtgggtgtgtgtcgggggtgtagtgtgtgttcctggtcagtgagaggatgagggtgtccctctgtagtggggggcaggctcggagcctggccttcagctcagatgcccctctggcccatccttcccactgccagcctaaactcgggcagcatggtctaactcagtctctccctctctcagcagccccgaggggcagtgcccaggtgggccccaaggcctgacagggtctctccctctctcccctgctccccacagcattcgcaacgacaggcgcctcctctgccaaccggtttgtcagcatcggaccccgggacggcaactttctgaacatcccacagcagtctcaggtaggagaccctgcccaccacctggatgcagggaccaggggagtagtcagggttggggggcatcttggtgttagggaagagcctggagtccttggggctaacagggagagagaggtctgaggtggggctggagggcccaggcttttgcacgcccagctgagcctgtctccccaggcagcccccaggctccctggctaatcagctaattggataattagctctgacagccctggccctggggaaggcggccaaggacccaagtctagaggccctctgggccaggcctggtagaagcaaagatggaagcctgaggcccatcgggaggagaatagagtctgcctcactgctttcacctgccccgactggaagccccggcccctagccctcccctttcccctggcgttgggtgggctgggtgacgggtggaggagggacagagggcctggtgggctgcgtgcccagaactggcactgagggcagggcagggcaggccgccaccctagaggcccctcacccaagtctccaggagtcctgttagggagaaggccagcatgctggagacctcatccttgctcctatcccctgctgacaccacccttagttctcaccaggagacagatccccgtcacaagcagggcataagactactcttagccctccaggtggagaccccagaggccagtgcccacagagcccagtgcccttgggggcacagggaagacccatctcaggaggaggacagaggcagctttagggggcctgaggcttttaccacccagggttttgaaaaagaacatgcaaagatctttcttttgcacattttacaaaaacaccaccttggaggtgtcctcagcccggggaaatccacctctctcaagagcccctggggccacctctcatctcctgctctgcctctgttctggggcctgagtccagagaaagttggtggatggaagttgtgtgtgtggtttgagattgtttttttttttttcttttcctttccttccctcaaaaaaaaaaaaaaaaaaaagccaaaaaactttgtcaaacttcaaacttcagagctccctagtggcaaggaggggaggggaagagaacttcaaccccctccagcttcccaccccctttccccagagtcacgtctgacccgtctggtttccaggagcaaccagacatgatgtaacacccagatgaacttgaacttgggggtgctgagaagaaaaacaatggctccgagcaggggctggagccagccccctctgctctgtgccagggaggccgagagagccctgctggcagaggcgggagggggtgcgagaggaagggacagcaggcgggcctcccctcccagctctgggctggcaccaggcttcagggttccatcgctccctccctcctgctgcctgcctgggctgctcacagctctgcggtcgtgcgctccgaggaccactgccacgagccgtccctgctaaccctgtttccgctgcctcctttactttctttgctcactttgcttggacgtttgggggccaagtcagagtttagggaaagtttgtctccccccatgttccctgtgtcttaggctccaggaggtaggaggaaggagtcccagcgggggtccagggcccctgagcaggcaggtgtgtctgggagtggttgggggagcggaagctggacaagcggagctggagccctcgggcctgggggcaggcaggcggctgcaacgggcgggcgcagggggtacagccgggggtggtttccacagtaaccagtgactttagctgatctctggagcaccagatggagagagaacaatagaatgagggaagaaaagagaattttagcaattttgtcattccctgggcagcgctttttacttagttttaatcaattttggacctggctcaggaagtagggaggggtgagcagagaaagccactctgtgcttggcagcagatcccccatttctgggacctgtggggaggtgccggggagcccccttggggcagcctttgtccctaactccagacctggaaccagagtcttccttccctgaggaggaccccccagtctgagcattggcagttgtccccaactgtacagctcaggagaccccaaaggggccagtgtgaggccctggcatgatctgccaggagcagatagggcaggtggggccctccctgtcctattgtccacaagcctcatttgcctggtgaggagaggggtgggcttaccaccagagtcagcctccccctcaacctcggggcaatggcacagggttcctgtatagtctccccttgggaagggggtcccagggaacaggcccaagcctgtggcaggtgggggtcacccagcccaggcgcttcccacccccgggcctgggccagaagcccaggagctggctgcgggccggttctcccccacccactctggggatgcctcaggcctgggtttccgccttagcctcgccaggccccaatgagcctctgtttggcctgtagtcaattgaccggttggacttggggcaggtgctcgaggagccccactgagggagggcaggtctcttgtgcgtactgtccagcacatacaggaaatttagcatttctgcccacccagcagcgcctgctcattgtggcaatcccaaaccgccacatttccagatgctcttgatctgcactgtccattgtggtagccacgggccacgtgtggctgtttacatttaaattattaactaaagaaaaatttagttcctcagttacagtagccacatttcaagtgcttagaaaccacttgtggctagtggctactgcaatggaaatgagaacatttccattgtcacagaaagtgctagatgatctccaaggccctttctgaaactcagtgtccctatcctcagtcccaaaccagagcctgagagcaggtctggcctgcaggcagaatgtttgaccaaagcaatgttttaaatattggaaattttcacacgaaattctgtttgggcttctggcttcttttgaaaagttggcagatgagctgccctgggccctcaccctgaccctaggcagggcacaggcattctggccaccacagaccctgcttcctcgtgctcgcagcacaggcagcagttaggagcacagcctgcactgccccttacatttgaaccctggctctgttgcccgagggctgtgtggcctcaggcaggtcacgtaccccctctgtgcctagcttcctggtggggtcagggcaggggtggagtgaaccaggacctggtatgtgctctgtagttggctccgcctggcccctgcagaccagagtctgtgacagcctgggagaggtcccaagatgcattttcagggaccctcattttgccccaacggtactaccaggtgcacccaggcccagtagaccacagtagaccctgacccaccactttgccaggaggtggggctggagccttggatggagggcgtagccaagcagcccagacccttggggtctgccctgggtgtgctctgagctgagccaccagacacaggcagacaagacaaggccctgtctgtgggaaggcagcgccccctgctggcgatatgaaggaaatgacgctcaccccagggagcctcaagtccttcctcaatgtctggtgccctgagggtagaggatccagcaccatgggctacgtggcccctcccccaggcctggcgctactagggactgaagctgtgtggttcccctgcccccagtctttcagcctgtgggaccttggctggggtatatagatgggaatttctgcttttaatccaaagagacagaaagaaaactcagcaagaagctgggccacccccaacccattcctaaaacccctctgggtacaaaagccccagcctggcatcttccccaccctccaggacccacacaaaaacctaaacaattggaaacatggccagatctcaggcctgtgccagcgccagccatgggggtcccacccgctgggcacagtgcccacgggaaggccagctggactctagcactaggggcagagtctctgagggggcggggttctcgcaggagggagggagagaatggggatgccctttcttctccatgggaacaaggtgggtggtggctgcccggcaccctggctctttgggagctggacccttgaggggccaggtcactgggccaggtaggagtgagatgggacctgccccagctgttctcagtatcgcctctttttcatcctgtttcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaaccccaccctccacacagccggagctgccctagggagcctggagggccagcttgtaaagatgatggggtttagatccctcaggctctcccctccagactccgcccttccctccctccctccctccctccctctctgccaaggctccagcttcttcccccagctgctcccgaccaggagggggagagcagcctccacttaccccaccccacccttgggctaaaagcccccaggcgggcagggggtgacccctggagctagttgcgtgtcccagaatggagggtgttctgacaccccaccctgagccgcaagagcagtcctggggccctggacccctctgtacagtccgtaggaaaaagtcggaatgctctcgacggcctcgtcccagcctgggacaggccccctttcccctctctctgcaggccaggagggcctccttcctgccacgagggaggggagtcgggccccaggtcgcccccgcccccagccctgcatgcaggtgccctcgctccgccccatcagttcctgcccctgcccctcatgcagactgccctgctggggccgggccggagggtggagcagaaaggggaccccggagccgagcgaggaggaccaggcagccgccgctgccgcgctaagccaccacctgcgcttaggtaggcgtcctgctcgccgactttcagttccttgggagggtgttgggtgtcgtccttttcaaaagtgttttggagctttctgtgccccccgactttcccccgcctccccgccccccacgtggccacttttctctggattttagctgtaatgtctttactctttatttaggggtggggcattcattgtttgggtcttttgctgttggaatgggaactcctcctccatttgagcaacttgggaacaatttggtaacacaccacaggaagtagctctcccccccagccccctcctccctcaagggagggttggggggcctgtccagagggtcttcagaagcccccctgggagggaggggaggatgagcacgcccagctcccctccagggtgtgacttggcccctctggcttgtctttctgtgccttactcctcctcctgcgtctcccgttcctggccccttcttgagtccttgtgcctctctctttctctctctttcttaattgtatgaaaacacaaagcacaggtcaggatcctctgagagaaaatcaacattgcaccacgtaggggtgggctatgggctgtatttattgtgaatctagtttgtgaggctgtggccccgagctggcggagggagggaagaggagggagtgacgggaggggaggaggtcagcgacctggggccgtagcggcaggcgaacggtgcctgctacccagctggaagccacaaggtggctggctccaggggcggcttttgttggaagttgagtgaagccctccccctgtcctcagcgtgcagccctagaggaccccagggctgaggggcagtggatcctgcgggagtctcccggggcgtggggagtaaggccccgggggtggggggccgggtgggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtggg

SEQ ID NO: 15370 - DNA, 9779 bp, Human
gcggggttaggttgggagctggaaacccagcaatgcagagacagagcagatagaaaatctccgccctaccctccgctacgcgccgtctctccaagaaatactaattccacttcctccaaaaataggatgcagaattgttcgaatggctccattcattcctggtgcgggccctttaaggggtggtgcgccccccgccccctttccgcccgcactggctcgcggcgccttcccgccaccagcgcccgctgacttccacaactaaatttggacggagtgacgtagggcagtcgcgcgggccgcttccggttgcccatattaggacagggcccgtgatcgccttagcggccggcggcggggcttccggggggggggcgcggaggggcggggctttgcgctccggccacgcccctccccatccccgacccgggcagccggagcaggctggagccccaggcttcctgactcgcattccagccgggtgggggaagaggagagtttcacttccttccctccaggggccaggaaggcgtgacgccaggaaagcaccccgcagcgggtaggggcgacctgagggctcccagggacgccatctcccagagacgctgcagaacgaccctgcatacacaggagacgacccgctgaggcccccttcatcccatctctccccttcccaattatttcccccatacaaggccccctcccaggttattcctgacccctgccccacactgatcttctcaggccttgggacaccctcccgtcccgcccttcccccgcacgctgggaactcaaaagttattcccccctaaaatacccttcccaaactcgtccccattcaacgatggtgccagactgcgacgacctgccgaagacgcaggccgtccccaccccgctaaccttaccacggagaccccacaatgatttccccagcccaggcgctatctctgagaccccacgcagcaactctgacgcgcaagggggcgaccctccgaggactccctcagataacccgcccaccctccaggggagaccaggccccctatcactcaaaaaaagtgctttcccgaagctccccaacacacagcgccactgtcacacatagggacgaccctgagtccctccgctgatattcctggcccctacccagacggagaccccacacacagagggcccccctggagaccatcctcaaagccaccacccgctacccccaggctcgcacccagaaagactccgcgcttctgaagaaacccacctccacgcactttctcaaaggtgacctccccccgctgctggcatatctgggaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgagggtgagtgacaacgacgggggagggcggagggtgctctgtacccaagccagccagtgcccgggtgccggccccagcgtgcccggcgggctgggcaaggccgtcggggtgcagagtgggaggcgcacgcaggggtatataggggtctccggagtcccccatgcgtttgggtttgcagtcgggggcagaggcaggcgggaggaccgcctgcccccagccgcgcccgccgtgcccctgcccgcagcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcgatatcctggggctttgtggcagagggtggcatgggagagcccattgcggtggcagcccaccttcgggtagggctggacccctagggacggggatgatatctggctccggccttgacccttgactctcagcccacgtatagtggaagccaacccaggcaagttcaagctcccagccggggacctgcaggagagaaaggtgttcgtggagcggatgcgagaggcagtccaggtcaggaaaggtcctgcaggcggggagtgggggaaggtttgagtgtgtttttttttctttctttctttctttctttttttttttttttttgagacagagcctcgctctgtcgcccaggctggagtacagtgttgcaatctcggctcactgcaacctccgcctcccaggctcaagcgattcttgtgtctcagtctcctgagtagctgggactacaggtgcctgccacgatacccggctaagttttgtgtttttagtagagacggggtttcaccatgttgatcaggctggtctcgaactcctgacctcaggtgatccacccggcttggtctctcaaagtgctaggattacaggcgtgagccaccgcgcccagcctgagtgtctttcctccctaatgctgtccttacctccaggaaatgaaggaccatatggtcagcccaacagccgtagcatttttggagaggaataacagagaggtaagccttcctgacccaccctgcccacctgagcccctgggggtaaccaagccagatccctctgtgcgtgttcacctgtcccttttgcgacagtgcccgtcctctctgtgggcagttatcttcttgctgtctacctgcctgcactttctcggtgtgtgcacctgaacctctctatgtgtatatgtccgtgggttcctctctactgtgtcctctgggtctatactggtttcctgttgcaggagagggctgggggcctgtgtacctatctcctttctgcttccatgccatttgtcctgtgtgcacctgtttccaggacgcatgcctgccttttactcttttttttttctttgagacagagtcttgttctgttgcccaggctggagtgcagtggcttgatctcagctcactgcaacctctgcctcctgggttcaagcgattctcctgcctcagcctcccaagtagctgggattacaggtgctcgtcaccatgccagggtaacttctgtatttttttttttttttttttgagatggagtttcactcttgttgcccaggctggagtgcaatggtgcaatctcggctcaccgcaatctccgcctcctgggttcaaacaattctcctgcctcagcctcccgagtagctgggattataggcatacgccaccatgcctggctaattttgtatttttagtagagacggggtttctccatgttggtcaggctgatcttgaactcccaacctcaggtgatccacctgcctcagcctcccaaagtgctggaattacaggcatgagccactgcgcctggcctaatttttgtatttttaatagggttttgtcatgttggtcagtctggtctcaaacccctcacatcaactgatctgcctgcctcagccttccaaagtgctgggattacaggcgtgagccatcgcacataacttcctttttttttttttttttttttttttgagatgcagtctcactctgttgccaggctggagtgcagtggcgcagtctcggctcactgcaacctccgcctcctgggctcaacgattctccagcctcagcctcctgagtagctgtaatacaggcacatgccaccacacccggctaatttttttttttttttttttttttgagacggagtgttgctctgtcgcccaggctggagtgcagtgacgtgatctcggctcactgcagcctccgcctcccgggttcaagcaattctgtctcagcctcccgagtagctgggattacaggcacccaccaccatgcgtggctaaattttgtatttctagtagagacggggcttcaacatcttggccaggctggtcttgaactcttgacctcgtgatccacctgcctcggcctcccaaagtgctgggattacaggtgtgagccaccacgcccggccaatttttgtatttttagtagagacggagtttcatcatgttggccaggatggtcttgatctcctgaccttgtgatccactagcttcagcctcccaaaatgctgagattacaggcgtgagccaccgcgcccggccagcttccttttttttttttgagatggagtcttggcatgttgcccaggctggggtgcagtggtgcaatcttgactcactgaaacctccaccttccgggttcaagcaattctcctgcctcagcctcctgggtagctgggacaacaggagtgtgccaccatgcccagctaatttttgtgtttttagtagagacagggtttccccatgttggccaggctggtctcaaactccctacctcaggtgatccgcccccgccttttcatctgtgcatgcacctaacctatttgggtgcgtgcacttggcctctgagtgtatctgcattttcccccctcatatcctaatatctgctagtttcctctgtaatgtgcctgccgtgtgtgtgtgtgtgtgtgtgtgtgtgtgtgtgtgtgtgtgtgtgtttctgtgtttctcccaaccacctctgtcagtccactttttctcttggtgttctctgttgatatttttcatatgttgagaaccaccagcctttctctctccctcataagcgtacgtggggtcggggagggtgggggactgaggctcctcccagtttgtcatcccatagcagtgcccacgtgccttccagatgtgctgccttgggggaattcaagtccaaactctaaaatacatctgttggagccgggcacggtggctcacacctaaaatctcagcactttgggaggcccaggcaagtggatcacctgaggtcaggagttcgagaccagcctggccaacatgatgaaaccctgtctctacaaaaaatacaaaaattagccaggcgtggtggtgatcacctgtaatctcagatacttgggaagctgaggcaggagaattgcttgaacccgggaggtggaggttgcagtgaggcgagatcacaccactgcactccagcctaggtgacagagcaagactctgtctcagacaaacaaacaaacatctgttgggccaggcatggtagctcacgcctgtaatcccagcactttgggaggctgaggcaggtggatcacttgaggtcaggagttcgagaccagcctggccaacatggggaaaccctatcactagtaaaaatacaaaaattagctggatgtggtggcaggtgcctgtaatcccagctaaaatccccccaaaaataaacaaatagtaaaatgtgacatttactagcattactatgtgttgggcactgctgtaagtgtcccccatcaattaattctttaaatcctcatttcaacccaggaaacacggattctagctcttcccattttattttattttttttttttttgaggcaaggtcactctgacacccaggctggaaatgcagtggtgcgatctcagctcactgcaaccaccgccccccaggttcaagcgattctgctgccttagcctcacaagtagctgggattacaggcatgcactgccacacccggtaatttttttttttttttttttttttgagagaaggtcttaacctgtcacccaggctggagtgcagtggtgtgatctcggctcactgcaacctcagcctcccaggttcaagtgattctgacctgcctcagcctccctagtagctgggattacaggcacccgccaccaagcctggctaatttttgtatttttagtagagacgggatttcaccatgttggccaggctgctctcaaactcttgacctcgtgatccatctacctcggcctcccaaagtgctgggattacaggtgtgagccactgtgcccggcccaatttttgtatttttagtagagatggggtttcaccatgttggccaggctggtctcgagctcctgacctcaagttatctgcccacctccacctcccagagtgctgggattacaagcatgagctaccatgccccatcctgctctctgcattttacagatgaggaaactgaggcacaaggaagccaaatgatggggtctctgggtcaccttgctagtaagtggtgagtggggaatgcaggctgtcctgccccagagtctgcccccctgacttaccaccgtggggatttgccccacaggccccgctgtgagttggggtctctccctgagcctatgttgtgtgcccctgcagatactcgcaggcaagccagctgcccagaagtcacccagcgacctgctggatgccagcgcagtctcggccacatctcgctacatcgaggagcagcaggccacacagcaggttttggggccagcggggtggatcttgggaggggagagccttgcagactgatctgaggtctggggtccctttttgttgttgttgttgttgatatggagtttcgctttgtcgcccaggctggagtgcagtggcgcgatctcagctcactgcaacctccgcctcccaggttccagtgattctcctgcctcagcctccctagtagctgggattacaggcgcccaccacaatgcctggccaatttttatatttttagtagagatggggtttcaccatgttggccaggctggtctcgaactcctggcctcaagtgatccgcctgtctcggcctcccagagtgctgggattacagtcataagccatagcgcctggccttctggggtcgttttcaacagcatctcccaccccttcgctctgcagctgatcatggatgaacaggatcaacagctggagatggtgtctgggagcatccaggttctgaagcacatgtccggccgcgttggagaagagctggacgagcagggcatgtgaggccaggaccctgggggtgggccaggggctctcggccgccctggtgtgtctgggccatctggggctgatgccatcctgttcttggcagcatgctggatgccttcgcccaagagatggaccacacccagtcccgcatggacggggtcctcaggaagttggccaaagtatcccacatgacgagtggtgagtcccctcaggggaggggtcagtcctggtgggggcaggttgtaggtggtaccctctccccgtgacccctgaccttctcgttcccagaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttatatgtatttgtgtcgtgtggtgtgtgttgactgcaaatgcgtgaccgagccctgattgggactcccattctaagccactgcttgcacaagtgctccagtgtgtgtgtgcacatgtgcgtgttccggatttctttttttttttttgagacagagtttcactcttgtcacccaggctggagtacagtggtgcaatctctgctcactgcaacctccacctcctggtttccagcaattctgcctcagcctcccaagtagctgggattacaggtgtgtgtcaccacacccagctaatttttgtatttttagtacagatgggattcctcatgttggccaggttggtctcaaactcctgacctcaagtgatttgcctgcctcagcctcccaaagtgctgggattacaggcgggagccaccgcacccatgcgagtcttttttttaatggtttaggttctcttgatctttttatttttatttatatttttttgagacagagtctcgctctgtcgcccaggctggagtgcaatggcgtgatctcggctcactgcaacctctgcttcctgggttgaagcggttctcatgcctcagcctcctgaatagctgtgattacaggaatgctccaccacacccaactaattttttatttgtagtagagatgtggttttgccatgttggccgggctggtcttgaatttgaactcctgacctcaaatgatccgcctatttcagcctcccaaagtgctgggattacaggcatgagtcactgtgcctggcctattttgggtttgtttgtttgagacagggtctctctcactctgtctcccaggttggagtgcagtggcataatgatggctcactgcagcctggaactcctgggctcaaggcagccttccacctcagtctcccaagtagctgggaccacaggcacatgccacctcgcctggctatttcatttttgtagagacagggtctccctatattgcccaggctggtctcaaactcctgggctccactgatcctcctctctcagccttccaaagtaatggaattacaggtgtgagccatcatgactggcttctatgttattatttatttattttgagatagagtcttgctctatcacccaggctggagtgcagtgacgcaatctcgtctcactgcaacctccacctcccgcattcaagtgattttcctgtctcagcctcctgagtagctgggattacaggcacccgccaccacacccagataatttttgtatttttaatagagacgtggttttgccatgttggccaggctggtcttgaactcctgatctcaggtgatccacctgcctcggcctcccaaaatgctgggattacaggcatgagccaccgtgcccagcccagttactttaatcttgtgttatctttgagtctatggggacccacggtgcatccatggtttttcctacttgatagaaccatttgtcctttcatattcttgggaccctcttgttcacccagatatttccaatatcggttaaattttgtgatctcgttttttttttttttttttgagactaagttttgctcgtcacctaggctggagtgcaatggtgcgatcttggctcactgcaacctccgccttccaggttcaagcaattctcctgcctcagcctcct

SEQ ID NO: 15371 - DNA, 304533 bp, Human
  misc_feature (1)...(304533): n = A,T,C or G
tggcctcaagcaatcctcatgctctgcctcccaaagtgctgggattacaggtgcagacaccgtgccctgccagatgaatcttaaagacataatgttgaaccgaagaaacaagaaactgtagaatatatactatatgattattccatttatataaaagcccaaaagaagcaaagtaaaattgtattggttaggaatgcataataaggtagtcaaactttttttaaaaaagcaagatatgaataccataaagtcaggtagcgattattgctggaataaggggctgtgtaagcgtgttggcaaagggggttctgcagaggtggtgatgttccatttctagccctagacttgatttcatgagtgttcatttcagaccaatttcttaactccgtacctttatgttttatgcatttttctttgtgcttattgaatttcaccacacaaaaagcagaatgggaagtaatcaaagtggttctggagagacgtgagtatcaagcaaactataccacccagaacccctatccagccaactaggacctggttaattatttcctcctgggagttcagacttgtcacctctggggtctccaaggtagaataaacctttaattccaacttgcaggagtccttgtgatttgaaacgttcacagaagtaaccccaaaccactctctccactttcaaaaatggtcttttgctaaacagagcaaatttgtttagagactgacgaatcgcacctctagacacaaatccccttctcttttctgtcttttaagtttttttcctgcctccatcctgccttctccttgcaagatgctggggagcgtccggctgtctgcaaccgaaatggaacggggtggaaaacaggctttcctcccaggggaggaggaagcaccccaattcccccctccctgcctcccaaccatgcgacgctcccctctctcccccacaaactccgctgagcccggtacccccgcgcctccacgagcctccacgattggtcgcgggccctcatgtgtcgacactctgggtgggtccttctactgttaaactcatcaattgctccccttttccgtttgctggccagtggttcagacctttgcgcccatttttttttcctctttaccttcttctacccgcaaccctccacaccagtcttattttagcaaaacctagagaaggaggaggtggagggatttggagggtggagaggcattgccgcatccaggggcagctattgagtggctaagcggagggcgcatacctctctctctctctcttttccccctgttgggaattttcaggatttcactgctgcaatttaaccccaagatgaggcaccattgagcgaaacgctgtgcgcacatacacactcacacttcctccgggagcagaagaggcagccgttggtgattcaggaagaaaaaaaatttttttttttttttttaaacctggaccctgcggtgtgaagactccttaggaaccctctggagcgtcttactccccttccctcctctttcccttccctttcatcttctttgtttttattttattttatttttggagctacagatctttcagcatttttaaggtctaggaactccagcaaaacagaagggcacttaattttttttttttttttttgccctccccacccagacctgggtttcgtctttctttatttttaaatatatatatatttttttattttttattttttatttttttttaatgggccgagcgcactccttttgcaagatgccagcctgacccggacctcggaggaatttgaagcttccactgcgtcccggggggggcgtcctttgcaaaccgttcgcgtcttaaagggggtgtgcgttgggtggattttttttttttaactgtctctttttttttttttccggagtgggtggactggggattgcctggattccttcctcggttattttttgcctcgcttctctctcccctcccccctcctccccgggcccccgcgccccgcccccgcaccctcctcccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggccatatccttttgcccgaaccccagcagcagctgcgcctccccctcctccctccgcctcccctcttccaggctgggagagagacccgggggttgatgggaggtggggaggaggggggtcttccaggggctgggagagggggcaccgggaggagtgtgaaagaatctctccaccccgagctgggttgagctaccctggaggcttgggaatgggtttgtggggggctggggggtgggcagcggagagtggatccttcccaaggaccgactctagaatgagatctggggcctggggtcgtgcaggagccttggtgggggctttcgagccaagtccggagggtttggagttctacggagtgagcttggagcgggctcgggcctgggcgcttctggccagggcaggggaactatgggggccttggttgggttttcttggccgtcgctcactggagtccacgcaggggaagctggacagcctctccactactgctttccccaaggtggggggccgccgcacttttagggcagggcgcttgggggctcccagggctaagagcaagagggagtccatgtggccttcacactgagaagccagcactggccgaagtgagtaccccagggtgggccgctgttcctatctggagaggatagtgatgggctggggggcgcttatgtttccctcatgtgtgtaggtcccattgcctttaaccgctgattggggaacctcatcatctttgggggtgtcgagaaagagatcccacttgctttatctgggcccctggcctgggaagacctgatctggacactttcagtaagaaagacagggcaacagcaaatgaggtggtgggtccattttagagcaccatgtccagcttttcctaccccgagtagccgagagggaacaccaggagaatcagcacccatgtggacatcttaggtaggtaaatgccttttaaatttttttttttttaatcaaagatccagaggaaaaaggtgaagcccacattttcttctgtggagatgctatcaaaatgcagatcttctgtgtttctttaaatccctgcctgcttgaaataaaccttgaggagggcttaacatctatcgagatgtaggcaggcaagggtgggtaattagtcgggctttctagcagttatctaagcatgacccagattccaggaggggggacacaccctgctgcccaggctggctggccactgtgccatgcccagatgtgccgcttctccgcacagttccaaccagctgccctctgtgtaaaaatgaacgggctggatgggtccctggggctcagcgatgagtcccctatcccttttgtatgtggttttgcagttatagactaaacggggctgggccctgtgtggtctccgggggttgctgtttgaggagcatggcgggtggtagagggactcacttcaggggggttcagaatcgagcctggctcttggatcctgggtgctgggattgcaacagagggcactgaggttttggagtgtgtgagtggtctactttgagggtggggaaaattaagaagttcagcagaggtgcttttgaggggagcatacctctaactacgatgccatctccgttggtgcccaaagcaggtgccaggtctttgcttcctaagtttcagactcttaaagaggctggttcttaaggttagcaattcctcaccatcccaggcccattgaagtgctcaggggtggcttgattactctgcctatcaacagagtgaggagtgggagtgccttgcaggaggacagggtattcatgggtgcacacccagttagctccaggagtgagagggctttgctcggctgacaggtttcctcattgaaaatggctttagatcgccttctggagcctggatttggagacttctaagaggaaaggaaggaggtggggagcccttctgctgtgtccttagcttacctctgtccagcctgaatcctgcagattggagggctgttgggggagagggggattgcagtggcccctcggaagggggaatcgtgggagagggaggcaggtgaattgcgagtgttgcttgccacttcatctattctctggccagctcgcccggggctttcttgctcttatgatgagtttgtgcattatgctctctgcagactgtttttgttctctttggcccgaggtaacaaacacattatacagccctactctggaagggaaaactccccacctcacaatctgtcatcgagctgggtcatccaggactgagctttctctgtcctggatggagcggagggcggtggcggggtgggtgggagggttggagatgagaggggatggacagagacctggggagggaggtagtgaataaaagaattcaggccagtgtaaagagaaagacacgtggaatgtcagagtcacgataccagggcagaacattctactttttaatctaaatatttctgccattaaaaaaaaatgtttaagcatatcctgagagtgaaaaaaaaagtgtgtaggtacttaaataaagtctaatatatgtacaggcaagtacatatattcagatgcatagatttttacaaaatgaacacacccacgtatccagcacccaggtcccgatcagtgccctggaagtccccctccccataccgcctcctagttgctcccccaacaagggtaccgctcacctgacttctaaggttcattttgcctcttttaaacatgtaaatggagtcacacagtacgttcttttgccactggcttcttttgctcacttctgtgtatgtgactctaatacaatctatccattctactgttgatgggcatttgtgtcatttctgtttgtgccactgggaacattcttgtgtcttctattatttttttcccacagttctcttagataggagtggaatcgcccctgctactttttgatgcatgtgtcgtgggatgtgtatttggaaatggtgttgactaagggttgcaggtcgatatggaaagcaggttcctccctgtcttgtttaagagaagtgagtgaatgatccatgaacttgtcggtatgctcacagggcctaagagtgctacttccaaatgtaaattccggcatggtacactggtgaaggatgcagtcttgctttctccacactcggggcaatttgtcactatgatttcttcctctttcatccctcagtgggtcaaacttgaagccatcaatgacaattaagaatcctcatttatttcattttttcccctcttcctaagtgaggaaacccaaatggaagtctttgatgttcaaatttacattgccgtgtttttctcatgccaggcagcaagccgtcttgaccacacaccttggtttcatgttttcattgactggaattgtgattcaaatagggccataagggtctctgatgattgccgaagagctcagatctgtcagctcaaaaaggagcatctgtcagccttcctagagttccctccccacttaatgccactcactccttctaccaagtgccaaggtgaatgtcatctttccagccctccctgtgccaccaggtctcccactgaacatgatgtagaaactcaggccatcggaggaacactggaagcaggtctgtgtattatcacgcacagtcgcctgaattacacgtagaattccagcttttcatccggtttgcagaaatcttaacaagacacctaaagtcacattgacatcaggtgacatcactttgacatctgtggacattggctgattggcactcctctcatttttttttttttttttttaagaaaagctctctaaagagaaactttctgcatgagaagcgctgggagacatgggagcaggttatcagactcttggcctgtcctgagagatagaatgttctagaaggtactgccgtagagggcaggatggtgtcacttacgtgatccttgtactagaccggcttggctggtatttccagaggagcaaaattctgcgaagtaaaatttagcacggcttttccaatgggagtattttcaaaaagggtgcaatttcttatccacaattccccaatccaaaaagctccaaaaaccaaaagacgagctcatatagaggtaaaacctaacctgaactgacttcagtttgaagtcttaatttacagttttcattcattctacttggtgtgcatttgagtatgttttgcagcagaaatgttagatgtgcttgatgatgaggtgctgcttcagctcctgactgttaggtctgcattgtagtcctgtcaaactttcaggtgtatggaagttgtcttgttaacaggatggttctggtccagcaggatttgggtggggtctgggattctgcttttctagctagcttctagggattccccatgtggtaagttcatgggctagggttggagtatccaggttagatcatagagacatcttgttatcatttttcttttccttaaaaatcaggtttataggggccgggtctggtggttcacgcctataatcccagcactttgggaggctgaggccggtggatcatgaggtcaggagttcgagaccagcctggccaacatggtgaaaccccgtctctactaaaaatacaaaaattagccaggcgtggtattgtgcgtctataatcccagctactcgggaggctggcaggagaatcatttgaacctgggaggcagaggttgcagtgagccgagattgcaccactgtacttttttttgagactctgtctcaaaaaaaaaaatagatttattgatgtataatttatttgtagcaaaattcacccttttgacatactggtctgcaagctttgacaaatggatgtagttgtggccaccacccaaatcaagatatgggacagtttcatcaaccctaaaatacccccacagtgcccctcttgagtcagcaccccacttctccagccccttcaaccactgatctgttctccatccctacagctttgccttttgccgaaggtcatataaatataatttcacagtatatagccttttgaatgtggattcttttactcagattttgagattcattcatgctgttgcctgtgacagtagcgccttcctttttggtgttgagcaggattccatgatatggatggaccagagtttgcttcccagccgaaggacattgggatgcttccagtttcaatgattatgaatagagctgctataaacattggcttatgggttttagtgggaacatttcatttcatacatttcatttctcttgggtaaattaacccaggagtgagattgctgagttgtgtggtaggtgtatgtttaattttataagaggctctcaaactgttttcctaagtggttgtaccattttacattcccatctttgcaatgcgtctaaaagccctgagttctgaattccaaagcacgtctggcctcgatggcttaggattaaggatgtggatctatggaaaggagtggaagtaatagtgttaaatcccggtcagagaaataagaaagattaaggatgtcattcaaagctatgtgcctgcactagagagagagaaagaaggggttctcttgggtggggttccacccctccctggtagttctaccattccccaggaaaaagtcaagctctgaggctgtgagacccatgatctttaccctgttcctcaccactgcaaccccagtgtgtgggacaaagcaggcgtcctataaacgtttgctgagcaaatgagaaaaggtacctgtcttcacccattaactaaattgtataacatctatctgatctacccttgtgccaacgttttaggattttgatgggttttagttgcagggggttgagagactgtccatgagattatcagaccaatgaaagtttctgaaatgttagtgcttgagtagattggatgcagcggccccttgagaatgaagtctttcttcagggacttggagtgggaggcatctgttgggtgcgtagggcttatgcttccccctccctgtttcccccccagtagcaagcacacatatacactttctcagcaataaaaagcaccgccgggaaggtggactccatccagaaatgatcagagcctaagagccgtgcagtaacgcatttccgagaatgccagctcagctcctgagaaaagggccggatgggatggtgcctgctctgaaagagggcagagaggagagggaaaacactccggactctgggtcagactggcccaggttcacattattcaccagccatgttatcttgggcaccagagcctatttcttgacatgcatgatgaggatattccttctagtagcatctcccttggagggctctcaggagattaaatggggtcgtgcgtgaaaaatggccagcacagtctccagcacagagaaaaaccccaaaacgccagagccgtaataccatggagtcatttaggttccagtgttctttttttggaaaccggccagaaaagaggctttctgggtgggaatgggagcgaagtgcccccccccccccaccccctgcgactggtcagtgtggattgattaacctgatcgtggcgctctttaaagccacctttggacattttgcattctccgttctctctggaagctttcaggggaaaaaaaattcgtggccacttgacccatttttctattcccttgggtctaaggtaaaaattaattctctttcctcctttggtccctccctctctctgtgggtgacaaggtgagggagttttaaagtatataattagcttccctcttccccttttgcacgccctgtctcttcctttggggccggtcgagagtgcagcccaggatggccaccccaggtgtccactgcaaactccacagaaaaactttgctcaacttttggtttagaatttaggtacccccctccccttccaaactttggtcttctttctcctcactccctaaaaaaataggaaaaacaaggaacattcctggcgagggaaccatgagtgggcacagcaacttaggtttcaaaaaccactgggcctcagttcttatctgagtagggtgacccttcagccagggttgcctgggactatcctgggtttagcatctctggaaactcacagtcctgggcaaactgggacgctggtcaccctaatggtgagttcttaacacctgagagagaagaatggtgcaagagatggtgccgttgaccaagaaagggggagagtcagttacttattccctctgaaaagccaagactttttattggaatgaatgcagcttttagaagccgtctttaaggcagctaatacaagagagattccagctatgaagggaaatgcctgagttaagtccggatcaagttttgacatctcgcttcggtcagacacggctttatctgccgttcagactgggagcagccgtgagtcttccttaaaggtgcctgttgctcaggcggcacctgcagttagaaattagcagcctcccacccccagcccccaaataacaggattcaagagtcccctctctgaagccatgagggaaacccaacttagtcacccacttgccagtaaataatattcatgctgttaagttctgttctcattttaggcctatgtgtaaaaaatatatgtaattttaaactgatttttaaagtattttcatacgaacagcatttgcaggagggcgaagtctggatgttacctttttgtaaaagtggatggatttgtcttcaatgagactctggggcagacttaaaacttggcccgcagtggtgttacatggattctgatcttccagagtctgtcacgttcttttatctccatgatctttattatcttctttattgagaatgatgggcatggtgtgtgtgggtgggagggctatgctgaccatcactgcagtgaaatgtgttcgtggcatgttgtggcgtctgcataggaatgtgtctgtttgattaacagcacaagcagtggaggctgtaaggaggaaaagaggagggaaggtgatattggatggaggggagacatatagagcttgggaacagtccaccctggctgcaaatctcagctccagctcacagttgtggagcctcagtcttctcctctgtaaaacggggacagtagtcctatgtccgaggaattgtaagaaggttaaaagatactgtacccagaaagcacatggcatatataatcatcctgtgaagtagccaactcaatgaattttattttatttattttgagtcagagtctcactctgtcacccaggctggagtgcagtggcatgatcatggctcactatagcctcgacctcctaggctcaagcgatcctcctgccttagcctcccgagaagctgggactataggcatgcaccaccgtacccagctttaacaacataaatttatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatgtatatatatatatatatatatatatatatggggagagagatatatatatatatatatatatatatatatatatatatatatatatatatatatatatatatagatatatatatatatatatatatatatatatatatatatatatatatatatatatatatatatatatatatatatatatgggtatatnnnnnnnnnnnnnnnnnnnngcccgccttccttatttccccccccttttttgtggatttgggcgataaattttccccagaaacactttccccctttttatattttgtcggtcccccggagcctttatattctcccaccccccgatgtgggccgccatctttctcctcttttatatggggacagaagtccctttctcgagatatttatagagatatatagatatttttcccatatacacaccgcaatatatatctccctgtgtagaggcccacacaaagaaatttatatatatatatttagagagagacacacactgtcacccacgctgatgtgcagaggcatatacatgtctctctatagccacgcccccctaggtataaacgaacccccctctttatctccccaaaaagatgggtatatatgcatgcacccccctacccatatttatcaacaaaaatttatatatatatatatatatatatatatatatatatatatatatatatatatatatatattttttttttttttttttttttttttttttttttgagatggagtttcattcttgttgcccaggctggagtgcaatggcgcgatctcggctcactgcaacctccgcctcccgggttcaagcaggacgatgggcatttgggatgtttctagtttggggtgggggattgtttgtttgtttgctgttatgaacaatgctgctgtaaggaatcaataattttgaatgaatgaattcgaggtgttaattttagtctgtgtacttggaaatctagcttcacctagaatcagctgagattcatcagcatttatggcaggagctaagacatttcacagcttactcatcattttctctaagaggctgggtcaaccggttagctcttggtcctgcttgtattctgagagtcagaacctgtggtttagacactggcaattgatatggttgtagagaagcagcatggttgagttgagagcatggattctggagctaggtggctggggttcaaatcccagctctactagtcactggctgcgtgatcttgggcaagtcacttaagtgttctgtgcttcagtttcccagtctgtcccagtggtgattctaatagctccatggggatcctaatagctcctatctgggaggattaaatgagttaatacatctgatgtttagagtggtgcctgacacttaggaagcactatatgtgtttatacatggaagagtggatagatggatggacttatgtgggtggccatatttgggcttctctgatccactgctgagaatagtgtgtggcacacagtaggtgctgcataagtgttaatattctgctctttcttgccaagtctctcaactcccttgatctctgttatttttggcgtctgtgttgttaacccattcttctgaatgatcagctgaatcactgttgctccaatatataagccaaggagaacacaatcacaaggtctcattgattgtccatactagaattccatgattcctaggcccaagtaggattttccccacgtctcagcaatccttcttccatgtttctaatctttttctctcatttgttatgccccattgccagactctccaatctccccacagcttccccttcctctaactatactgtctctagtcttaccttctccctaagggcaccgtctttgaagacatcaaatacttcagagcaccaaatataggttagcttctctgagggccttacaaggacatggagtgtttgggtcttacacaaattggaatggtcagaaatgtttagagacttgagttgtctttgaaagagttgtcagaatgcaaatttttgacttgtggcctgtttctgatcacaacgcagtcttttaagttatggatcatagctggatgtttgtggtttagaggggatggaggcatcctctgcagttagtgttggatggctgggtggatggatggatggatggatggatggatggatggatggatggttgaacagatgcatggatgagtggatggatggatggatgggatgaaggaaggaaggaaggatgggtgattggagggtaggtgggtggataagtagattggtagatgactcgatgggtgggtggacaaatggatgggtgaatggatgactggatggatgactggatggattggtgtatgagtgaatatatggctggatgaataaataggcagatgactagactggattgaggggtaaaaatatggatgactggatgggtggatgagtggatgatagatggttgaatgggtgggtggatgggtggatgttggatataagggtgtatggtagggtagctgtctatgtgtgggtctccctgatatttggtgttctgtttgacttgggaatgaccaagtctctccgcttaccaccttatttgtaccttttccagtatcaagtgaattttgcacacttttgtaaaaatcaataagattgtatgtttaggactttgggaggccgaggcaggcagatcacaaggtcaggagatagagaccatcctggctaacagggtgaagccccatctctactaaaaatacaaaaaattagccaggcgtggtggcgggcacctgtagtcccagctacctgggaggctgaggcaggagaatggcatgaacccgggaggtggagcttgcagtgagccaagatcatgccactgcactccagcttgggcgacagaacgagactccatctcaaaaaaaataaataaataaatattatatgcttaggttttacctatgtaattagaaagctccttgagggtaggggacagtgatttgccttcctcacatccccccaaagttcctgcactatatcatgcataagtatttaattgagtaatggtgaggaaagtaaacagtgttattgaacaaagattattaaaattctggaaacacctggttttgtttcagcactgggactgaaagtggaattccttggattttgctccattggtggataggatagcatgtggtggtggactggtagactctttctcttccaagcagattgggtaaatgccccagattcttacccactagtcagagattacagattactgattgatatggtttttctctgtgtccccacccaaatctcatctcaaattgtaatacccacatgtcatgggagggacctggtgaaggtgactggatcatgggggtgatttcccccatgctgttcttgtgatagtgagttctcatgagatctgatggttttaaacttgtgtgggcctctttcctctctctcctctcctgctgccgtgtaagacgtgccttgctttccctttgccttctgccatgatttgtaagtttcctgaggcgtccccagccatgcagaactgtgagtcaattgaacctcttttctttataaattacttttatagcagtgtgaaaacggactaacacactgatgtagcaaggtcctttaaggccccatgtgatctggtccctgttttgtctttgatctcatctctttcattgtctaccttcctttcattgtctattctgtctcagccctgctgaccattttactcacacccatgtcatttgcattacatgacattccttctgttcagcataagctatttcctctgcctgcatcactgtttctccaggtctccccatggctaactccttctcttcatttaggtctcagcccaaaagttacctcctccaagaggcctatccttttcatttactgaacatctcatgtacaaaaaagaatataaaatatatgtatactctctcatccacaaaaaaatctctgaagacattttaatgtatttcatcccatacctttttatgcatgtaaacttttaggaacacatttccatgccactaggtatccttgaaaaaataagggccaccatgtatagttgcacaggttgtgcactgcacaaagatagcatgtcacatatcttaagtatcatggagcttgtatgtctactatttcagtaccccagctgataaaagcttaagtatcttgttctagcaagatgaagctattatgacaatttttgacagagaaaggggtgttttgtttaagttcacaatcagagaaatgggtgtcttgtttaatttcacaaccagagaaaggggtgtcttgtttaaattcatacagtggtgctgtatgggttggtggcaaccccagaaaagactgttgttaatatctgataatgttccactttatacgtgtattatattcatgtaacaatctctggctgtttgttttgccattataaataacagtgcagtaaacatctttgtgtgtgaatctctgtccaaggttctgatagttttctgaatgaaattcctgtctatatatggcactccaagcccataattgaaactctgctgttaccactttctttgaatctgtagaaggaattttgagaacaggtgactggtatattcaggatgttgatgacaaggaacagagaaagaacagttaaatggtttggaatttttcctgggctgcatgtaaagcagtgcttttgaactgggagcaatttttcccccaaggggacttttggcaatgtctggagacgtttttggttgtcacgaatgtagggggagggggcaagatgctactggcatctggctggtagaaaccagggatgcagttcagcatcttaaaatgcacaggacagcctttctcagtaaagaattatccagctccaaatgtcagtaataccaaggttgagaaatcttgatgtaatcgatgtcatgggtttcttcaagaggagtgggtggatttagggtttttgggtgacttaaatttaatttacagtttgtcttcctagctgggtgtctaagccagctttctgtgaactttagatcccacacaagaagcaacaggcttgctaccgacagattcgttgatgtaaatatagatgagtgtatagaaggaaatctcacccagagctggaaaatgttggaatgaaaactgcggcggcctccccttctctctccttccccttctgttgccctgtttgaaaatcgtgccttactttctttggtctcctggcatggtgaatgctgctggtatggactgtgtttctatatccccttgatccccacacccttaggaatgtacaggagagagaccctggagcatatcagcttagagatggaggggaatgggaaggagtgcgttcattcattcataaatgttgactgagcacctactgtatgctaggtgaatgggaggacgtgagggcagggaggtgacaaggttggcttattctgggctttgtgaactatggtgaggattttgtttttttccaaaggaaatggaataaccactccttttttccccccgatatacctaaactttttgattttcataacaaaaatgggcttccttttgtatatttgttttgagaccagccgtttttccaccaacactgatcacactgcagtgagcatcctggtagagaagtctttgcacacttctgtcactgtttccctaggacagattcctggaaatggtatggcaaggtcgtatgtcaggcttttgggccaggttgcaagaaacaggaagtctgtgccctttcaaattccaaggtcccctttccctgacgacgtggcccaatcaggcttgccctcccttgattttacatcttcaccaatcagataagtgaaagtgaaatcctgttgtggtatcctgtgcatttctttggtgacttaagacatagagcattttccagatctctgtgggctgtttggatatcctttcctctgttttctcaggcacattctttaccgatgtctttgagggattgagcaagtttctgttgaaattgaggcatgtcatggctctgtgtggggcttgaggcagtccagtgtagtggagggagggaggctgtggagcctggctgcctaggttcaaataccaactctgcttatttccattcatatcattttaggcaaatcacttagccccctgggcctccctttcctcatcagtaaaagtggtataacattagtgcctgcattgtggggtggttgtgaggaaagcagcactcaaaacagtacctgacacacagtgggtgccaaataagagtctgatgtattagtgttataggtatcggcctcctccctccccagtgcaatagtgtgtgtgcgcctctgtgtacctctgttggtgctgacaagccctttttaaaatttagaggtgaggtctcactctgtcccctaggctggagcacagtggtgcaatcatggctcactgcagcctcaaccgcctgggctcaagcaatcctcccagcttagcctcctgagtagttgggactatcggtgtgcaccaccacacctggcccttagacagcccctttatttcaaagcgaaatggcagccacatgatttagtgcaagctctccaagctttaggaccagctgcaactcctctaactgaccaaacaggatcccccatgtccccaacccccaaaacctgatgaaaagcaaacagaccattttccacattcatgacggaaaggcccttttcttggctcctgcccttgctcatgtcaggatttcactccatccctgataaagaggaagcaccatgtcccaggaggacatggaaactctctgctttgtggtgaatagttacagtaacagtagctcctctctgtggggagcttatgagcccctaagctttatagaactgccctggcagtttatgagaacttcatcccagcccccagagctcatggcacttatttttgcccccagtttgcagatgtgcacactgagactcagagagctaacactgcttgccaaggtcacacatctagcaaatggagaaactttatgagacaggtgaaggcacagcaaggataaaaacccagagggaaaaatactcaagttttctccgggaaaccatttgcattccagagaggttggtgtgcgagtgggcaagagatgtcgcgggacgatggttaagggacagagtctgagctcaactaggactaggtttcttcctttccttccttccttcctttcttccttccttcttcctttcctttgtctttccctccctcccttccttcttcctttccttcctttcctttctctttccctccctccctcccttccttcttccttccttactcctttccttccttcctcctttccttcctttcctttctctttccctccttccctccctcccttcttccttcctttctttccttccttcctttttcctttctctttcctttctttcctttccttccttcctctcttcttccttcttttctttctttcttttctctttctttctttctttctttctttctttctttctttcctttctttctctctctctctctttctttccttctttctccttccttccttccttcttttcttttcttttcctttcttttcttttgttttttgagatggagtctcgctctgttgcccaggctggagtgcaatggcacaatctcagctcactgcaacctctgcctcccggttcaagcaattttcctgccttggcctcccaagtggctgggactacaggcacgcgccaccacacccagctaatttttgcatttttagtagagatggagtttcaccatgttggccaagctggtctcgacctcttgacctcgtgatcctcctgcctcagcctcccaaagtgctggcattacaggcgtgagctaccacgcctgggctaggactaggtttctatcggtggtgtggcttttgggaagctacctaatcttaaccactctgtttcgtcatctataagataagcagtgtagcattttcttgcaggaatgttgcaaggattaagtggatggtgactgtaaaacatcatgcgtggcacatagtaaattctcagcaggtagtcattgctggtcatttacttttctctaatgaccagcaagctcttaatttcctccttggcgtgggcactgggacgtagatggacaaaacacagagagaaataaacacacggacaaaaatccctgccctggtgtggctgatattctgggtggggagagagagggagtccaaggaccagataaacaggtaaaggatagtttgagtgtggtaagtactaaggctcaaaaataaagatctcccaggtgatcttagctgcatttggaggtgacaggagatacaactgagaaactgagataggaggaaacccaaggggagatgtgggcttgatttagggtgatctgaggagtaggagaagtcaggggctggtgtggggaggctctgatggttctctctggggagtgaagcagggattcgttggggagacccaaggggacaggtgaaggcccctgaacaggtggccagtgctgagaaaggaaaggtggaggacccaagtgagttcctaatttcttcattgctcccctaaggtgtttgtctcacccttggccatagtcttggatcacttacagatgcagaccaggctaggctcaatggcttgtgcctgtaatcccagcactttgagaggctgaacccaggagtttgagagcaggctgggcaacatggtgaaaccccgtctctacaaaaaaatacaaaaattggccgagggtgttggcacatgcctgtagtcccagctacttgggaggctgaggtaggaggatctcttgagcccgggagacctatgctgccaaataaggtaggcagtagccacacatggctattgcaattttagaaattaattacaggccacatgtggtggctcacacctgtaatcccaacactttgggaggccgaggcgggcagatcatgaggtcaggagatcgagatcatcctggccaacatggtgaaaccccatctctactaaaaatacaaaaattagctgggcatggtggtgcacacccgcagtcccagctactcgggagactgaggcaggagaattgcttgaacccaggaggcagaggctgcagtgagctgagattgcaccactgcactccagcctgggcaacagagagagactccgtctcaaaaaaaaaaaaaaaaaaaaaaagaaaagaaaagaaattaattacaataaaaacagtccctgagtttcactggccacatttgaagtgcccgatgaccctgtgtggcttagtgaccactgtgctgaatagtgcagatctagagcatcctactggacatgttgccagggtccctgaaccaacagaattagcatctcctgggagcttgttggaaatgcagaatctcatcccctaccccagacctgctcaatcccaatctgctcttcagtgagattcctcaggtgatcttgactgcaccttctaatcacttggaagctttaaaaatgctgaggctgggcacggtggctcacgtgtgtaatcccagcactttaagaggccaaggcgggtggatcacctgaggtcagaagtttgagaccagcctggccaacatggtgaaactccatctctactaaaaattacaaaaattacccaggtgtggtggcacacacctgtagtcccagctacttgggaggctgaggcaggagaactgcttgaacctgggaggtggaggttgcagtaagctgagatggcactgctgcactccagcctgggtgacagagtgggactctgtctcaaaaaaaaaaaaaaaaaaaaaaaaaagaaaagaaaaaggaaaatgctgatgccccaagctccacccccacagatgctggagagatttgtccagggcttcccctggagtggggaatgtttgaaaactccccaagggtttctaaagttccgccagagttagcagaaagcccattaggtggctaagcaggtagactgaagttggagctgtgtgaccttgggcaagccacttaccctctctgaaccacaagctcccttctctctaaaactagagacctgctggcacctccctcccagggctgtgagaagtaaatgatgggatgattcaaagtgctgagtagggtcagatgcagtggctcacacctataatcctagcactttgggacgctgaaatgggaggattgcttgaagccaggagtttgagaccagcctgggcaacatttaaacattacccaggtgtagtggtgcatgcctgtagtcctagctgcttgggaggccgaggtggggggatcccttgagcccaggagttcaaggctgcagtgaacaatgatggtgccactgcactccagcctgggggacaagagtgagaccctatttctaaaaaagaaagaaacccaaaatgctgagcgggtgccttggattgatagtaagcagtgcctgtgtaataagcatgaattttaaaaaatgaggtcagcagccttagagctaatggttaatgggtttgggtgtgggattttttttttttaatttttaaaacattgagataaaattcccataacataaaattgaccattaaccattttaaagtgtacagtttggtggcatttaatacactcagtgttgtgcacccatcacgtctctgtagttccaagaccccaaaaaggagaccccgtactcactgagcgctcactccctgtctctccccgctcccccagcccctggcaactactaatcttctgtctgtatagattgacctattctgattttgggggtttttgaactcgccttccctggctgacaacctctcgccatccaggtgagactgtgtgaaagcccagctccctgcatttctgggtcttcctctccccactgggggctgcccccacctgtttccccctctgggcaccctggttctactcatcagcctggcttaatcccagcagcaggtccatgttctgctctcctgtggctgccacaaatgagaggtttcatctcagctgggtttctcctagttaaatatttaataaataagacctacaacttgtgatgctgggagtgtttgatagtgaaattaatgatggggagagagtggcaggcggcccacaggtccatgctggagctgggatgaggcgccctgggcaggcgtccgtgccactgatgcttgggaaccacggtgggccatgccatcccatttcccccagccagggcctcttttttagcactgtgtccagcacagggtagccacctgataaataagtgttaaaagaaagagaggctgcgtgtgtagggaagaaggaagagacagaggagacaaagaggagacacagagagagagagagagatgagagagaaagaaaagtggaaggtgagaaagagacagagatggaaggggagagaaggacctggatggaggaagtgcaaggaaggcaatggtgagggaaaagagagagagacaaagatggaagggatgaaggagagggagagatatggaggtagagaaagagacagaaagaagagagagaatattgcttcttgtatcttcccctcctcctgttatccttgaccatcttattatttttttcttttttctgtctctccagttctcatttccttaccctcgccgtcttgccaactcgtcatctcttttcatttcctgtgtctatgttatcttttaattttctgtctgggtattttccccttttctctttctcagcataaactgttggttggtgtatgtgtcttctttcttttttagtctttagctgacgtgtgtgtgtatgtgtgtgtgtgagagagagagacagacagacagagagagagagagagagacagagagaacaaacctagagagcagtgtaggaacatagatgaacattttaaagaccaaaccatgaagcgtacacccattttacccaggtcaagagccacagggccaccatcagattctccctcatgctcatcctcaatcacagccactccttccctcctggaggaaccactattggagattatatgggaaccattcgcttgctttcttgtgtggttgtaccacctaagtacgcatcctgaagcaatatagtcagatattatgtggttttgagttttatatgaataaaatcatgtgagaggagttgttttgtattttgcttcattggtttgcagttacctttgtgagatttcatcctcattgtggtcactgcagctccttcatgatcttgtttattcattgatgatgagcatgtgactttgttctcttttgggcactggcataagcagctttgttggttgtttatggattctgctgctcgcttgcaggggtctctctggagcacatcgctctgtgtgaaattgttggatactaagatttgtacattttcaccttgactaaacactgccaaacaattttccaaagtgcttgtgctaatttacactcctgccggtggtgggtgagcattcaagatgcttcacaaccttgccaacacttggtattgtcaggtttttaagttatagcctttctcatggtgatttctcattgtgattttagtttgcatcccccgattgcaaattagagtgaacatagtttaaaatatttattgactattcaagcttgcttttttgtgaagtgcctctacatgctctgtccatttttgattaggtcacttttaaaaaaaaaatattgatttgtgggtgatccttacatagcctggaaactgattcttcatcattatatgttgtgcaatattttctcttggcttggcttttgatcttttttataatgtcttttgatcaccaacagttcttaattttgatgtggttgattttagaaatcttttcctttatagtttgtgggctttgtatcttatttaagaaaatcatttctaccctgaggccatggatatattttatgttatttctgaaagttttacagttgtgttcactgtatgtctttaatcagcttgggattgatttttatatgtggtggtaggtaggggtccaatttcctttttattccataagaattgtcccagcatcatttattaaaaagcccattcttgccccaatgatctgcaagacaacctcttgactgtttaacttttaccttctttcatctggtctgtttttatactcaacctttgaagccacaaatatttattgagtgccaactgtgtgccaggcactgagttacagtgacggatatgacagatgcaatcatggctttcatggagtttacagtctggcaaggatgacatgtaaatagttattactacttataatttaaaatgttataggccttgcaaaaagggacaagtctggcttgctctaaaagaaacatgtgaaacaacatcttccagggaagtgctgataaactgagtctttagtgggcctctgctattgtaggggtgggaatggtggaaaagatgttttggccacagggaacagcatgtgcaaaggtcctgtggaaggtgcttaggagtttgatatttatcctaaaggcactgtcaggctactgaagcagtaatacaatgattttatgtctgtgaatagttccactggttgctgcatggagaatgtattggaatacagcaagaataaaaagccatgagaccaattaggaaatgatttcactcattcagggaagtgtgccttgggctggcatggtggctgtggagatggaaatcattgatcagattaaaagaaattttgagctggcatgatttttcccctctctcccctctctctatctctgtttcttttctggttgtgttttctgggtgagaaaagcagtttgtgatcctgccaagggtatgtgctctggaggatgtatttgccacagatggtctttggaattctggccaagagagtcactggacagcccctggcccccagggtttctggagccaattcaacaatgactgtttattaacaacagcaaggatgagttgctagcctttccttcagagcaccttttaactgttaccttactttgttacccaaaccgacactatggaattggtgggggagaagtggaagggtttttatctccattttttatagaacgggggaagttaattggcactcttgaaatcatacaaaagatgttggtttcaggattggtttctggactttcagcccaatcccaattactcaagctcacacacccaatccccaaacatactcttttgcaaataatttccctactgaggtgctcctggccaatttaaaaggtccccatttccttgcctataaaatgggaattaaagtaaaaatatctacctgttgacttgctgtgaggtcagtgggcctgacacatggtgtggactcattatatttacctatgtgaatcccttagttccctttacttggaagaggtggaaaactcaaaggggcttaaacaagaagtggggattgtattggctcatgagactgaagagtctcaggagtgtccagcttcaggcttgtttggatctagggatcagataacaccattaggcctctgtttctgtttcttggctctactttttgcagctggctccattatccatgacttagctgcacttccagccctccagtctgcccaagaccatattcagagagagattcttctctctttttcagctatcttcccggaattttcagcaaatgctttcttgcttttgattggctgttgctgaggtcgtgtgctcatgccagaaccaatcactgtggggaaatgggaggtggagaacggggtgctctgattggcttaggcttgggtcacatgactttatggagttggggtggagccaacttctccaagtggggaagagcagtcttcttaaaggtgtattaggatatgcttgctgctgtaacaagcaacccccaagtctgcagtagcttaaggcaatacgaatgtacttctcactcaccctaaatccaatcagataatcagcaagtggcattccatgtggtgatttcaggacccggctctttccatctgtggctccaccatcccctaagatcagaaagtccttcacttccggcctgtaggaaaagagtatgaaggctcacacaggaagttttgggaggccacatatagaagtagtgaaccttacttctgcctgcattctgtggactggaatttcatcccatggtgtatgagagagggtcccagtaggaaacggaagacacagaccaagaatcaaattaagagatagcttaagaatcaaattaagagatagcttacaaaggtgtgggcccttactgaaatagagaaggaggaagagaggaaggaggcagagacagagagagactgagactcacaaagacacacacacacacacacacacacacacacacacacacacacaagttgagagaaagaaggggggagagaaagagagagagggagcatttcctaacaggaagctggcagaataaatgtcccccattgtccaaagccagagggctgggagcccagtgagcccatccacacaggtcagccccccatgtgacagtcctagaagggtaaagaaggaaggagagtggatttggggtaatggaagacagccaatacccatggtccatctgactgcagggggaactgagaaattcagtccatggagaagaaggtttagtggacacgtcactttgtctttttcacaaagtgaaactaggttctcaggtggaaaaaagaaaaagaaggtttgccttgctgctattcttttttttttttttgagacggagtctcactctgtcacccaagcgggagtgcagtggcacgatctcggctcactggaagctctgcctcctgggttcacgccattctcctgcctcagcctcccgagtagctgggactacaggcacccaccaccacgcccggctagtttttttgtattttagtagagacggggtttcactgctagccaggatggtctcgatctcctgacctcgtgatccgcccgcctcagcctcccaaaatgctgggattacagacgtgagccaccgcacccggcctccttactgctattcttattattggtggtagcagtggtggtgatggttattggttcttagttccctctacatgccagtatctgctctcttctttttttctcccttacttctttccttgttctgcaaattctttccctttaagtgaaaatctttccgtgttctccaagggagataaattctatgccaagcttgagtgtggggtcctctgcttggatagctgtcttctccaggagatgaggtagaactgagatagtgggggtctctgcaggcagtctgtgcccctggcaagcccctcaccttaacctgaggctgggtggggaaagatgccttgatggagtcagaacagaaagcaagtgatcgctgcctgaaccaagcagtcactttcctggaggtgaaacctagaaacggtccctcaggctgggtccagggaggtggacttgggtcccaggggcaggaagcaacctgcccctcacctgctcctacctctttgtagcctatcttggcaaccagaagtaggtatacaagtgacgttgaagctgggcatgttaacaatggtgtgagcccgcctgactccaatctggtccagctgtactggccgtgcatcctcatctccagcccccagggtcagcccagcggctgtaacaatggtctgtcccctccccgccccacccacttctttgaactcctccaaggatctgtgatgatagggctgtcactgtcttagcttccaccattcaagcttaaccggccttcttcccctccatggagaacggaagagcaacccctcattgcctctggcagctgaccagcaggtccctgccttctgcccactcccaggtctaggacaatgaggtgagaggtagacaggaccaagttccccagtgctgtcttctaggtccacctatcatgagagccgtgattcctagtttttatcaccctctccccaactttgccagctctccacttctggcagtggtggctgcccatgacttcaccttcccgtgcctcagtttcctcatctgtaaaataaggacagccatggtaatgagagttctggtcaatatgccaggcacctcgcttgcatcaatttagctcatcctttcagtgccctgaggggtgggtactgttatcatcccgtgtaacaaaaagagaaaaccgaaacagagagagagactcactatctgaggtcttgcacccctcaagcaacaaaagtgggatttcagcctaggctatctagattcggaggccacggtctcaatgaataataacaacaataataatattgtcctaatctgatgagtttttgatcagattcaatacaagagcataggcagaaaagcttagcccagtgcccagcacatggtaagaactcagcatgttatttataatagtaataaaccattttatgttatgtaattatatattcatagataaatatagttgactcttgaacaacataggggttggggcaatgaactcctgtgcagtcaaaaatgtgtgtgtaactttttttctctattttttagaaattttaaaattagagacaaggtctcgcttttgttgctcaggttgatctcgaactcctgggctcaagtgatcctcctgcctcagcctctcaaagtgctaggattacaggtgtgagcccccgcacccagcctgtgtataacttctgactcccccaaagcttaactactaacagtctattcttgaccagaagccttaccagtaacataaacagtcgatgaagacagattttatatgttatatgcattatatactgtattcttacaataaagtaagctagggaggagaaagtattattttaagaaaatcataaggaagagaaaatatatttactattcattaattggaaagggatcattataaaggtcttcatcctcattgtcttcacattaagtaggctgaagaagaggaggagttggtcttgttgtctcaggggtggcagaggtggaggtggaaggggaggccagaaagacaagcacgcttggtgtaactgttattggaaacaaatctacataagtggacccataaaattcaaacctgagttgttcaggggtcaactatatatgctacaaatacgtaatatgctaatatagttgtatgttattgttatagtacggggatcagaaaatgttttctgcaaaggattagctagaaaatgtctagtaaatactgtctctttgggaccactctactctgccattatagcaaaggcagctacaggcaatacgtaaatgaatgggcatggccatttgccaataaaactttgtttacacaaacaagccatgggccagagtttgtcaacggctggtatagtatatgttattatatattagctttactttttctgttgctttgtttatgttcttctttgcccttcctttcttaaaggccagcctttctttctctctgttggtctgtcttttaggacagcatggcaggccactgggacatgggctctcctgactccaggcttgtttgtctgataagacatgaagagtgaaggtggcaggactctgagctcaggcctgtcctcctcctcttccctctcttcgttttttctttcctctttcctcttttcttctcaagctccagaagttgccattttcctttcccattgctgattttctctgccttgggagaaagcccgagaagatcacttggagaagcccacgagcatctctggcctctcacccagctcctgccattgtctttactcttcctcagacacaccaggcacagtcctacctcagggcctttgcactggctgtttcctctgtctgcattgttcttctctcaggtgacctcatggcttctccctcctctccttcaggacttcactcaaaggccaccttctcagcatttgcctcccgcccttctgccttattttcccctttggaacttttcaccttcttacttactcatctgtctgctatctgtcaccctacatcactatgatctccacaagggaaggtgattttattcgttttttgttctgttttgttgaagatgaggttttgctcttgttacccaggctggagtgtggtggcacgatctgggctcactgcaacctccacctcccggattcaagtgagtctcctgcctcagcctcctgagtagctgggattacaggcacccaccaccatgcctggctaatttttgtatttttagtacagatggggtttcaccatgttggccaggctgatctcaaactcctgacctcaggtgatccacccacctcagccttccaaagtgctgggattactgtgagccaccacacctgatcttttggttttacccaccaatgtggactagaacagcctagatcagcaggtggcatgcagtaagcagttgataaatatgtgttggatgagtgagcactgtggcttctgtcattctgttgctcaatagcattcatctggaaataaccacagtttgtttatccatttacctgttgattggcatttctgttgattctcgtttgggccattatgaacaaagctgctgtgaaatacttatacctttgcccaattcttcacttggtgaacccttataaatcctttaggccaggtgtggtagctcacgcttgtaaccccagcactttgggaagccgaggtaggaggatcgctggaggccaggagttcaaaaccagcctgggtaacatagcaagacccgtctctacaaaaaaataaaaaattggctggacgtggcaatgcatgcctgtagttccagctacttaggaggctgaggtgggaagagtgcctgagcccaggagttcaagactgcagtgagtgatcgcgtcctgcactccaggctgggcgatagagtgagaccctgtctgtaaaaatgacagcaacaacaacaataataaaacctttaggtttcctcttaaaaggaacatccttagagcttttcctgacccagcaactcaccccaagtctgaattagacttcaccccatttctttcataacatttatcacaatgacatgtttattttgtgggggcgggtggcattctggccagaactgtcgacttccagagtgaaaatacggaagaaccaaataaaacacaacacacacatttgcacagcagctcgagggaggtgcttagttctttgagtttccaagaacagagagacgaagatttgtctggggaggaaaaatcagggactgcttcttggaggaggtggactgttgctgccccatccacccacacatttgcagatgtggtgatgagaagatgactgtcacgaggtctctgagcccagggggcccatggttgagtgcaaagatagtggggttgacaaataatcgtcgtataacaaaagaaaagccaccacagttgcataatggaaaggcggcttctatagaacattcagatcatagttgaaggcatgtcacactgtgttactcagaggccactgtcagagccaaaagtgagagtggatgagagtttgggcaggaaacaactgaaccagatacagcatcacctccatgagggctcagctttatctattttgtcttctgttgcatccccagcccttagaacactgcctggtccatctttgctgtgtgaataataataaggaacgatcgctgtgttgagtttgggctgtgaattcagacagtttgctgctgcatacctgattatgagtctcagttttcctcctccataaaatgggcaaaacagtccttgcctcatggggctgtgcatttgtttagcaaacactgaaggagtatacatggtggccaaggcactcttcaagacacaggaagcagacaaaagtccctgccctctgggagcttacatgctcatggggagagatgtatgataagaaacaaaaatagtaggtaagttgcatagtactttagaagattataagggtaatgggaagagaacagcagagaaagggctggggaggcagttgctgtattagatagagctttatcgaggcgatggcattggagccaagacttgaggaagctgtgaggatgtctagagaaagaaggaacagctggtgcaaaggccctgaggtaggggtatatgtgacatgtgtgacagtgaggaggcagatgtggctgaagccagtgagcaagagagagggaaggtgcaaggataaggacagagaggtgacgggacaggttttggagggccttatgggctgcggggaggactttggcttttgctctgagggagctgggagccacggagggcttttgagcagaggagggacgtgacctgactcagatattcataggctcctctggctgctgtgaaaagaacagactttgaaggttgggggcaggcagggcagaagctggggaattaggaaggaggtgacagtgttggtcctggcaggtaatagtgggggtggaaccaggttgttgtctgtggagataataatgagtggctggattctggttataatttttaagtttttttattgtgataaaatgaatttttttattgtgataaaatgaaatttaccactttgaggtgtgcaattccacagcacttactacagtcaccctgttatgcaacagtcacctctatttaatctcagaacatttcatcccccctaaaggaaaccctgcacccattagtagttacttccagtttctcccttcccccagcttctggaaactactaattctggatataagttgaaagttgaccagtaggatttctaggcagacaggtggtgagggctcaatgcattcatgcacagaaagtactcaggtggcatatcataggtgctcaaaactgaaatggtgatgatgagttggcaatgatggtgagtccttccagaatccctgctctagtgctaaactgacctacctggctgtgtagaattctcacctgctggccgggagggtggcagaaccaggatcccttcttacttccagtctggcttgggttagggataggggaggaatgatcagaagaaccaagctagcaccatctgttctggaacatcatccaactcttgtccagatttcccagaactgagcaggaaaatgtccagggaggaacagtgcagctgatggaagtcctggtaagccctggccccagcttcctgagctgctgttgcaccaactagcatttgttggaccttcagtctgagccaagatggcagcttcagaggaagaacaagaagtgtacaagtttctttcatggttgtgtccccgcctccttatatagcctcatataaacccctgcactatcccgttactgtttgcctctccctgaaaagagtgtaaaactcccccactttttccctacttttcacaatgtgttttggtttctaaagatgaaactcctttaattatgttctggttgtaattttctggctccttttatttctcccttacttgatgtattattttcccttgttccttctgccccctgcctccattgatgtttctcttcactgctatctagatttaattctcaactcctgccaagttcagggtgatagtgcaaaaagacatggaccatttagtcttgaattcaggtcccacttctgacaccttcaaagctgctttactttgggcaagtcatatgatcttcctgagggggtatcctttaccttgttcagctaacatttcttgtttttctctgggcacagagtagagtgtcattttccccacctccctgaagttaggtatggctgtgtgatttggtttcatcaatgaaatgtgaagggaagtgacatgagtccttccggacagaagccttaagggtgagcatgggattcaccatgtttcctttttcctgcctccactgtcatggatgcacaaagatggaccctctctcaaagtaagtgctggagagaggatgacatagatcagtccccatcccacttcatagcatgagtagaaaaatagacctggggtgtgttcaaccactgagatctggggattgtttgttactgcagcaggacgtagactaggctgactgtatacctcattatctgcattttggggctgatatctaatcacagtgtctccaggaagattatgttgatgtatgttttagggatggatattcatattttcctataagggctcaataggttcggaaatgtcacatgcatgtaaacttctgattaacaaatatttcttgctttccaatttcttcctatagtgcttctaattttcctgtttttcaatcttgaataaaatgtgagaagtgtttgacttctccttcgaggagattaatggtttctaaagcctggggcattgatttagtcattctcaacctccttgtttctatgacctttttttctccttctctggtcacttagtgtctgctaaggggtgaaggaatgtctgttttaactcattgcattttttttttttttgagacggagtctccctctgttgcccaggctggagtgcagtggtgtgatgttggctcactgcaacctctgcctcctgggttcaagtgattctcctgcctcagcatcccaagtagctgggactacaggtgtctgccaccactcccggctaatttttgtatttttagtagagacggggtttcaccatattggccaggctggtctcgaactcctgaccttgtgatccgcccgccttggcctcccaaagtgctgggattacaggcgtaagccaccacacctggcaaactctttgcatttttaactcttgacatcttcatcttctttttcccacctcccctttgcctgttcctcccctgctcaccccaccagggagtttataatcaggttctagaacctgcaatgtttttctgttgttgtcttccatcttccttgagtcttatgggaatcggccatagtcgcaaattaacaaatagctctgaagcgcctcaagcttggaggcatttccttttgctcacctaagcaagatcctggagctgttgcaaatatcctgccccctactgtaaatctgtcttcatggttgtaagagattcagtcggggtcagtgaagacccgagcaggagatcttggccgaggctccttgatgttctgtctgcgctgggtgttgtcatattgattaagctcctgggactgctgccagcagcctctaggattaaatcaatagagtttgcaaaagtaaaagcttcttttggagacacagaatatgtgggtttattttttagtgataaagcttcaaggagaatcttcatggatggcagaaccagtgatggaaaaggcgaggcagacccaaatatttggggaagtgcagtggggagcaagtgagggaggtttcattgggaggccggggctttccagaaaatctgtttaactggagttgctaatgcaacagctcagagttagaagtgaaggtggaagatgcaagaaggactgccgctgagatgtaaagagaaatgaaggagaggtggatccatttgctcattcaataaacattttgggaggcagggggtgggggggagcctgccatgtgcctggaactgggatgtacatggtggggacatgacagtgggcaggacagatgtggttcctcctggccctcctggaacttgtaacaggaaaagaaggcataaaataaggaataggcaaatacagacataattactaattgtggtaagtgtttgggagaaaaccagcagggtcctgtgtttgtttcctagggctgccaggacaaattgccatgaactatatggcttaaaacaacataaatatattgtcacccagttctgaaggctggaagaccaaaatcaaggcatcagcagtgctgagctcccttggacggctctagagaagaatgcttccttgattcttccagtttctggtagttgttagcatacattggcttgattggcttgtggctgcatcactgcagtctctgcctctgtcttcacatggccttctccttcatgtcagtgtcttctcttcctcttctctctctctcttttttttttttttgtcagggcctcactctgtcaccctgtacaagagtacagcagtgcaattatagctcactgcaactgctgcttcccagcatcaaacaatcctcccacctcagcctcctgagcagctgggacttacaggcgtgcaccaccatactcagctaatttttaaatttttgatagagatgggatctcactatattgcccagactggtcttgaacttctgggctcaagtgatcctccctcctcagcctcccgaagtgctgggattacaggtgtgagccactgcacctggcctcttctgtctcttataaggatctttgtcgatggattttgagcccgtcagataatccaggacaatctcatcttgagatctctaatttaattatacttgcagaggccgttttactaaataaggtcatggccagaggctccagaggctaaagcatgggtatgattgcaccactgcactttaggctgggtgacagagcaaggccccatctctgaaaaataaaataaaataagtaacctactacaggccctttgcgtagaggataattagaagtacaggggtaccacgtaagtgaagacctgaaggttgttaagcacagagcagagtgtgaacagaatgagacagagggaggaagagaatcccaggcagagggaacagcatgtgcaaaggccctggggaaggaacaagttcatcatgttaaaaatgagccagtgtagctagagtctgatgagcaaagggactcacaggtgggaagacacccaagaagttggcagagacaggtcacacaagaccttctaggtcaagttccggaggtgaactttattctacatgcaatgagaagtcctcagagaagcttaagtgggatgggacagaactgctttactttaaatatatatacatatatacaaacatataatattacatatataaagcatatatatgtatacatatatacatatctatctacctgtctatatattttttagctgggcatggtggctcacacctgtgatcctagcactttgggaggctgaggtgggaggatcacttgagcccaggagttcaagaccagcctgggcaacatagggagaccccatcactacaaataaaaataaaaattaaaaattagctgggtgtgatagtgtgcacctgtagtcccagctacccgggaggctgaggtaggaggattgctggagccccaaaggttgaggctccagtaagccgtgattgtgcccctgcactctagcttgagcaacagagtgagatcctgtctcaataaaataatttttgtattgaggtgaaattcatgcaacataagttaaccattttaaaatgagcaattcagtggcattcagcgcattcacaatattgtacaacctccacctctttctagtgctgaaatattttcatcaccacccctccagaaaaccctgtatccatgaggcagttgctcctcatcctcccctcccggtatccccccaacccccaccactcctggtaactacaaatttgttttctgtttctatggatttacctatactggctctttcatataaatgaattcaggcactgtgtgacctttcgtgtctggcttctttcacttagcataatgccctggcttctctctggagaatgaaatggatagaccactttggagtctactgagattatagatatttctgtgggaagggacagtggcttgaccttgggtggtgctgaagaggcaatgctgagcaggaggattcaaagtctaatttcggaagtagaattggtggggtctgatgatacatcagctgtagggggaggaagatgtaggaactgggaaggtctcttagggtaaccttacctgattgagctccttactaggcagctggtggtacaattcataacaaaggttaatagagaaagagacatgggattagggagggaatggaagagtttgggccttggacactgtagtggtttgaatcctgtccaccaaaaattcagatgcatttggaacttcagaacctgagacctcatttgaaagtaggatctttgcagatgtcattgagtcagggattgagatgaggtcatcctggattacagtggactcgagattccatggtaagtgcttttatatgagaaggtacaggggagaaagtcatgtggcaatagaagcagagaatggagtgctgcagccacaagccaaaagacatgtagaggcaccaaaagcgggaagaggcaaggaaggatcctcccctagagcctttgaagggaaaccccctaatttcagaaccttgcctccaggatgacgagagaataaatttctgttgttttaagccacccaatctgtggcaatttgtcatgactgccctaggagactaatatagacactcctatgagatgctctaagaagacacagagtggtatagctattgctaagaccacacactgtagcagggaggaaatcaaatggagaaatgccccaactccccctcctctctgatctcttgctggtgcctcccgttggccaagccaacccagaaggcagaagatgtggtggagggcagcgttgcagggcttggatgatgcagtcacagaagtcagccctgcctctaccaggatgccaaacagggcaatgagtggatattttagggagaaagggcaacaagagaatggcaaaatacatcgaaatgcatgcaagctctagaaagaggatagagatagataaagggtgattacctaggattaagccccagggaagaccaacatttagagattggatagaaaaagaggagcaaaaagggaagattgagaagtagagaccaggaggataggaggaaaactagaacaacattaagaagggcatggtcaagtaatctgggcacagaaaaatggccctgggatttggcagcctgggggtctttggtgatcctctttggaagagttttggttgagtgatgggggctagaaaccagcctggggagggtaggagaagaatgtgcagtgaggaagtggcaggaacacgtgaaggcaactcttcatgaaggggagtagagaaattggttggtggctgaaggaaaattttcagtcaagggtggaggttttaatgatggaagaatattgatttctgtaaattgggtcattcccatccattataccaatatgcacgggtgtcttctctgatataggatgctgggattctcaaatgcccatttgagtttagcatcatgaatttaatgtcaccagcccagatagttgatctcattcaggaatgctccactgcccaggtatggggaaggcaactagttgagttcatgcagggatggattttttccaggagagaaacaggaggcaagaaagtgcgatataatcaacctatgtaaggttgacaaggcaggagagggtcctgagaaatggcggggtcagtgggttgcagggctcgatgggatggacgttggtttgcatttaagggagttagtgagctgggaggtggttaaagaggaggtggttcagccgggcgcggtggcccacacctgtaatcgcagcactttggggagccgaggcgggcggatcacaaggtcaggcgatcgagaccatcctggctaacacggtgaaaccctgtctctactaaaaatacaaaaaaaaaaaaaaaaattagccaggcgtggtggcgggcgcctgtagtcccagctactcaggagcctgaggcaggagaatggcgtgaacccgggaggcggagctgctgtactccagcctgggcgacagggcgagactccgtctcaaaaaaaaaaaaaaaaaaaaaaaaaaagaggtggttcaagacaaggatgctggaaacaggtgttttggaggtggctggtgtagcttctgagcatgcatagctggagtggcttggaggagacattggttattgatgaagaggtagggacatcctccagtgatcaaggaagcaggggaccagcatggacaatggtctctccacagggaaattggaggtcatcaaatgttaacaggttccgtcggagtcttagctcccagcttctgttttcctgtggatctcaggatcttggctgctggtgctacctctgactttggacttcccattgagcccagcagcactgggagggaccttcatggcattggctggtttaaggaagacttccttggctttgctgactttcttgggggccttcttggctacacctgcttttgagggagccctcctcacctcacctgacttcttgggggcaccttttccaccttatctgagttgggaaggtctttctttgattctcttgctttcttggggcccttctcactggtttttctgggggccatgatggtggacatattccagagctgagctttccttttgttcttaggaactaatttgaggctgccagtggccccaccttggtcttagagttgatggtctgcagggaatttccaggttaaaggttttttatttgtttgtttaattttgagacagagtcttgctctgtcacccaggttggagtgcagcggcacgatcttggctcactgcagcctccgcctcctgggttcaaacagttttcctgcctcagcctcctaagtagctgggattacaagcacgcaccaccatgcccagctaacttttgtatttttagtggagacagggtttcaccatgttgaccaagctggtctcaaactcctgatctgaagtgatccggccaccttggcctcccaaagtgctgggattacaggtgtgagccactgcgcctgacctccaggtttaagtttaaaccatgaagtagatggactgtgtagagagagaccagggaaatggaggattttactgaccactgaacagggatgtcactattgccagagaggaaaaggattcccccttggtagagtgaacatataagggaaagtggttgaaaattgaatcaggagacagagacctcacaccactcagaggtccctagagaactttactgacctagaaaaaaagataaacagggagaaggtcttcagttcttgtttggaatctgacactgaagcatcctcactcctcactctcttcccgaccccgagagtctgaaattgattaatactttttgtttaaaacttggcttgttgttttgttttttctttctgttttcatcaagggatctttattttacttttgtgtatttgtgtgttttccatgagtcatgttaattcttccatgtttaaactttttggcccagaggaatttatacatttaaattatggatttaatttcagaaggtacatacacacacacacacacacactcactcatctcactttttaaaaactgtaaaatatagccctgtaaatatccagaaaatatctaatgtgggccgggtatggtggctcatgcctgtaatctcagcactttgggaggccgaggtgggtggatcacctgaggtcaggagttcgagactagcctggccaacgtggtgaaaccctatcctcactaaaaataaaaaaattagctgggcatggtggcaggtgcctgtaatcccagctactcgggaggatgagacaggagaatcacttgaacccaggaggcagaggctgcagtgagccgagatcaccccactgcgccccagcctgggcgacagactgagactctgtctcacaaaaaaaaaaaaagaaaagaaaaagtcagtgtgcatcccctctgacatccagcaacttcacatcttggaatttatgctgcaggaaaattatcacaagtgcacaaggatgtatggtgagatagttattattatcattttaaaagatagggtctcactgtgtcacccaggctggagtgcagtgaagtgatcacagctcactgcagccttgaccttctgggctcgagtgatcctcgtgcctcagcctccccagtagctgggattacaggtgtgagccaccatgcctggcatccccctttttttaaaaaaaggttttaattatgaaaagaatatgggcttgttgttttgtgtggttttttaaaagcttaaaaaatgtgtagtgtgtcatttagaaggtgaaaagcccttaccccatcccacctcccagagataacctctgctagcaatttcgtgtttgtctttcaaattttttcccacacacattctttgtactggctgcttcccctcctgggttactcttctcccagacagaaacagggctcattcccttgcctcctccagcttttattaaaacattaacttccctgtagctggatgcagtggctcacgcctgtaatcccagtgttttgggaggtggggaggcaggaggatagcttgagcccaggagtttgagactagcctgggcaacatagcgagacccatctctacaaataaataaataaataaataaataaataaataaataatggaaatttaaaagagagagggaaggactcttgaaaaccgtccatatcatgcttctctaaatggttgagggctcagaggaaaaaaaatcagcaatttcacatcacggaatttattctgcagaaaaattctcacaagtgcacaaggatgcgtggtcagatgatgatgatgatgattattattattattattgaagaaagtagcagcagcagcagcagtattttaaaagacagagtctcggatgggcatggtggctcacgcctgtaatcccagcactttgggaggttgaggtgggcagatcacttgaggtcaggagttcgagaccagtctggccaacatggtgaaaccccaactctactaaaaatgcaaaaattagccaggtatggtggtgggtgcctgcagtcccagctaccagggaggctgaggcacgagaatagcttgaacccaggaaatggaggctgcagtgagccaagatcgtgccactgcactccatgcactccagcctgggtgctgacccaggttaggtgcaagactccgtcttaaaaaaaaagaaaaggaaaaaaaaaaaaaaaggacagagcctcactgtgtcgcccagggtaaagtgcaatgagtaaaggcccatgatgggaaccctgaggagagagtcaaggggaaagaaaaaaaaaaaagcaaaaccaaaatggaatttaaaaaaaatcaggtgcaatttgcataacagaaaattaaccattttaaagtgaacggctctgtggcatttactgcactccaactgttatgtaactaccacctctgtctagctccagaacattttcaccacccctaaaggagaccttgtacccattaagcagtctctctccttctcccctccccaccaccttcctccagcctctggcaaccacccatctgcattctgtctctatggatttacctattctaggtagtcaacaggatgagatatcccaaaagtccatccatggatgaacagataaaccaagtgtgatatgccttcctcagatattagtctgccttaaaaaggaatgaaatactaatctttgctacaacatagatgaacctcaaaaatatgatgtggctggacacagtggcttacacctgtaatcccagaactttgggaggctgaggtgggcggatcgcttgagcccaggtgttcaagaccaccctgggtaacatagcaaaactccatctctacaaaacaatttacaaaaaactagccaggtgtggtgacatgtgcctgtagtcccagctattcaggagactgaggcgagaggatcgattgagcccaggaggccgaggctgcagtgagccatgatcataccactgcactccagcctaggcaacagagtgagaccctatctcaaaaaacaaaacaaaacaaaacaaaaaagttgatgctgagtgaaagaagccagacacaaaaggcaacatcgtgtttaattccatttacatgaaatgtccaatgaagattttttttggcaacatttattttgagtataatatttagtgagtggaccacacatatgcatgcactgcagtatgttcttggaaacatttcagatttgagaggtctgttcagctatgatgacggtaggtattgtcccttccctccctccttgaagaaaaggaactaaggctggacgcggtggctcatgcctgtaatcccagtactttgggaggctgaggtgggcagatcacttgaggtcaggagttcaagactagcctggccaacatggtgaaaccatgtctctactaaaaaatacaaaaaattagccaggtatggtgctgcacgcctgtagtcccagctactcgggaggctgaggcaggagaattgctcgcacccaggaggtggaggctgcagtcaaccgagattgcaccattgcactccagcctgggtggcagagcaagactctgtctcaaaaagaaaagagaagagaagagaaaagaaaagaaaccaaaagaaaaggaaagaaaagaaaaggaaccaagacctagaagggcaaaaataggaaaagttggccgggcgcagtggctcacgcctgtaatcccagcactttgggaggccaaggtgggcagatcacaaggtcaggagatcgagaccatcctggctaacacggtgaaaccccgtctctactaaaaatactaaaaattagccgggcgcggtggcaggcgcctgtaatcccagctactcgggaggctgaggcaggagaatggcgtgaacctgggaggcggagcttgcagtgagccgagatagcaccactgcagtctggcctgggcgaaagagcaagactcggtctctaaaaaaaaaaaaaaaaaaaaaattggaaaagttatttactattagcagcaattgtcataaagtaatgaacatttattgcatgattacaatgagataaattgtatcctgtttttataagcatattaagttttcttttttaaaaaaatgtatgtatttatttattttaagagatagggtcttgctctgttgcccagactggagtgccatggtatgatcatagctcaatgcagcctcaaattcccaggttcaagcaatcttcttgcctcagtctctcgagtagctaggactacaggcatgtgccaacatgcctggctagttttcttatttttaaatgtatttttgtagagacaggatcttgctgtgtcgcccaggctgtcctcaaactcctggcctcaagcgatcctctgccttggcctcccaaagggctgagatgataggcatctacctctgcatttggcccacattaaattttctagtcatcatgggaaccaaaataaacaatataaaacactcacattccttgagcacttactatatgcagggccctgtaatagattattgtgtgtatcagctcattccattctcacacaacctatgaggttgatgctattttctaccttttatatatgaggaaactgaggctcagagaaggaaactgccttgcccaaggtcaaggccacgtctgatccccaaatcctttcaactcctctgcactactattttttagtgcagatattgccagttttctaagcagaagcatgatttagcagccctgagtagacttctcatttcagaaccaaagtgttggacattgttggataatatgaaaaacaaatgacacacaaacctatttgatactgtttttaattttctcttcatttgattttcctgatgacatgattaatcttttttgcctctaccctgtatgtgaaatgtaggtctttgcagatgtctcagagagtgttaatagttgctgctggttttgttttctctccccggggattcccatccctgggtgcaagtgaaattaaacttgtgcctctttgccgctggccgtggtgctgaaaacatcccgggcagcgctagggttgcccttgttagcatgccatccctgctaagagtcttaggctgatcagcgagtggagagatcttttccaggcttcattttggttagaactgtgtgttgaagattttaaagcccatgtctgggaactggagactgtttggattgtttgaagttgaaatagtcatgaataattcctacttgagatgggcttatgagggcgtggactagcatgcaatggttggcctttactaaactgtggccattggttgggacttgggtgaggtgtaacccatttggtctaatccatatggttagggccccaagtgcacctgcattctatttttttttttttttaaataaaggcaaacccatctatcttctaaccaggatagctcctgagtggtctttggggaccaccagcttaaaagcatagactgtgggctgggcacagtggctcatacctgtaatcccagcactttgaaaggccaaggtgagaggatcgcttgagcccaggagttcaagaccagcctaggcaacatggtgagaccctcatctctacaaaaatgttaaaagttagccaggtgtgttggcatgcacctatagtcccagctactcaggaggctgaagtgggtggatcgcttgagcctgggaggtcaaggctacagtgagctgtgatcgtgccactgtatttcaccctgggcaacagagcaagaccctaactcaaacaaacaaacaaaaaaaggcatagactgtggagttgggcagacctgggtgtgagccccagctctgccagtacctcctatgtgaccttgaaaatttgtttaatctctctgagcctggattttcttgtgtggaaaatgaggcttaccacagaacccaccttgtagaaatgttgcaaggaattaactgaaacaaagtgcttaccacggtatctgcccaaagaagcagttggaaacaaggcagctgtaattatggtcgctgtgcttgttaatggccccataatagttgatcatattgcagagtgaaattggggtatgtgtttaatggaccaaggaatatgtcttaaacccatatatctagggttctggtaccctctactctttttcctggtgattgtgatgagcatggaacttacatgaaaatgaggtctgtttggcttcttcacacaagctcaatgacctggctaactgctacaagtatctgtttccttagaacccacccatcagcagtccccatagtggagacaaggtcacaaagagttgacaaacctgatttgatttccgcaccaaccacaggaggcttgaaatgagatgagggtgaagggcaccacagagggatgcaaggattacttggacactgcaaggtcttgctaagggatgggaaccatcagccacgcccactttgagaattttccttcatgttctgaatctgaagagcaaggtcctgttctcagatgcaagccctccttcttccctacgcagagtcaaacttggtcttttccagggtcacatacagcctctctctggggcctctgcaggtcctgatcaatttcattgtgtatagagctctgtgtctcctcacctgcctgcagggctgtctgctatcctgacttccgagagccatttcggaagccagcttttcctcccatcagggatgcttctcttctttcagcccccgccccgctttggcctcctaggatggctgatttttctggatcccgctgacacaggtgctttctctccgagccaatcagggagcagaaaggctcagctcagctaacagaggcattgctcaccgcagctgtgagttagaactcaggctttctaaatcgggaggatcaggcatgacttgaggttgggctgagaaagcctcgcctgccccccagctcgactacccagtgaaacctttggcttctgcctcgggcgaggcatctcttaccatgccaagaactcagcagcccatctttctttcatctgggcaccaagtacatcattgcatatttcagggggtttcattgtgtccttaacatgctcatggagacttggcttgagatgaagtcggggtttctaggcagcaggacccatgtccccttccttcatttcctccaccggtgatttttgttttgttttgttttgttttgttttgttttgttttgtttttgagacggagtctcgttctgttgtccaggctggagtgcagtggcgttatctcggctcactgcaaactctgcttcccgggttcaggtgattctcctgcctcagcctcccaagtagctgagattacaggcgtctgccactatgcccagctaatttttgtatttttagtagagacggggtttcaccatgttggccaggctggtctcgaactcctgacctctggtgatccacccgcctcggcctcccaaagtgctgggattacaggtgtgagccaccgcaccaggcccttccactggtgttttttgagcatctactatatagagaatgctctcctgggcacagaggatgaagcagtgaacaaagtagacaaaaaatccccacgtgcatagagtgtgcagtctcgtgggagagacagggaacaagataaagaaggaaaaaaatagcagatgcttgactggggacggggactaaagaaagaaaaaaataagcaggctaagggggttgatggatgtgacctttgagtaaaggcctaaaggaagtgagggagggagtcatgtggatgtctggggaaagactattccaggagaatgaacagcaggtacaaaggcccctgggtacaaatgtgcctggggagtttggggaataaaagggaggccggcgttgctgtagctgagtgactaagggagagaatagaggagatgaggggagggaggtaatgggagcaggtcatgcaccttgctggtgctggaaggactttgtttttgcttttgagtgagatgggatccatgggaaggctttgaatacttccacatgcattaggctgaaattttcttttctgcttttgtcgcattccaacattgcttttatttcatcaaaatcttcggtttcttctcaggctctttacccaagtgggagcagaaggctggtacccagggctgttcagttctccccctggggtcagaacgtggaggagaaagcttggaggagaaacaggaacccccacctctttctggatgactcaaaaccgcaattacctgagctcctcctcctatccctgaaatagaggcacttagcacttcctaaacttcccggtgcacacaaatcccctggcgatctttttaaatgcaggttctgactcagcaggtggatgcaaggtctaaggctgcattcctaaccggtgctggttctgggaccacactttgagtagcaagggtctgaggtcattgttgcagatgtccatctggggcatgtctgtggacacttgcgggggtgcgggtgagcagagggaggggggatgatgttggaaaagcagtgtgagtatctgtgtttgataagaagtaagaaaatgaagcaaggtgggagagtagaacctctttatttttgcctacgtgctaaggttttattgccatacccagagagccctgggtctgaaatccaggcaacactggccagttgaaaccctgatattgcagcccataaaagtgctgcatgctgcatggtggacttctgggactcttcctggaaccttcagtgccagagccggtccaaaggaagtcacatccctgccattgaggggcaggagaccagggaaccggaggagtgggatggcagaagcgcgtgtaaggaggctgagttggcagggagagaaagcgaagtcagcttcaaatcatagcgagaggagaccagggaagggcttggcgttgctgctctgtgtacaaatattgtctcttattttccaggctgcagggtgaggcagagtggagtatttgtgcaacacagcccagctttgttctctgggctcctaatgcctgtcagctcagaggcagaaagccaatcagagatgatcgtcggcaaggccggcttttgttggctccccaaattgccctgagtctcggattttgcttttcagagtgtgctttcagctggaggcaaaggctgaagctggtgacaaaaggaagcctggttttcctggctttccgagacttttactgagggggtttctatttcagactccgttttcccacctggaaagcaggttccactctccctccggcctggaagggatggttttatggtgcttccaaaatgccaaacctaactccagggcagaagaggagactgaaaccaattaattttccaaaggttagagctacgaggaggggagaggtttagcatggtcaagttccccaagacatactaattgatctctctacagaatgcgggatttcagtgcccccaggggacactcagcaatgtttagagaccacttgaggttgtcatcactggacaggaggggctgctactggcatctagcacacacaggccagggatactgttgaacatgctgcagtgcccagacagccccaccaaggagaatgatccacccctaaacctagtgctgaggttgggaaatcctgctccggagtaaccaacaccctatggctttttcactcaagcagccgcttctccagcgcttacacctcctcagagattgccagatccatatgcagagcctgttggcgtgggacacttctgaggggtgtggcagggagacagcggacattcccatttaccagctgatcagcaggttaggagctaatatgaaatgaacaagatagaccctccccacctgccctgcagatcctctggtgggacactagggagggaggcctcctaaacccaaatgacagttcccaggatgcagggaggagtttacctatgcaaactggagagaatgcaaatggggcatctagagatacttactggacgacccctcccctgcctcgggtcttggaagaacagattctcagaggtctgccctgatcactgtaattttttttttattgaggtaaaattaatataacacaattaaccattttaaagtgacatttagggctgggcacagtggctcatgcctgtaatccccgcactttgggaggctgaggaagaaaggtcgcccaggagttcaagaccaccctgggcaacaaagtaagactctgtctcttacaaaaaaaaaattaggcacacatggtgttgtgcacctgtagtcccagctactcaggaggctgaggcaggaggatcgtttgagcctaggaattcaaggctgcggtgagctatgatcatgccactgcactccagcctgggtgacagagcaaaattgtgtttctttaaaaaaataaaagtaaaaataaataagaaaagaaaggagaggggaggggagaggcgtttagtacactcacaatgttgtgtaactgtcaccttcatctagttctaaaacattaagcagccactcccatttcccttgccattccccaggaacaacaaatctgctgtctgtctctggatttgcctgttcgggatatttcatatacatggaatcatacaatatggggtattttatgtctgcttctttcgcttggcataatgttttcaaggttcattcctgttctatcatgtatcagtacttcattccttttttttttttttttttgaaacggagttttgcttttgttgcccaggctggagtgcaatggcacaatcttggctcactgcaacctccgcctcccgggttcaagcaatcctcctgcctcagcctcctgagtagctgggattacaggcatgcgccaccacacccagctaattttgtactttttttagtagagatggggtttctccatgttggtcatgctggtcttgaactcccaacctcaggtgatctgcctgcctcggccttccaaagtgctgggattacaggcgtgagccactgcacccggcctacttcattcctttttatggctgaatactattccattctatgagtagaccacattttgtttatccattcacccactggtgaaatttaggttgtttccatcttttggctgttgtgaatagtgctgctgtgaatatttgtgtatgagtgttcgttggaatacctgtcttacgatccttttgtgtttataccttggagtggagttactgtgtgtcacatggtaactctgtgattaactttttgaggaaccaaggaatggttttctatggcagttgcactggtgtttttttgttgttgttgtttttgttgttgttgttttgagacagggtctcactcccattgcccaggctggagtgcagtggtgcagtcatggttcactgcagcctcaacctcctggggctcaagcaatcctctctcctcagcctcccaagtagctggcactacaggcctgcgccactatgcccggctaatttttcatattttttgtagagatagagtctcagtttgttgcctaggctggtctcggactcctgtgctcaagtaatcctcctacctcggcctcccaaagtgctgggattacaggcatgagccaccgcatctggccagctacaccattttatattcccaccagcatgagggtttcaatttcttcacatcttcaccaacacttgttttctgtttgtttgtttgtttttaatagctatcctagtggatgtgaagcagtatcccgttggggtttgatttgcacttccctgatcactaataccctcatgtacatattggccatttgactgtcttctttggagaaatgtctattccagcctcctgtccatttttcaattggattatctttttgttgttgtgttgtaaatgttctctctttattttttatttttttgagacagagtctcgctctgtcgcccaggctggagtgcagtggcacgatcttggctcactgcaagctccgcctcccaggttcacgccattctcctgcctcagcctcccgagtagctgggactacagatgcccgctaccacgcccggctaattttttgtatttttttagtagagatagggtttcaccgtgttagccaggatggtctcgatctcctgacctcatgatccacccgccttggcctcccaaagttctgggattacaggcgtgagccaccacacctggccgtaaatgttctttatatagtactagacccttatcagatacatgatttgcaaatagcttctcctattctgttacttgccttttaactttcttgataacgtcctttgatgcacaaaaggtttaaattttgataaagcccagcatatctgttttttcttctgtggatcatgcattaggtgtcaaatctgatcataatgttttatttatttatttacttatttatttattattttatttatttttgagatggagtcttgcttctgttgcccaggctagagtgcagtggcatgatctcggctcactgcaacctccacctcccaggttcaagcgattctcctgccccggcctcccaagtagctgggactacaggtgtgtaccaccacgcctggctaatttttgtatttttagtagagacagggtttcaccatgttggccaggctggtctcaaagtcctgaccgcaagtgatccacccaccgcagcctctatctatttttaatttatctctttttttttttttttttttgagacagggcctccttctgtcacccaggctggagtgcagtggtatagtcattgtacactgcagcctctacctcctcggctcaagcaattctctcgcctcagcctcccaagtacctgggaccacaggtgcctgccatcatgctggccctgccaccatatttgaaattgcagccctgaccccttccactgtctatagtcttcaccatcttactacataacatagcatatatgatgtactgtataacatggtatatgcagtgtactgtatagcatagtatacatgatgtagtcatctcatttatttgcttctcctctgggaagcaggaggaagcttctcctcttgtctgctttgctctcaactgtgtccctagcccagaacagagtctggcacacagcaggtactgaatgaatatgtgttcagtgaatattgtgggtgagatagaaggtgaatatccacatttccctttagaagtcacctgatctgggtttgagatctgcagggatctactccagacaggagaacgaataattccacctgtgctgatgagttggaaggatctagagggcttgagatctttccactggggtcagtgggggtgggtgcacctccaacacccttcttttctttgaacaagatttttccttaattccccaatactccctttgaatatatgattttagccaccatcatagcgaattgcatcgtcctcgcactggagcagcatctgcctgatgatgacaagaccccgatgtctgaacggctggtgagtgatgtcttttctcagggtcttctccttggctttagcaggacattaatttttgggggagtggagcagggcacagaggaggctctcagtcctggagcccagagccagatcatgggaagcctaaatttccttttcattttttcttgaaccagagtctcgctctgtcacccaggctggagtgcagtggttcagtcatagctcactgcagcctccacctcctgggctcaagccatcctcccactgcagcctcctgagtagcagggactacaggtgccaccatgcccagttaattttcttatttttatctttttttgtagagatggggatctcactaggttgcttaggctggtctcaaactgcccactttggcatctgacataatttcaggcagtatactcaaatgaacattgttaatgttaataattatgtcttggccagacactgtagctcatgcctgtaatcccagcagtttgggaggccaaggcaggtagatcacttgaggtcaagagttcgagaccatcctgaccaacatggtgaaagcccgtctctactaaaaaaatacaaaattagctggatatggtggtgcacacctgtaatcccagctacttgggaggctgaggcaggagaatcgcttgaacccgggaggcagaggttgcagtaagccaagatcgcaccattgcactccagtctgggcaacaggagtgaaactccatcttggtgggggggaggcgaaaaaaaagaaacaagaatattacaaaggatacagatgaagagatgcaaagggtgagatataggagaagggtgtggctggcagcttctaggtagcttcaggagggggactggtcaccagaaagaccaaggcatgattcgagggttgcgactttcagccccaccccccaacctctgggagggcagaggggctgaaaatcaagttgatcaccaacggtcaatgatttaaatccaaacctctaatcatgccttggttttcccggtgaccaacccccatcctgaagctacctagaagctgccagccatcagtcaatccttagcctgcaaaaagacatccctttggagatcccaagggttttaggagctgtacaccaggaaacagtgtcaaagaccaaacatacatttcacaatgtcacagtcttctaaaaactataactagcctagcaaacctatgatttctagatctttgcattttcacttaaaataaagctaaataaaaagcgtccattgaaagactggtaagcaagtagaagtaccagtggcaagctaatgtggaaaaaaaaaatcattcaggcagagtgaaaatgattgtagctcgagaaacgttgctgtaacagatgggaaaacattcacattggggctctgatggagaagagcttgtagcttaatttcaaatatgatagattagcagctggaagccagaaccagccggaggttctgcagaggaactggaggtgaggatactggccacttatcagccagtacagaagtcctattccaaacctttaacaatctacatgccagctgagaaccatcctaaggggtcagatttaggagtgaggtcaatgcacaagctctagcctcaaataccttgaacgctgcatgtgacaagtaaattctctaaaccaatgctttccattagaactttctgcagtcacagaaatgatctccatctgccctgtccaataggattgtcacttgaaatgtagccagtgtgactgcagaactgtgttttttattttattgcatttaaattaattttaattgaaatagccacatgtggcctgtgactgtcgtattgaataagacaggtgcaaacaaataattctgtttagctgagtgatatgtgaggttggcccaaaaggaatgaaggaggaaggtgccttctctaggcattggctttgctcgcaaaaggctttggacaagagaactctgcaagaggcagtgaggggtggtgagtgcaggagggtcaggggaagtgagagggtgataggtactgatttctaggtgggctggttccctgatcttgtcaacatctgcccagcccaagacgctgaccttgccttctctcccttccaggatgacacagaaccatacttcattggaattttttgtttcgaggctggaattaaaatcattgcccttgggtttgccttccacaaaggctcctacttgaggaatggctggaatgtcatggactttgtggtggtgctaacggggtaagtggcgcgtgctatacgctttggatttaactagctgaaggattacgaggcttttggttggtgtggtccgggccaggctcaggaaggctgagcccttgtgttctccctccccttgttatgcgcctgcctcctttctgccaacaccccacctccatgtctcagctgtatattacagcagatgctttctgttacaattaaaataatagctcattattgttggctgcttccagagtgctttatgcccattctctaatttaatccttgcaacaacccactgaattaggaaatattaatattcccatctgaccactgaggaatcagaaactcagagtgtaacttgcttaaggccacccagcaagtaagtgatggaactgggagatgaacagaagattatgcattccagaactcaaggttttaagtgttgtacgtgcatgggtctcttgatttgcttgaggatatcttgcttttatttcaacttggtgaatgttttttgagaatgtctgggtgcaagggattgtgattatgacaaaggagaaaagcaagctaaataaggtacagttactgtcttcaaggagttttcagatccatatatgatgaactgtggttgaaatgtgtatatgctttcctctaagcaccctgtatgaggtagcacttgctggtataacaaaagatccaaagctaggaaatgacttaaacacggcagaagtttatttgtcactcatagaaaattcaaaattgagctgggtgtggtggtgcatgcctgtaatctcagcactttgggaggctgaggtgggaggatcacttgagctcaggagttcaagaccagcttgggcaacacagtgagaccacccccccatctgtaaaacataaaataaaataaaaattaaccaggcatggtggtacatgcctgggagaattgcttgagctcaggagttggagggcacagtgagctatgatcatccaaccgtgctccagcctgggcaacagagcaagaccccatctcgaaaaaaaaaagtccaaaataattgttcctagttgacaggctcatctcctccaatgactgacggaccctgacccttgccatattgtggctcttcattgtcagcccacatcatccaataactccatgcttgtctgtatcaaaccaggaaggagaagtgagcatagaaggtgatacttggaaaggtttatgagtttggaaggggtgtgacccatacctgttccattcatatcctattggctagaactcggtcacatgaccacacatcactgcaagggaagctgggaagtatcagattgtgcttagaagaaaagggaaatggatttggagaatgacctactagtctgtcagggaccttaaaaacttttattagattccagtagggacattagtatctggtaccaatggctggttcctcctcttcccactctctactctcctctcagctaagtctgggctcttctattctaagacccttcttcactggacacctttttcatagtaatcatttacaggatcatagctttccatgttttgttgctgctccaggttctgtctctcttggcggatgtgatgggttgcagcacccacactgtgctggccgggctctcacaatgcagatttgtttcagagcaatgttgcctctcacagaaggagctgtggcctattgggctgtttctgtagaggccttcagatgtcagcagtctgttgtaaggactctgggctagctctcatgggcttgggtgttcacagagggatctttgttggctgtgctcacagttcggtggcttgggaccttggtgggttccaagggcatattatggtactgggcacttttctcttagtctactaggaaactcatctagaaacagcctagtggctaacttttttattgtttaaaaaatgtaaagctgggcagggtggctcatgcctgtatcccagcacattgggaggccaaggtgggaggattgcttgggcccaggagtttgagacgagcctgagcaacatagcaagaccacatctccacaaaataaaaattaaaagtgtataaagctgggtacagtggcacatgcctgtaaccccaattactcaggaggctggagagagaggattgcttgagcctaactagtttgagaccagcttgggtaacctagcaagatcccatgcaaaactaagtagagaataatagagcaaacacctgtgtatacattcatttattcaatgactatttattgaacacttctgtgtgccaggtcctgttctaggctctgggacacagcagtaaacaaaatagaaaaatcccctgtcctcatggagctgagagtctactgatggagatggacacaattgatgaatgaatctagtgtgtcagatggcggtgaggggtacagaggaaaaataaagcaggggagggatgggatgtgtggcaggcaggggtgaggggtgctggaagccagggaagacttcactgggcatgtgacatctgaatgaaaacctaagggaggtgagtgagtgagccatgaggagagctggaacagagtgtcaggcaaagggaacagccagtgcaaaggctctgaggctggactgtatctgacatgtttggtcaacagtaagaagacccacatggctagagaaggtgaccagaagaatggggagaattggggatagagaagtaatggagtaacctgctatcaaaacacaacctttctctttttttttttttttttttttttgacaagagtctccctctgtcacccaggctggagtgcagtggtacaatctcagctcactgcagcctctgcctcccagtttcaagtgattctcctgcctcagcctcccaagtagcttggattacaggcgtgtaccacaacatctagctaatttttgtatttttagtagagacgggtttacgccatgttggccaggctggtcttgaactcctgacctcaagtgatccacctggcatggcctcccaaagtgctgggattacaggcgtaagccactgtacccagcaaaacaaaacctttctaacctttctaatccctgttttctccctccctagacccattcctttctctcccccatccaggggcactttcctgaattttatgtttattatttgcatttatgtattcacactttggctgcctaagtatataagaaatatatgctacctatttttacacttcaaaatattttttaaatagcatcagagtgagaatagtttacactttgactacatgcatagataagaaatatgtgggctgggaatggtggctcacacctgtaatcctagcaattttggaggcaaagatggaaggattactttaggccagaagtttgagaccagcctggccaatgtagtgaaaccctgtctctacaaaatgaaataaaatgtaataaaatattcagctgggcatggtggtgtgctcctgtggtcccagctactcaggaggccaaggcgggaggatcacttaagcccataaggtcgacgctgtagtgagctatgactgcactccagcttgggcaacagagcaagaccctgtccctaaaaaatgttttttgttgttgttgttgttttttgtttttttgtttttttaataaaggccaggtgtgatggctcacacttgtaagcctagcactttgagaggccagggcaggaagactgcttgagtccaggagtttaagaccagcctgggcaacatggtgaaaccccatctataaaaaaaatgcaaaaaattagccaggcatgatgacgcacgcctgtagtcccagctactcaggaggctgaggtgggaggatcacgtgagcccaggaggtcgaggctgcagtgatccgtgattgcaccactgcactccaggctgggcaacaaagtaagaccttgtctcaaaaaaataaaataaaataaaaaataaaaaaaagaaaagagaaagaaaaaaagagatatgtggtactgtttttcaaacttcacatttctctaacctgacttttgtgttcaacatgagataaatctgattaataaaaatagtttccatgcatccattttcatgactgcatagtattctgtggtaggagtatgctgccgtgtatttatctatttggattgtttccagctttgggctattttgacccaaagtgtccctgctttctcccaagtgagtttctctagggcacgtacccaggagtggaactgctgagttgtatactgtgtgcatcctcagccccactaggtattgccaaattgctctgcaaagtggttgtgccaattcatgctccctgggggctggcttctgctggctgaggctggcttgaccttgctggcaggaaggagccttaaaaatccctgtgtggttttttttgttttacttttattttaagtttaggggtacaagtgcagatctattacatgggtaaacttgtgtcttgggggtttgttgtacaggttatttcatcacccacgtattaagcctagtacccattagttatttttcttgatcatcttcctcctcccgccctccaccctccaaaaggccccagtgcgtgttgttcacctctgtatgtccatgtgttatcatcatttagcccccacttagaacacgcagtatttggttttctgtttctgcattagtttgctaaggataatggcctccagctccatccgtgttcctgcaaaggacatgatcttgttctttttcttggctgcatagtattccatggtgtatatgtaccacattttctttatccagtctatcattgatgggcttttgcagccctgtttttttttttttttcataataacacggttatgggaacacttagggaagctcatatattattgagcagtgtgatggttaatattgagcatcaacttgatcagcttgaaggatgcaaagtcttgttcctgggtgtgtctgtgagggtgttgccaaaggagattaacatttgagccggtgaactaggagaggcagactcacccccaatctgtgtgggcaccatctaatcagctgccagtgtggccagaataaaagcaggcagaagaagttggaaagagtagacttgctgagtcttctggccttcatctttgtcctgtgctgaatgcttcctgccctctaaaatcagattccaagttcttcagcttttggactcatggacttacaccaatggttagccaggagctctcaggcctttggccacagactgaaggctgcactgtcagcttccctacttttgaggtttgaggactctgacggatccaccactggcttccttgctcttcatccttcagatgggctatcgtgggactttaccttgtgattgtgtgagtcaattctccttataaactccctttcatatatacatctatcctgttagttttgtccctctgaagaaccttgactaatacagacacctagtgggtcccaataagtgatcattaaactgaaggcagtcattcagtaggtcagtttgtcacttgtgtttgtatctccctgcttacaacaaggtggcctttcttctagtttcctgtcatctgatggaagagattctagactcattcctctagaggagaaatacttcatctagaacagataggtcctaagggtgagagctcatcgttgggatgaatgaacccactgaaattttatgcaagaagaaaattgtgtatatgtatatttttttttctggtctgtagtttttattagattctcagggaatcctgatcctatcatgaagaccttctattctagattgggttcctttcacatccccttctcctttcttgttgaattctccatgcatttctttcacttgcttttcttgctcttatttctctggtagtcagttatcctttttgtctggtggttctatctccttcaaatgaggcacattgctcaaattttattactccaaattccaaggtgctgtttagtgtcctgttgggttgtaagctaggaacagggaggggaaagtaaaacattctgcatgagctgggtgcagcgggcaagcacctggaattccagctactggaagctgaggtgggaggattccctgagcccaagggtttaaggccagcctgggcaacaaagtgagattttgtcttaaaaaaaaaaaaaatcccagctgggctctgtggctcatacctgtaatcccagcactttgggaggcagaggcgggcagatcgcttgaagtcaggagttccagaccagcctggccaacgtggtgaaaccccatctgtactaaaaatacaaaaaaaaaaaaaaaaaagcctggcatggtggtgtggtgtgcactggtaatcccagttatttgggaggctgaggcagcagaatcacttgaatccaggaggcagaggttgcagtgagctgagattgtgccactgcactccatcctggatgacagagtgagactctgtctcaaaaaaaaaaaaaaaaagaaagaaaaaacacgcgcgcacacacacacacatcatgcagacctagccttctgccaatgtcaatggtagagaaacacagtagacacttaattctatgtttcagagaggaggggactcaaatatattaatttgacattgagacagtgatgactttaatgagtactttctttcctttttttttttttttttttcgggacagagtgcagtggtgggattttggctcactgtagcctccacctcctgggttccagcagttctcctgcctcagcctcctgagtagctgggactacaggcatgcactgctgtgcctggctaatttttgtatttttagtagagacggggtttcacactatcagccagactggtctcgaactccggacctcaggtgatctgcccacctcggcctcccaaagtgctgggattacaggcatgagccaccgtgcccggcctaatgagtactttctgattaacctgttgccctctcagattcctgaagcaaaccacagcgttaaaacgtgattcattttgtgtggaccaccacggtgtttaccttcttcttgggtgaagtttggtggaaaagatcttaccccggacatctgtttgttctttgtaactcagagcctcagagaaatcctaactttataatgttgtcaaacccttgtaaggcatgtttttattgtatttgtgttctgatcatgaaactgaaaatgtgtaagaggaagatttcagaagcttggctgtatgtctgagatgacagttcttttactgtcattctcaaatatatataaatattgaagagatcaaataacacaaatcgtgcatgttaagaaaagagactgtgaacctcaccagagaggggtgagcacaattttttttcttttttattcacagggttagcactgtccctttcacataataaatgctcagtaaaataaatggttgttaagccggaaaagggtaacacttctgataatgagtgtcctgggaaatttactaagctgtttagaagatgggaccaacacactgatagaaatagtcagatagtccagaagtctatggcagatgccctgaacatcagatgagatataagacagagaagctctgggtctttgccagctctgacattttatgactctatgaaacggaaggttcctttttagaagggtctataaactgtctcaggctttgggccattttgttgaagatcagaggcaaggaaaagacacaactacacaggaaccatcagggaaagatgttgttttttggtcttgaagcatcattgaatttttttttttttttttgagacggagtttttctcttgttgcccaggctagagtgcaatggcatgatctcggctcactgcaacctccgcctcccaggttcaagtgattctcctgcctcagccttctgagtagctgggattacaggcatgtaccaccaagcccgggtaatttttttgtatgtttagtagagacgaggtttctccatgttggtcaggctagtctccaagtcctgccctcaggtggtccgcccacctctgtctcccaaagtgctgagattacaagcgtgagccaccgcaccgggccgcatcattggattttaaggctccatggattctggcaggtccagcccttctgttttactcacaaacaagtggtttgtccaaagtcacacagagatggtggcaagagatctagaataagaaggtgtcttcaagtcatggagccaggaaccctggctttttgggcaatggaagtggtataaatgtttaatatcacccctcaggttctgccactagagcccagctctctcttccttcctcttgccccctgactagcctatggcctctttccagagaataagaaagggatcctcagagaataatcccagttcctcgctttttattatatagttgaggaaaccaagtctcagaggggtcagtgtcttgaccatacacctctcatgtcctctctcctttttgattaattgaataaatacatgtagttgcttcttacctcctttctttcttcacccctgccccatgcacctgctcttagttgccttcacatgtaaacagcattccaacaacaacaacaaaacacaaccagcattctaactcatgagaccagcaacagttcctataaataccagcagcattttattttaatgtctctctgcagtagtttctcccctccatggatcagtcatccttggtaccaaaaggattccccactgtgacacaaatgctttttgtcattctcagtgagttataccattgagagagcatcgatctttttattgttcaaagcttttggttgtcatgatatttgctggaccatgtttcaccaggaaccacatcacttcctagcagcaggagctattttcttccatcttctaacaacaccagcagtgacagtgataataatgatgttagctgccatggtcgttattcttatcatttattgagtacttactatgtgccagggactacattaagagttttatgtgtattatcacattgagcctcgctagcctttgtacagatgaatctgaggctcagagaggttaagctgctcacaagggagtcacacagctggtaaggggtggatcaggatctcagcctctctgctaggacacttctctaaacctagaataatactgggcctgtgttaagttcagcaaagagctgtattcaacccagtgtccttaggaatgtaatgcctgttattaacaacagtggcaacattgataagctgaaacttatgaggtgcttacaatatgatatactatatattatatacatacataggcacccacctataatctcagcactttaggaggccaagtcaggaggatcacttgagcccaggagttcgagaccagcctgagcagcatagcaagatcctgtctctgtaaaaagtttattttttcagttggccaggtatgttggtacatgcctatagtcccagctaatgaggaggctgaggcaggaggattgcttgagcccaggaatttgaggctgcagtgaactatgatcacaccactgcactccagcctgggtgacagagcaagactgtctctaaaaataaaaataaaaataaaattatttcaactctcaaggttaaataaatactattattattcccatttacagatggagcaactgaggctcaaagacattaaatgcttactgtcttagtctgttttctgttgcttatagcagaacacctgaaactgagtaatttataaagaaaaagcaatttatttcttacagttatggagactggaaagtttaagatcaaggctgcatgagctataatgcacacacactattgcactccaggctgggtgacagggtgagaccccgtgtcaataaataataatataaaataaataaaacaaatttcaacatgagttttggaaggtttgaaatattcaagccagagcatctgtctcataagtggtggacccaggatttgaactaaggcagatctggatctagaacccattttcttgaatcctacgctatttctctaaggtcaagtttgccaaggaaaataaacttgagaatttgaatagagctctctgacatgggaagtcagggtgatccttccttcccctccctgatcttgggttccactatggctgggggaaaacaggagcagaagagatttcaagaaatgagagattggcctagcgccatggttaagacctggacttcagagtcagaggaagctcctccctctatgacagtgagaatgtgggttgaactcactgaacctcagttttctcacctggaaaaagggagtaaaactagtgcctagctcctagggtttgcatcacacacgaaagttggtgaactgaaggaaaaaaacttaaattcttgtgggggagcatgtgatagatgctacaaattctccatgccttatttacctagcttacgtctaagttcacctgcagcttcctcttggtacactcccatctctctacatctctgttggagggcagtctctggcatcacagagtttgctgagccagatgcttaacaacctcggtagcatccctcaaccagtgagctagggagtcagtgtataaataccctggcttccccattgctcagtgggaaaacactgaaatatgttatacagcatcatagaggtgcctcagtaaaattgaatcctagttgttcacataaaacccattcactagtgtaccctttaccaatctctctcttcctcattcctcacttataattccttgcattacctcccaaattaaccattggaccctagtttttgccttggggtctactcggcgctaactcaaggagcggaagttggaagcttagcgggttacaggtttcagcaccctggacagctcccagcacaccgtattgtgctaaaatgttctcttccctccctctgcctccagctggggtggagagggactgagtaaaggccagatggccaggtgaccttgttccatactgagcttcttggccattttccctgtggggctggagaagaccttgccatccatctctccgcaggtttgggggccgactgaggtcttgttttctcgaattgctatgacaaatgccagcctgcctccaaggggcatctgtcccactgcctctacagtttgcatgcctaatgactcctctcctctcaccagggcagggaggtggctgcctggtgggccgcttgaagccgggagaccaagatcatgccactggactcgcaacaaaccgagactcttttttttttttttttttcctcgagacagggtcttgctctgttgcccaggctggagtgcagtggcgcgatcttggctcactgcagcctccgcctcccaggttcaagcactcccacctcagcctcccaagtagctgggattacaggcgcacaccaccatgcctggctaatttttgcatttttagtagagagggggtttcaccatgttggccaggctgatctcgaacttctcccctcaggtgatccactcgccttggcctctcaaagtgctgggattgcagctgtgagccaccatgcctggccaacagaataggactctgtctcaaaaaataattttttttaaacattgctttgcaacccagctgcttcttgtgcaggcatctctaaatgaggacagccagtctacatagacacgtaaggaagcatagtggttaagacctggtctttggggttagagtggattcccaacctgactccactgtttccaagctgtgtgaccttgggcaagttactgtacctccctgaatcttccatttcttcatctggaaaatgagagtagtagcatcccctgacttggtggggcatggtggctgatgcttgtaatccaaacactttgggaagccaaggtgggtgaatcgcttaaacttgggagttcaaggccattctgggcaacatggtgaaactccatctctacaaaaacaaaacaaagcaaaaattatctgggtgtgatagtgtgtgcctgtaattccagctactcaggaggctgaggtgggagaatcacttgagcccaggaggtcaagtctgcagtgagccgtgcttgcaccactgcagtccaacagagcgagaccttgtctcaaacaaacaaaacaaaacacaaaacaacaacaaaatactaccaccttatggagttgttttcaaggttcaatgagttaatgtctgacccatgctgggctgggtttatggatgttacttgcccagggacagtctgaagaaagagaaagtgatatagtccattgggcctcagcttcctcatctgtggaatgggaataataattgcacctacctcaaaaggtaaaagtcagtgagatacatataaggcattcagaacaaaaactggcacagaataagtgctcaattatattagctattgtaagactaataactatcattataatgatgataataattattactacttccccaggcccagttccatagaccagttagttaactgtagggaacgtttgctattattagttgggttcccaatatctgacctccctttccaatttagggagaatcctcccctttctataaagtactgctggtctatgggatcccaccctcactaataagttgaaggtgaaagggattcattgtcaccccatcacctggtagtcagggcatgtgatttaaacaaccagggccaggcgcagtggctcacgcctgtaatcccagcactttgggacgccaaggcaggaggatagcttgagccaagcccaggagtttgagaccagactgggcaacatagtgagacccctatctcttaaaaattttttaattagctgggggtggtagcacaggcttgtagtccccgctactcaggaggctgaggcaggaggattgcttgagcccaggaggtcaaggctgcagtgagccgtgatagtgccactacactccagcccagcctgggcaacagggcaagatcctgtctcaaaaaacaaactaataaaaaactcaaccagtcacgttttcctacccaggaatttgaaaatggaccaagtgatccaaacatgatggtttggactctttcatggcctcctgctacaggagaaggtcaggctggctacattgttcctgctcatttcccaaatcccctcttctggccccctgttgattatctgagtttcctaaaaatcccttttatgcctaagatagccggtcagtgtttggttttgcaatcaagaacccagactgggccaggcacggtggcccacgcctgtaatcccagcactttgggaggccgaggcgggcagatcatgagatcaggagatcgagaccatcctggctaacgtggtgaaaccccgtctctactaaaaatacaaaacaaaaaaaaaaaaattagccaggcatgatggcggtcacctgtagtcccagctactggggaggctgaggcaggagaatggcgtgaacccgggaggcggagcttgcagtgagctgagatggcaccactgcactccagcctgggcgacagaacgagactccgtcaaaaaaaaaaaagaaaaaagaagaacccagaacccagactgatcctgagacaaagatttgagggcaacgaatcacgaggtcaggaaatcgagaccatcctggctaacatggtgaaaccccgtctttattaaaaatacaacaaattagctgagcgtggtggtgggcgcctgtagtcccagctactcgggaggctgaggaaggagaatggcgtgaacctgggaggcggagcttgcaataagccaagatcgcaccactgcactccagcctgggtgacagagcaagactccatctcaaaaaaaaaaaaaaaaaatttgaggacaagtggtttgtttggcaataccaggaaacaggggaacaggatagtcagaaaagaaagagaaagctgggcatggtggctcactcctgtaatctcagcactttgggaggccaaggcaggtggatcacctgaggtcaggagtttgagaccagcctggccaacatggtgaaatcccgtctctgctaaaaatataaaaattagtcgggtgtggtggcgtgcacctataatcaaaataaaataaaatcaggatattttattttaaaactctgtcttagtgtaactcatatttacctcttctgtatgctcctttgcatcagttatatattgccataatacggctgtgtaacaaacaatccccaagacccagtggcttataatgacaagcatttatttagctcatgattctgaagggtggcagtttaggctgggcccagttgggtgctttatctggtctcagttgagctcattcatgcatctttggtcagctgcgggtcagctgggtggctcttctgtttggctgttagctggctgcagactggtccaggatgacctcggctggaatgactgtgctccactccctatggtctttcaccctccagcaggctagcctgagctagttcacatggcagcttttcatcctccagcaggctagcctgagctagttcacgtggcagcaatgggattctaagagaaagaggaagtgttcagccttcttaagggctagtcccaggaatggcacaacatcgtgttggccactgttgtccaaagcaagcaatgaagctggtccagattcaaggaatggggcaacagagcccatctggtatttacctggggccactggggccccattcctgttccctggggccttttgccctgacttctgtgggccctcagagcatattttcagattcctttccatccctgaccctcagcaatcaatgtagatgacgtgtcattactgtgtcacttgcacagagaaaaggaggaaaaaatgtcagcaaaaactctgctgagagcagagggcccatcatacagcaagctggaaagaaaagtgggaatgattacacagcctcctcagatgcttccagcttttatcaaatctcactgtgatatctgagttctgaaccctcacaggtggttggcgtgcaagggaagagatttcttgtctgccatgctgacatgcacagacacgcaacctggctccctctgtccactggggctttggattttgtttgttgaaatgttacccactcctgatcagagctggatggaaacctggctctgattccattggctcaggggctcaggtgggggcagaggccaggctggttgggtgtctatgtggagaccttaactcttctccctcccgccccaactctttttgtttctttttttttttttttttttttttgagatggggtttcactcttgttgcccaggctggagtgcagtggcgtgatcttggctcactgcaacttctgcctcctgggttcaagcaattctcccacctcagcctcctgagtagctgggattacaggagcacgccaccatacctggctaatttttgtatttttagtagagacagggtttcgccatgttggccaggctggtcttgaactcctgacctcaggtgatccaccctcctcagcctcccaaaatgctgggattagaggcgtgagccaccacacctggcccttttcttttcttagctgcctccacctctcttcccttctgcagtgttaggtttatggaaaccgaggccggcgtagagatcaacttcagagagcatgaactgagcatctgctgggtcttagatcctttacatagcttatcatcttcaaaccttctcacagttctgtgtggctagagccaggatttggacacagctctgccccactgtagaaccaggcttccttctgtccactgtcaaattttagagggagaaaatagggaaagggacaccagccttctccacgagcagcttctgcccactcaccccagggactttgcacatgctgtgtgcctgtgtctgagatatgctccctcctctgtatctgcttaattcttacccagacatgatacataaagtatttaacatccaggtggcagggacaccagctaacctgaaaagaggttcccctgttgtgccacatgtgtactcattgtttgctgcattgtgggggcagtccaggggccttgaagaggggccaaggtgccaaaggggcactctcaggcctcaaggaagtacatgtttactgatatgatactgtctcttcctccaggaaggaagccttccctgatctccccactgcatgcccactatgataccagtttaggtcccctctttatggccatctgtggcatcagtgtgaatcctcttaatgttgtctatttggttaatcatctgtctccttcctctggggggtaaagacagaaccacagagcctcgtgtagaacttgagaatggggttcagtaaaaatctgttgaatgcataaatgggtgattgagtgaatgaatgaatgagtgaatgaatgagtgagtggatgaatgaatgagtgaatgaatgagtgagtgaatgaatgaatgagtgaattaatgaatgaattcatagctgataatacaggcttcatggcttttgttaggcttgcccagacattgctaggggatggacagaaggaagaagagctatacttaattccagtcctgttgttctgtagcaggaggagaaaaacagggactgcccagcctgctctgggtggattcaggagcagctgaggttcctctcttatttgcaaacagggaattcaaaaagccccaacctcagaatcacactcgcctcagcagctgtaccagccaaggggacaatgtgggaagccttgggcaccaggaatgctgagtgcttcgaaaaagcgaaggctcagggaacaatccctgatttttcattcccttgtcctttctgaagaaacaggcaaaggcaggccaggcacggtggctcacacctgtaatcccaacactttaggaggccgaggctggtgaatcacttgaggtcaggagttcaagaccagcgtagccaacatcatgaaatcccatctctactaaaaatacaaaaattagctgggtttggtggtgcatccctgtaatctcagctactcgggaggctgaggcatgagaatcacctgaactggggaggtggaggttgcagtgagctgagtctgcgccactgcactccagcctggatgacagagtgagactccatcttaaaacaaaacaaaacaaaaacaagtaaagccttgtgtgtttttaaattgtaggttcagcagcaaagctctgtaataaggagctggaccctgcagtcagacagtcatgggcttctccagtgcccagccgagtgacccgagggagttatgataaacaccaacattcatccacaatttgtacctagtgctattctcaatatcttgagtaaattatctcatttaatcctccaggcacatctttcttggtaggtgccgtcattgtccccagtgtacatctgggaaaatgaggacaggctggcagagcacccttcctgctcacctctgctgctctgctgacctctggcaagactgttgtctctctgagcctcagtttccccatctgaaaattggggcctgtattagcccgttctcacattgctataacgagatgcttggctggggctgggcgtgatggcttatgcttgtaatcccagcactttgggaggctgagttgggcagattgggagtgtgagaccagcttgggcaatatagcaagaccccatctcttctaaaaaaaaaaaaaaattagccaggcatggtgatatgcacctgtaattccagctacccaggaggctgaggcaggagaattgcttgaacccaggaggcagaggttgcagtgagccaagattgcgccactgcactccagcctgggagacagagtgagactccatctcaaaaaacaaattatttttaaaaaattaaaaaaaaaaatgcctggctgggcacagtggctcacacccataatcccagtactttgggaggccaaggtgggaagattgcttgagcccaggagttccagaccagcctgggcaacacagtgaaatcctgtctctactaaaagtacaaaaattagccaggtgtggtggcacgcgcctgtggtcccagctactcaggagggtgaggtgggaggattgcttaagcctgggaggtcaaggctgcagtgagcaatgattatgccactgcactccagcctgggcgacagagtgagaccttgtaaaaataataataataataataaataaataaaaaccctgagactggggtaatttataaagaaaagaggtttaattgactcacgattctgcaggctctacagaaagcatggcagcatctgctcagcttctgggaaggcctcaggaaacttacaatcatggcagaaggtaaagctggagcaggtgtcctcacatggccagaacaggaggaagagagagagtggggagatgctacacacctttaaatgtccaatctcacaagaactcactcacgatctcgagaatagcaccaaggcggaaatctgcccccatgatccaattaccttccaccaggccccacctccaacattggggattacaattcgccataagatttggttgcggacagacacagatccaaagtacattaaaagtaatggcaaaaaccacaattacttttgcaccaacctaatatctcaggggctcattgtacctatttcacaggacaaatgaaggtatcagtaataacagtagcctgtagtcccagctattcaggaggccgagacaggaggatcacttgaacccaggaggtcgaggctgcagtgagctatgatcacgccactgcactgcaccctgggtgacagggcgaaaacttatctctaaaaataataataacaacaacaatagtgaacacagatataacatgtgtgtggccaggctgtgcccttagggctttgcagggattatttcattcactctcaatctccccattttacagatgagaaaactgacgttcagaaaagctagaggacttgccccaagccacacggctaggaagtggtggaattggggtttaaatgaggaagcttgacttcagtgtcgaagctcttaactgccacactcaatacatggagtagaggttgctgattctgtgattatctgattctggaaagtaaagaccctgtttccagacgtttgctgcttgacttagttcccaggggatggccactggatgatgcagtgttgcccaggagaggttagctagacacactgcaaccattccattgctaatacttatacttgctcttgttctgctgggtgctatgcagggaagggctgtctgagccctttgcaagaattctcccattggtgcctcccagagattctgaggttggggctttttgcatcccttattagcagatgagacaccaaagcccaggtcaataatctgacctgcatcccccgcctaccagccagaccaaggtcacttccccacaatgcaggccctgatccaaggctctgggtgcaaaccagtttccatgtccctgggggtccatcttcttcagctgactttttttttttttttttttttttgagacagcgtcttgctttgttgccgaggctggagtgcagtggtgtgatcatggcttattgcagccttgacctcccaggctcaagcaatcctcccacgtcagcctcctgagtagctaggactatgggcacacgccatgatgcctgggtaattttttttttttttttttgagacagagtctcgcactgtagcccaggctggagtgcagtggcgcaatctcggctcactgcaagccccatctcccaggttcatgccattctcctgcctcagcctctcgagtagctgggattacaggtgcctgctacctcgcctggctaattttttgtatttttagtagagacggggtttcaccgtgttagccaggatggtctccatctcctgacttcgtgatccgcccacctcagcctcccaaagcgctgggattacaggcatgagccagatgcctggctaatttttaagtttttttataaaggcggggtcttgctatgttgcccaagctggtctcaaactcctggcctcaaaaagtcttcctgcctcagcctcccaaagtgctaggattacagacatgagccactgcacccagcctgactttttttctaactgaaaaattaattatatatattcatggagtacaatgggatgttctgatatatgtttacatttttgaatgattaaatcaagccaattaacatatccactacatcgcatacttattttttgtggtgagaacgcttaaaatctactcttttagcaattttgaaatatacaataccttatgttgtatattacattatgttgtatagtacgttgaaacatacactacaatacgttatcattaattgtggtcaccatgctgtgcaaaagatctctaaaacgtattcctcctgtctgactgaaactttgtatcctttgcctaatatctccccaatccctccaccaccagcccctggtaaccaccattctctctgcttccatgggttcaaattttttattttttgaaatttttaatttttatttatttatttatttatttatttatttatttttgagatggagtctcgctctgtcacccagtctggagtgcaatggtgccatcttggctcactgcaacctccgcctcctgggttcaagcgattctccagcctcagcctcccgagtagctggggttacaggtgcttgccaccaggcccggctaatttttgtatttttagtagagacggtgtttcaccatgttggctaggctggtctggaactcctgacctccagtgatccacccacctcggcctcccaaagtgctgagattacaagcgttgagccactgcacctggcctaaaattttttttttttttttttttttgagacggagtctcactctgttgctaggctggagtgcagtggcatgatctcagcccactgcaacctcagcctcccgggttcaagcgattctcctgcctcagcctcctgagtagctgggactagaggtgtgcaccaccacgcccagctaatttttgtatttttagtagggacagggtttcaccatgttggccaggatggtgtcaatctcttgacctcgtgatctgcctgcctcgggcttccaaagtgatgggattatgggccaccacgcccggcctcaaattttttagagctcacatataagcgagattgtgtactatttgcgtttctgtgtctggcttgtttcatcttagtataatgtcctccaggttcatgcacgttgtcgcaaaagatggaatttgctcctttttaaagactgaatagtacttcattgtgtacatatacacgccatattttcttcatccattcctttactgatggacatttgggttgtacctgcatcttggctattgtgaagagtgctgtcatgaacatgggtgtgcagctgactctgaggtgttagagggattacagctcctccaaaagaccaccgtcacccaaacctgctcctcctgccctattttctgtttaggtaaaggcggctttaaccccctgcagtgctctggcctcagacctccagatcttcctctatgcctctatgcctctttttctccaccccctgcatccaatctgttagcacatcttattggctctaccttcagaatctacccagaatccaccacccacctctcaccaccttcacagccccaccctggtccagcccccatctttgctggcctggactaaaccagttgcccctccaccccaatctggtctcttaacttcagtccttgccccacccccaggactgttccccacacagcagccagagggcacctgtgagccactgagtcaggacctggctcctctttgctcacaacctcacttggagaaaaagcccaaattctcctcacagggacccacaaactctgcccctgtgatcccccatccccctctattcccactctcctctccactcactcggcttcagctacacaagttccctgctgtcccttacacaccaagcactccccagcctcagggcctttgcacaggctgttccctctgcctggaacactcttcccccagatatctgcttggctcccccctcacttcctttgggtctttgctcaagtgtccttctaacatgtaactgcctcacctgcactgtgccaccccactccccgcctctaggcttaatttccctctacacccctgaagagcatctgccaagctatatttacttgtttattggttattgccaatcccctgcccccactagaatgccagctccatgagggcagggacttctgtctgttttgttcactgctattcccccagagcctagaacacagcctggcacatagtaagtattcactaaataatttgtaatatgaattgtgccagtaaaatcttccaggggcatcaagcccctgccatgactaggtggtaacatcctcaccccctgtccatgtgctatctcctcctgacctgcttgtctcattgttctaatggtggctcacgcctgtaatcccagcacttggggaggccgaggcgggcagatacctgagttcaggagtttgagaccagcctggccaacatgatgaaaccctgtctctactaaaaatacaaaaattagctgggcgtggcattgcacgcctgtagtcctagctactcgagaggctgaggcaggagaatcgcttgaacccgggaggtggaggttgcagtgagctgagatcatgccattgcaatccagcctgggccacaagagcgaaactctgtctcaaaaaatatatatatatatttcattgtggtaacatatgcataacataaaatgtaccattttttaagtgtttagttgagcggcgttaagtacattcatattgttgtgcaaccaggaccgccatccatctccagaacttttgcatcttgcaaaactgaagctctgcccccaggaaactctcactccccgctcccccttcccctctccccgactcccccttcccccctccccactccccccaccctactccacactccccactcccccagcccctggcacccgccgttctagtttctatctctgtgaatttggctactttgggtcccccctgtgagtagaatcatacagtatttgtctttttgtgactggtttgtttcgtggagcataatgtcctccagtctcatccatattgtagcatgagtcagaatttccttcttttccaggccgaatcgtattccattgtgtggatggaccacactttgcttatctgttcatccagatgggcacttggcttccaccttttggctattgtaaataatgctgctgtaaacctgtgtgtacaaatagctgagtccctgctttcaattcttttggatatagacccagaagtggaattttttttaaatcaagatttgacccactggggcccttagaggtctcattggctctgaagcttttttttttttttttttttggacgctttgaaactaaaaataggagtgaggggcacagtgaggggggcacacatctctcgtgtcagcgttttttaaaaacaccccgggaggaagatgtgtgaaatccctcccttccccccgctcccaccccctccaagatctcaaaatacctcttgttttaggaagcggctgtgacatcaggcaggcagcgtgtggcatctgagacacaatatcgcaagtggctgggagcccagagaaaccaggacaggcgtgctggggatgtggactagagatggagctaattttagtggctgaagaggctgcaagaagagagagaaagaggggtgtgtgtgtgtgtgtgtgtgtgtgtgtgtgtacgcacagtgatagaggctggagggggagaaatgacagataaatcagcttgggcaaagaaagctaatgggcagaggagcgagacccagctcagaaggtggtcagcaaatctaaagatgtgtgcccgagggtcaaggtggtggggggattcataggcaagtggtagagaggctattccatttgcagaggctctctctgtttgaggcgtgattcacctgtgccgtcctcaaggccattctgagaacaccactgttgttttcctccttttatgagtagggaaactgaggcattgaactgcttctattcttcagtaagaagcagggggaacatatggtagaagcaaagaaatacaaacatgagggctctcggggtctacgtgattggctgtgacatccatgagagcggatcgcaggttgaaggaaacactggtggcagaaagtagctgaacatttggatttgggaatcccagtggacgtggcgaaaattctggcttttcccttcacaggctgcggggccactctgacctgcggtttccttatctgtgaaatggaacgatgccacctgtctcagcgttgttttgaggatgcgaggagatgatccgtgtaatatgcccactagggggcctgctccagggtagattctcagcaaatggtagtcatggtttttgttacatttggggatattggcaggtaaaaaggaaatacttcattcattccaaaattgctcactgaggttctactatgtgctaggccctgatgacacatcggtcaacaagacaggcctgctttctgcccttgtaaaacttcagttcaactgcattgcactcatcagcctaataatccaggtaaattgtgatgagaataacaactagcatttactatgagccctttacaaatattaacccatttaatcttctaaagagcctataagataagagctcttgccctgcgcagtggctcacgcctataatcccagcacgtcgtgaggccaaggcaggtggatcacctgaggtcaggagttcaagaatagcctgaccaacagggtgaaaccctgtctctgctaataatacaaaaattagccaggcatggtggcaggtgcctgtaatcccagctacttggctgaggtaggagaatcgcttgaacccaggaggcggaggttgcagtgagtcgagatcactccactgcactccaagagtgaaactctgtcacacacacaaaaaaaaacaacctgttattatccacattttacctatgaggaaaccgatgcccagagaggttaagtaactgtccaaaggtcacacagctacggagtggtagagctgggattcagacccaggagtgtgatcccagagtgtgtgtgtatgtttgtttgtttgtttgtttgtttgtttgtttttaccactgtgttttcctgcttctgcaatagaagtaatcaccagtcacactgagcagttgttatgtgccatgcccttaacacacatctccttggatctttggaaagaatcctaaaagggttgtttttcatgatccacattttatggagagagagagatcaaagcatagagagaggaagtaacttgcccaagatcctgcagctgaagactctagggttgcaaatttgggacggccctggaccctgcattccagcttctagcagctcatagggggaactctttatttatttatttatttatttatttatttatttatttatttatttattttgagatggagtttcgctcttcttgcccagcctggaatgcaatggcatgatctcggctcactgcaacctccacctcctgggttcaagtgattctcctgcctcagcctcctgagtagctgagattacaggcatatgccaccacgcctggctaatttaattttttttagtagagacggggtttctccatgttggtcaggctggtctcgaactcctgacctcaggtgatccgcccatctcggccccccaaagtgctaggaatacaggcctgagccaccacgcatgccctgggggggaccacttttatcggtgcatttcttccattttccctgtgtctgtgtaaagataaacacccccaagccccttgactatgaactgtgggccataattagttaatggaaggtaaatgttttagagacggaaattgctgtgccatttttccccgctaggcattgttgcctgcatgctaatgcaacacaatgtgcctttcttctgtcaggcatttttagacaaattctattttccctaaaatattttgccaaagaaaatagcaagtggggaagacattcagaggctcaggcagagagaggacaccattcccttgggtttaaacagaatggcagagtggataacagcacagatcttgagttaggtggatgccaatttgtgatttatttcccagcaaaccaagatgctggctctctgtgtgcctcagtttacttatttgtcaaatgaggagaataatggtacctgtctctcaccagcttaccagttgcctctttagctatgtctaatctgctattaaccacgcccactatgtctttaattccaagtattagaattgttttcttcctacaagctgtctgatcttttttaatcctgcttcatcttttgcagtattgttttcctacagcaggatttctcaaccttggcacaattgacattttgggctaggtaattcttggccgtgagctaccaccctgtgctaagatacttagagcatccctggcctctcaccctactaaatgccagtagcagcccctccccagttgtggcagccaaaaatggctcagacattgccaaacgaaatgtcccatggagggtagaaacgcccccacttgagaattgttctataggtattttcaagcatgtcttacatttctttaagtataatatgcaaaagaaaaggctaaatctaaaaaaagcccataatatgcgaagaatttttataatcagtgtccaataacttaagtatctaaaattgttatggctttttttctgctgtctcttgtttcctgtgattcctcattctggtgccttgttttcttgaatgtcttgttatctttggttgtgtgaagctcattttccatgggacactattttttgttttgttttgttttgagacagagtctcgcttggttgcccaggctggagtgcagtggtgcaatatcagttcactacaacctcagcctcccaggcccaaatgattctcctgcctcagcctcctgagtagctgggattacaggcgtgtgccaccacacccagctaatttttttgtatttttagtagaggcagggtttcaccacgttggccaggctggttttgaactcctgacctcaagtgatcaacccgcctcggccccccaaagtgctgggattacaggtgtgagccaccgtgcccggcatccatgggacactgttgaagggagttcattgaggcctgcgatgaaggcgaaccctccatggacaatttgcatttactttttccaggtgtctgggaaactcccagtctaggaccatcttagacttttagaccaacaatgtgttgagaatttaggtcaccagtgtctgcaaaagccagcttgtggttataatttctcaaaaacttttgtttttctccttttctgcaaagtgccaaagtaacttcctcaaaaatctctgggaatggaaagacgggagtaaattaacttcaggtttcttacctgaaagtgatagcctattggggccccatcctacttggggagtggtgtgtctcctttgagactttctaacacgtgtgtaccctggactttgccccacccctgctccctaggaggccataaaacttgaagcagcagttccatgggttagacagatgcccttggggcaaaagtggttttaatgctctggtagatgctcaggttacctctgggaaattcttgacttcacttatttatttggggctgataactactaattgtcaggcctttcttgtttcaacaacatggacttcagattttatgcaggatttgtcatcgttttcagcaagagagtcagtcttattacccagcttactgcattagaaatagatgtctgggccaggcgcagtggctcacacctgtaatcccagctgtttgggaggctaaggtgggcggatcatgaggtcaggagttcgagaccagcctggccaacatggtaaaaccccatctatactaaagatagaaaaaattagctgggtgtggtggtgcgtgcctgtaatcccagctacttgggaggctgaggcaggagaattgcttgaacccgggaggcagaggttgcagtgagccaagatcgcaccactgcactccagcctgggtgacaggacgagactctgtctcaaaaaaagaaatagatgtctgttgtgtggattatttaaaagagtagatggccaagaactatgacttatgcctgtcatctcagcactttgagaggctaaggtggagggatcacttgaggccatgagttagagaccagcctgggaaacatagcaagacccccatctctgcaaaagtaaaataaaataagttagtgtgcatgatggtgcaggcatacctctagtcctagctactcaggaggctgaggcaggaggatcacttgagcctaggagtttgaggctacagtgatctatgatcatgccactgcactccagcctgggtgacagatcaagaccctgcctctaaaacataaaaataaatacaaattaagttaaaaaataaaataaataagtaatagaacatccagcacagttcttggcatgcattgactgttgttgtttgtttgtttgtttgtttgtgacggagtctcactcttgttgcccaggctggagtgcaatggcatgatcttggctcatcataacttccacctcccaggttcaggtgattctcctacttcagcctcctgagtagctgggattacaggcacgtgccaccactcctagctgttttgttttgtttgtttgtttgttttgtatttttagtagagatggggtttctccaagttggtcaggctggtctcaaactcctgacctcaggcgatctgccagcctcggcctcccaaagtgctgagattacagacgtaagccaccacgcctggccagctgttttgattgttaaatgaaggtggtatgaaagggaaggaagaacagtgacatttgcaagggacactccctggagggcagggcaagggggctgtggaggggagaagtcagagagtatgatacaggttgccttgggtgatgttttagattttagccaacattggcaaagagcctcatttatctctcagagtagctctggctactggaaatgctgcacaacttcaggcggactttctagaagaaaactcttggccaggtgcagtgactcacacctgtaatcccaacactttgggaggctgaggcaggtggatcacttgagctcaagagtttgagaccagactgggcaacgtggcaaaacctcatctctacaaaaaaaaatacaaaaattaaccaggcgtggtggtgcatgcctgtatcccagctacttgggaggctgaggtgggaggattgcttgagcctggggaggtggaggtggtagtgagccaagattgcaccactgcactcccatttgagtgacagagcaagaccttgtctcaaaaaagaaaaaaagaaaagaaaagaaaagaaaattctctctgggattcaatcctggcccacacagcattggcttcacttcacctccttctcccctgagatacacagcaccattcccccaagcttcatcaacttaatctctgatctgggtgctgtgacttgtccccattcctggccagaatttaaggtagggatgaacccactagccctccatcacgcactctgccataaaagcacaccacgtgctgattgctgtctttggtctcctttctgccttgccctctagactctgagctgcttggagacagaggccagttttgtccatctccaaatcccctaaagtcctgtggccagcaagcaggtaggacatctgaaagttcgtcagagagggaattgcttttctcttgagatgcaactagaacaagaatcttattgacctggagtagcttcaaggttgtaagagtatgtgtcagggttctccaagaccactctcaggtttgaaggtttgctaaaagggctcacgggacccagaaaagctgtgaaattcagttatggtttattacagtggaagaatacagataatacagattaaaatctgcaaagcaaaagatgcacaaggcaatgtccaggggagatcaggcatgagcttccagctgttcactcccagtggagttatgcaaacagtgctcaattctcccagcaatggtgtgtgacaatgtacagtgtaccgccaaccagagaagctcacctgagccttggtgtccagggtttttattggggctcagttacattgacatggagcacccatgtgactgactttaactgctgggtctccagcacactccaagatcaaactgataccgtgtgtcccagggccccagctgaacacaaacaggcagtcaccatagatcccattgtgagcataagctaccaggcatggcccaaagccctagatatacagatattctttccaggagccagccaagggccagtccttcctttggaatatgcagagtttgaactccccaaccccaaggagttaactctttactacacagaatataaatctcaccaagtctttcttcttgtcaagtcctctcaaggtgacccattgcttttagcagtgtctttgagaccctgcgtcatctggccttgacccatatcacctgtgttatctctccactctagctacattgaacttttcttttttgagatgtggtctcactccatcacccaggctgaagtgcagtggtacagtcacagctcactgcagcctcaaactcctgggctcaagtgatcctcccacctcagcctcctgagtagctgagcccacaggtgcatgccattacacccagctaatatttttatttttagtaaagatgggttctcactatgtttcccaggttggtctcaaactcctgggctcaagcagtcctcccatcttggcctcccaaagtattggcattacaggggttagccaccacatccagcccattgaactttttaaggatcccctagcatcctatactttctgtcactggatagccttggaattatttttccttctttttgaaatactcttcttctttccaccctttgctgtcaagtctcagaataggcattatttcctccaaaaaccctctcctgaccctccaaatctggatgaggacacttcctttgcccagagagcgcctgttttaatcctctcaggtggctataataaaataccttaaactgggtggcttatacacctcagaaatttattttccacagttctggaggctgggaagatcaaggcactgacagatttggtgtctgatgaggggccatttcttgtttcatagaaggggtcttcctactgcatctttacatggtgaaaagagttgaggcagctctctgaaacctctttcatgagagcatgaatccctctgtcttcatgatctaatcacctcccaaaggccccacttcctaatatcttcacattggtgactaggtttcaacatatgaatttgagaaagacacagacattcagaccatagcagtgctcttccaccaggttttttatccccctgtattataattgaggtttaaattatctgctttccttcccttagattgtaagctccatgagagcagggccctacccatccagtcattgtcctatcccccatgactacaacttcctgggtacataattaatatttattatattatgtagcaaaggtatgctgccatactaagagacccaaaaggccaccggattaaaaccttaaagaaaaaaaaataatttctctcctataatagctgcaaggttagccatgcaggttggcagggaagctcacttccacaaagtcactcagggattcaggctcctgttgccctcttcttttctaccaccaaatgatcttcagcaccatttgcacaatcaaaacttaactggtcttgaataggcagaccttgaatttctgaagtctcagacccaaaagtggcagctgtcacttccactgacatatcactgatggaaacttaatcatgtgatcataccaaactgctagggatgctgggaaatgtagttttgttgggaactccatgacttggctaaaattccattactgtagaagatggtgggggatgggggagtggtggacatccagtggttgctaccatatttattgaatcaaattgtcaaacaggacctatctgataaggggttcttttccagaattaactgaattattaaatcaggggcaaaggcatgtcacctcatctttctctccctatattggctttctagggctgttataacagagtaacatgaacttggcggcttaaaacaacagaaatttattttctcttagttctggaggctagaagcctaaaatcaaggtgtcagcagagccaccttgacaactgctctaggaaagaattcttccttgcctcttctggtggctcctggcaacccttggtattctttgtctggcatccacttcaatctctgcctccatcttcatttgccttttttctctgtgtgtctatgtcctttcctcttcttagaaggataccagtcattgaatttagggcttactctaaatccaggatgatctcacctcaagatccttaattagttacatctgcaaagagcttatttcaaaacaagattgcattctgaggtttcggtaaacacgaatttgggggaaatagtattcaactcaattcactgctttacttaagaaaagagaccatgaagtgagcctccttctgcttgagagagagagcgagcctttctgtgcaataggtcaatgaatggatgcagctgaattccacataactttataaaaatagatggccagcccatggggtttgctgacccctgcccaaaaattccaaagtcaacagcagtctcttttttaatcatttctctattttttaatttatttttatttttatgttgagatagagtcccgctctgtcgcccaggctggagtgtagtagtctcggctcactgcaacctctaccttccagatacaagtgattctcctgcctcagtctcctgagtggctaggagtacaggtgtccgccaccatacccagctaatttttgtatttttaatagaaacagggtttcaccatgttggccaggctggtctcgaactcctgacctcaagtggtccacccacctcggcctcccaaagtgctgggattacaggcatgagccaccatgcccggccaggattttcttcattttaacagcattcttacttgtcccacatccattctatcctgggtctaattagataacaaaatctacagatcttgtttaactgacattgtcctgggggatactttttatcttttgagacaaggtctcactctgttacccaggctggagtgcagtggcctgataacagctcactgcagcctcgaccacctgggttcaagcgatcctcccacctcagcctccagagtagctggaaccacagatgcatgccaccacacctggctaatttttaaatttcttgtagaggtggggtctccctatgttaccaaaggctggtctcaaactcctgggctcaaaagagcctcccaccttaacctcccaaagtgctgggattacagatatgagccactgtttccagccttggaaatatagtctaagaactgagtcaataggcgattttgtcattgtgtggacatcatgtagagaacttaacacaaacctagatggtataaactactgcacacctcagttatggggcataccctattgcacctaggctgcaaacctgcacagcaggttactgtcttgaatactgtaggcagttgtaacacaatggtaagtatttgtgtatctaaacatatctaggccgggcacggtggctcacgcctgtaattccagatcacctgaggtcaggagttcgagcccagcctggccaacatggcgaaactccttctttactgaaaaatgcaaaaattagccaggtgtggtggcaggcacctgtaatcccagctattcgggaggctgaggcaggagaatcgcttgaacctgggaggtggaggttgcagtgagctgagatcatgccactgcactccagcctgggtgacagagcaaaactccatctcaaaaaaataaaaaataaaaaacatatctaaacagaaaaggtacagtaaaaatacagttataaccatatgggaccaccattgtataggcagtccgctgttgatcaaaacatatcaaaacatcgttatgtagcacatgactgtaccataaaccacacggcttcaaacaagggaaatgtattctctcactgttttggaggccataggtctgaaatcgaggtgtcaccagggtccctccaaaggatccgggggaggatccttccattggatttggagttgcttcactccagtctctgcctcagtggtgacagggcgttctcctcttccctctcaaagttccctcttctgctgtgtcataaggatacatatgactgcatttaggccccactcagaaaatccaggaataaactcttgccctcatattcttaactaaatcgtacctgcataccttattttttctaaataaggtagcattccagggattaggacatcaacataacttctggagggttcactgttcaacccactacagccagaatgcgctttgaattcaggttctgacatctgggactgcctcccacgtacacacaccactaccttgtactgaatgcctgaagggttctgcccccacctccactcccccaaatatttgctgtggacctgagaaagctgacttcatggaagcttcattccattgttctaaggacttttcatacattaacaaatgtcttctctctatggggaaaaccacagagaaatcaagacagagtggggttaagtaactcacctgaggaggaacagtaagtggcagagccaggattcaaaccaacatggttttgcacagttttgacatcatttgcaacacaaatattgtcacagatacctttttgagcatctactgtgctaaccgccaggaaggaaaagaacatggggccgggagagctcttgacaggggacagggctggccatggaggtctgtgtcttggtggaagatgctatggttctctttttttttttttttttttgagatggagtcttgctctgtcacccaggctggagtgcagtagtgcaatcttagctcacagcaacctccacctcccgggttcaagcgattctcctgcctcagcctcccaaatatctgggattataggcacacaccaccacgcccagctaatttttgtatttttagtagagatggggtttcaccatgtgggccaggctggtctcgatctcctgaccttgttgtgatccacccgcctcggtctcccaaagtgctgggattacaggcatgagccaccacactgggcaactatggttctcttttaactccttgtgctgaaattattgcagaagcccaggccagttcatccccagaaagtgaggcataaacaggcagagctctacagaaacagagaatccacgactggtttgatggaggctgcctcactacctacagaatgggctctgggtggattgttctatctggggagccagcccacccaccagtctcagcccttggcgactctttcctgctgtcacagcagctggacattcagaaaccgaaacatgacagccttccctccctgttcctgcccagtggagtggaaacccctcgggacccacataccgagcgtgcacagcagcacagagttgcacagttaacacagcgcttcttctccagccctccggatgcaagctgacagattggcagctggctgacttccaaggtccagtgagttcttggcagtcgctttctgacctggacgagtggctgccacctcctggaacatcaggctgcccccttggggagagggtgacggtctctctggaaagactgtgagctttgaggtggtcatcaaaagccattcttggaaacattctttgagctgtaccgtgcaattcggtcaccaattgcacgtatttggatattaatatccgtatgtggatattaaattggttttgggttttgttttgttttgattgtggcaaaatatacacaacaatcctcctgcctcagcctcccaagtagctacaggcatgcaccaccatacccagctaatttttggattttttaaatttgtttgtttgtttttgttttttgagatggagtgtagcactgttgcctgggctggagtgcagtggcgcgatctcagctcactgccacctccgcctcctggattcaagtgattctcttgcctcagcctcctgagtagctgggattacaggcgcccgccaacacgcccagctaattttttgtatttttagtagagatgaggttttaccatgtcggccaggcttgtctcgaactcctgaccttgtgatccacctgcctcagcctcccaaagtgctgggattacaggtgtgagccaccgcgcccggccgatttttgtagttttagtagagacagggtttcaccatgttggctaggctggtcccgaattcctgatctcaggtgatccaccgcctcggcctcccgaagtgctaggattacaggcatgagccaccgcacacagcctaaatgctgtgcctcacgcctgtaatcccaacactttggtaagctgaggccagaggattgcttgagcccaggagtttgagaccagcctgggcaacatagggagaccccatctctataaaaaataaaaataaattagccaggcgtggtggtgcaggcctgtggtcccagctactcgggaggatgaggcaggaggatcgcttgagcccaagaggtcaaggctgcagtgagctgtgattgtgccactgcactccagcatgggtgaaagagcaagaccttgtctcaaaaaaaattaagcgaaatttaaaattctgtttctcactcacacaggctgcacttcaagtgcttaatcatcccttgtgggtggtggctatcatattggacagcatggatagagaatatttttatcagcgtaggaagcttcatcagagaggaccgctcagaggcctgtggggaccagcacagtgcagtagaagacacaggccagctggtgagagactggtcttctgatcccagatctgtccctcacttgctaggtgaccttggacagctccctcagtccctctggagttttctcttcattgttaaatcaggaaattggcctcagtgaattctgaggccccatctacttttttttttttttttttttttttttttttaattgagacagagtctcgctctgttgaccaggctggagtgcagtggcatgatcttggctcactgtaacctccgcctcccaggttcaagcaattctctgcctcatcctccccagtagctgggactacaggcgtgcaccaccatgcctgggtaatttttgtgttttcagtagagaccgggttttgccatgttggccaggctggtctcaaactcccaaccttgagtgatcctcccgcctcggcctcccaaagtgctgggattacaggtgtgagccaccacgcctggcctcatctagttctaaatgttatgacccactcagctctgaagacaagggaggaacatcctctcagtctagctctgacatgcagaagcctctcaccctgtcccccaggtcataaaggcaggcgtgttgtgaagagcacagaatgggctgagaaaaatatgcagggattgcgtctatctcccttccttccgcacgtttccttgtcggcaccacctgcctctattccgcgccgcacacacacccgccttctctctgtctcggaggaagacaggatcttccatcccccaaatcctgccctgattcctactctgaagcctctgccctgactcctttaagctccctgggaatacagcccatctcctatgccctcctcatcccagtagttcctaccttccccaaaatcgctttgggaaagtcccccaatgagtaaccagctgtcctacatgggcatctcagaacttctcttctgttgttgttgttgtttgttttgcttttgttttgagacaggatctctctttttcacccaggctcgagtgcagaggtgtgatctcagctcactgtagccttgacctcccaggctcaggcgatcctcccccctcagcctctggaatagctgggactacaggcacacgccaccacacccgggcaaattttttttaggacttttggtagaaatggagtttcgccgtgttgcccaggctggtctctaactcctgggctcaagcgatccgcccactttggtctctcaaagtgctgggactacagacatgagccaccacacccggcagagcttctatttcttgagtgtgttctcagccatgctaagacattttctcttctcagcctgatgatgcttttggcttgtgtttctttgtttttaattaccccttcccagtcgctgtcatgggatcatgagggtcttctgtccatctagatgacacctttcttgtgccacgtgtctccaacattccctggtttttaaacccttattgctttcaagatactatccaagctccttaatgtggcacattgtccttcgctgctatctgcctgctttttttttgagacagagcctcgctctattgcctaggctggagtgcagtggcgcaatcacagcttactctgcagcctcgacttcttgggctcaagcaatcctcctgcctcagccttctgagtagctgggaccacaggcatgcaccatcatgcttggctaatttatttttatttatttttatagagaaggagtctccctatgttgcccaggctggtctcaaactcccggactcaaagttcattgcagtttcaattttttccttggctcaaggatcctcccacttcagcctcctgagtagctgggactacagacgggcaccaacacacctggctaatttttgtattttttgtagagatggggtcccactatgttgcccaggcttctatctgcttttatctcaccttccactcttccatccttcctttcttttcttttatttcctttcccttcccttgccttccttttctttctttctttctttctttctttctttctttctttctttctttcttgacagagtctggctctgtcacccagactgaagtgcaatggcaagatcttagctcactgcaacctccacctcctgggttcaagcaattctcctgtctcagcctcccgagtagctgagattacaggtacctggcaccacacccggcaattttttttttttttttagtagagacggggtttcgctatgttggccgggctggtcttgaactcctgacctcaggtgatcctcccacctcagcctcccaaagtgttgggattaacaggtgtgagccactgtgcctggccttttttttttttttttttttttttaagacaggaccttgctctgtcactcaggccagagtgcagtggcactataatcactttctgcagccgtgacctcctgggctcaagggatcctcttgccttggcctccctagtagctgggactacaggcatgtgccaccacactggctaatttttaaaactttttgtaggccgggcacggtggctcacacctgtaatcccagcactttgggaggccaaggcgggcggatcacgaggtcagcagattgagaccatcctgcttaacacagtgaaaccccatctctactgaaaatacaaaacattagccaggtatggcttacgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaacatagtgagacccctgtctctacaaaaaaaaatttttaaattagccaggcagggtgatgtgtccctgtaatcccagctactcaggacagtgaagcaggaggatcatttgagcccagaaagttgaggctgtagtgagctgtagttgcaccattgtgcttcagcctgggagacaaagtgagaccctgtctcaaaaaggagaatggggagagagagagagagagagaaggagaaagagagagaaagagagagagggaagtcaaggagaaccccacattttttgacatggtgtattagtctcttctcacactgctaataaagacatacctgagactgggtaatttataaaggaaagaggtttaatgcactcacagttccacatggctggggaggcctcacaaccatggcagaaggcaaaggagaagtaaaggcatgtcttacatggcagcaggcaagagagcttgtgccatttataaaaccatcagatctcatgagacttattcactaccacaagaacagtatgggggaaactgcccccatgattcagttatctccacctggcgccgcccttgacacgtggggattattacaattcaagttgagatttgggtgggaacacagccaaaccctatcacatgggcaagtgaaaggatgggtttgccatcaaataaaatggggaaggagactgactaggtgggcagattaggaactcagctttctatgaagtgcctactgatggatagagatattgtgttggccatctattaggttggtgcaaaagtaattgcggttttgccattaaaagtaatggcaaaggaaataacctttgcaccagcctaataggaattggagtctaaaattcaaaaaaggtaagtcagagctggagatccaaaggcaggagtcagcctcctgtggaggctatttaaggaactgaataagggcatagatgcaggagagcacccaggactgagcccagggcttactctccatcattaaagaggttggggaagatgaggaggagccagcagagaagactgaattggagcaaatcagaagaatgtgggtgctggctgtcatgcaaggaaagtgctaagccatttcaagtatgagggaatgatcaatgatgtccactgatgctgatgtgttgactcaaatgaaaaatgagaatcaaccattggatgtagtggcatggagatctttcgtgacctgagccagagctgcttaggtgaagaggtgaaggcaagaggctactggaaggattactactagctcttttaaagagttctgctgtgaagggtagaggaagagagatggggcatgtgttagctggtgggggaagtggatttcagaggtttgtttcccttaaaaaaaaaaaaaaaaagaaaaaagaataaagaaaaaaaaaaggccaggcacaatgactcacacctgtaatcccagcattttgggaggctgagacctcgggaatttgagactagcctggacaacatagtgagaccccatctctacaaaaaaaatttttttttaattagctgggcatggtggtgcatgcctgtggtcctagctacttgggaggctgaggtgagaggatctcttgagcctgggaggtcgaggctgcagtgagctatgatcacaccactgcactccaggctggacaacagagcaagaccctgtctcaaaaaaaaaagatgggagacctaacagcagattttatgctgataggaataacctattaggggagaaaaacatgaggatgctggaggaagaagagtgtcaggaggacatctcttggtggacgagaggggatggcatttggtgtacaggtggaaggtttcactttagatgacagcacacacagttatctatagaaacaggagaaaatgcactatatgggcatacatgctgggaggtagagagtaaataatagtggtggttgcttgtggaaattctcttctaatgtttttatatttttatggtttatcaaggacaatttatatttttacagtttactgcaaacaacaagttctaatttattcaataattatttgtgggtagaccgagtgcagtggtgcatgcctgtaatcctagcactttgggaagccaaggtgggaggattgcttgaactcctgattcacttctgagcttgaatcaggagttcgagatcagcctaagcaacatggcaaaacactgtctctacacaaaatacaaaaactagccaggtatagtggcatgcacgtagtcccagctattcgggaggctaaaacgggaggatcatttgagccctgaaggtggaggttgcagtgagccaagagcgagccactgcactccagcctgggtgatagaataagaccctgcctcaaaaagaaattcttattcttcttcttattattattatttgaggagacatttactttgtaccaggcgctgtgctagatgctggagatacagacatcaacaatgacaaggctaagtgcctggcgtatttgtactttgagtctaataaaagacatcacacagacacacaacacacacacacacacacacaggattgtcaaaggatcaaccatttcacatgtcaagatcaggaatgatattggtctactactgccttaccatatctcctaccatgacctcatcttcctcttgccagattttaagtctttatacctcaactcccagaactctcttcgcctcacaccctatcacaatgtcatccgtaccccacggccaatactccatcattcgggaaagcaaagttccaaagcgtcaagattgtatcaatggacctgtctctatggcaacagtcctgaatgagccaagcaaggtaaccctggagatggcgtgaatgagaaagtggcctgttgccacggagacgtgctgaatgggaaggcccccacgagccaggctatgtcacgaagccgaaacagtcagcatgaagtcggtatgtctattttcaactcggaattacaaaaatacattttaatagagctcatgacccatctccttcctcgtccctgcctcccaccccactcttcagccttcatcctacaacacaatcgagcctcaccaggaacccttcaaacccctcaaggacaccttactgttccttcagtacacagtccccttcctgggctgaggtggtattcctttgaccaactactgtctcccctttgggaccaacagtattctcaaaagccatgagcttatgggaagaacattaactacattctttggggcaagaacagttgctcacctgtgaaccagctcagcttgcatctgtgagaatgattgcaatgggtagaccagttctccatcaaagaatggccctagcaccccacacacagtggtataatctgatcatgctggtgtattgaacatataatgttagtgccacatgaaaggaatttgtaaaaggacttagtgcctagaaaggtacctttgaagatcttggaatctctgaaacttacccaggttccttataccctgctcaaagtattcctccatttatttcttcattcattagttcttttgtttcaccacatatatatttttgaaacggggtctcactctgttgcccaggctagagtgcagtggcaagatcgtggctcactgcagcctcaacctccccatctcaagcagtcctcccacctcagcttcctgagtagctgggacaccacaggtacaagccaccacgccaggctaattcttgtaatttttgtagagacggggttttgccatgttgcccagtgtattcgtttgttctcacattgctataaagaactacctgagactgagtagtttataaagaaaagaggtttaattgactcacggctccacaggctgtgcggaaggcatggctgaggaggccacaggaaacttgcaatcatggcggaaaatgaaggggaaacaagcacatcttcacatggtggcaggagagagagagtgagggggggagtgctacaaaaccaggtctcacgagaactcactcactgtcatgagaaaagcaagggggaaatctgctcccaggatccaatcacctcctaccaggtccctcccccaacattggggattacaattcaacatgagatctgggtggggacacagagccaaaccatatcacccaggctggtctctaactcctgagctcaagcaatctgcctgccttggcctcccaaagtgctaggattacagacgtgaaccatatttattaagcattgttacagcaaagagaagcattgttgcagcataacaattggaagactccattgatggacgtctccatcaacaagaactgtcggataaactatggtacacccatcccttagcgtgttatgaagtcattacaaaaagaagaagcagatctctgagtgtcaataagagctagtacttatagggtgtctactgtatacaagtgctgttagaaagtgagtattaactcatttaattcttgtaacaagcctgtgaggtggattctttcatatccccattttacagagaaggaaataggaatctctatatccaagatatgttatcaggtgacaaaagcagtttttgaatggtgccgccattttctcgtaagagcaaatctggaagattccatgagaaattaataattgtgtttgcctctgtagcggcaccctgaaagatttggaagtaggtgtggaaaggaaacttactttcttgtgtctttctgaattttgtactgtctacgcgttttgtctttcacaaaaccaaacagaaaatgaccatttggtgcattttgtgtgtcaggcattcttctagtctagagaagcacaggagagcaaaatattttactgacgagaaaaatgaggcatggagaagttaagtgacttgcccaggtagcagagctgggattccacatcatagggtttatacaggaaacaggtaaacagagctgtgcttgtgtgtgggtatgtgtgtacacatgcatacatgtgtgcatgtgtgtgtgtgtttgtgtgtgtgtgaatgtgcttgtgtgttgggagagggaaatggcaagagaagaacctacagaaggtcagcaggaaccaacccatgttttgaggagtttggactttatcctgaaggcacaagggagccatggaaggatttagacaaggggtggttgtgcttagctttttatttagaaggatgactctggctgaagggtgatggcccagaatacaggtatatgtgaaggactcctcctgccctagtaggaggatgcccacccaccctctctgcccagtgcagtatcaaagggcaaattgggtacagagaattctcaccaagctgggtagaatccactctgatgctggggagtggacactgaatgcaccagcctctcctcctgctcaatccctgaattgaagctgttccactaatgttagggatcagattcccttcatatatatatatatatatatatatatatatatatatatatatatataattttttttttgagacagagtctccctctgtcacccaggctgaagcccattgtcgcgatcttggctcactgcaacctccacctcccaggttcaagcaactcttgttcctcagactcccaagtagctgcgattacaggcacccgccaccacacctggctaattctatatttttagtagagacagggattcacctatgttggccaggctggtcttgagctcctgggctcaagtgatcagtctgcctcagcctcccaaagtgctagtattacaggcatgagccaccatgcccgtcctttttatattacctttttttatagagatgtggtttcactatgttgaccaggcaggtcttaaactcctggcctcaagcgatcctccctcctcagcctcccaaaatgctaggattacaggtgtgagccactgcatctgtccagactctgttctccataaagctggcatatggaaagagggaagaccatccaggcaatatcgaagtcccattggtgctgatgtggctgctgagaccacatgaatggatgcattctgactctgccacctctcagctatgtgaccctgggccagtcagcaagtccctctataactcagttttctcatctgtaaaatggcgtcaacagtagccaaccccagcaaatactgtgaaatatacagaacatcattataatggtgaggatgatagagatgctatgttatcagaatacctgggcttgaaccagctccccttcttgcaagctgtgtgacttggagctgatgcccaaacctctgtgggcctcatttgtttcatctgttcaatggggataataacactcttacttcatacagttatggaggatttattgaaataattgacatacagctcttagaacagtatccggctccttgtaagcgctcaagaaatattacagactgttgataataatgcaatactactaccaataatatggccaggagcaatggctcacacctgtaatcccagcactttaggaggcagaagcaggctgattgcttgagcacgggagttcgaggccagcctgggtaacatagggagactctgtctttacaaaaaataaaaataaaaatacaaataattagccaggtatggtggtgcatacctgtagttccagctacttgggaggctgaggtgggaggattgcttgagcccaggaagttgaggctacagtgagctgtgatcacaccactgcactccagccagggcaacagagtgagaccctatctcaaaaataataataatggccgggcgcgctggctcatacctgtaatcccagcactttgggaggccaaggcgggcagatcacttgaggtcaggagtttgagaccagcctggccaacatggtgaaaccccatctactaaaaacacaaaaattagccgggtgtggtggcggggtgcctgtaatcccagccactcaggaggctgaggcaggagaatcgcttgaacccgggaggtggaagttgcagtgagccgagatcacaccactgcactccagcctaggtgacacagtgagactccatctcaaataataatatgagtaataataataatatcatttttatcatcattcttactaacagtctctcactccttgccctgcagttttgcctgttttcttggaataacactcttccacacctttcccctcagggatggttcacgtttagcatcatgacccacccctggggattagttagctcatttctggaaagcactttggagctgtaggtgctttgcaggctggaaacatcacgggacttgtaccatatttaagcaatgccagattattctgcctggcagggggaggacacagaggatacggccctggtatcttttctccctgcctacctcagctttgctctgaaccattttctgtcctgttcagggcagcctgggccacttgccacttccagctttctcgggagaggatgccttcctgatggcacgcctcttaacacacacctggtgctgttgttgaaaaagcaacaattgactccagcgccagcactgagaggcttgtccttaaaattagcaggagctgttggaaggtcgctgttagctcttttgactggaacacactgttccccaggtggcatgaggctgaatacagtgcagggattggctctgctctcaggtggcctgctccacgctcctgagctccgggtggaagctgtgaccattatttccttaacagaaacatatatagcagcattaactatgaaccttattactgtgtgtgtgtgtgtgtatatgtgtatatatatatatgcacatatgtgcatatgtgtgcctatgaacctgttctgagcactttacaaatgtcaatgtattttatcctcccaacaacccattttataaataagacttgaggcacagagaggttacgttactgccccaagatcacacagctggagagtggtgaggccaagatttgaacatatgtaccattgtaccatatgtaccaactttttttttctttttgggatgcattcttgctctgtcacccaggctggagagcagtggcatgaccacggctcattacaacctcaacctccaggttcaagctatcctcccacctcagcctctcaagtagctaggaccacaggtgcataccaccatgcccagctaatttaaagtttttttttgtttgtttgtttgtttgtttgcagagatggggtctccttatattacccaggctggtctagaactcctaggttcaagcaatccccccacctcggccttccaacatgctgggattacaggcatgagccactgcacccaggtcctccctccttataaaggtcgccaagcacaatcttgtgagcctggccctatccacacccatacgcaacatggtgtgtatttttcaaacaaaaactgaatgaacacctctggtttgggttcccctcacacttgtcccgggtttgttgactctgtgttgtgggcctagacaaagcagtgtctggagctcctagacccagggaccagacagtctgggttcaaatcctggctcttccacttctgcctgagtgctctctctgaacctgtctttctttatctataaaatggagataatttttttaaactcatcacttggtcaaactgctttgagcatgcaaatgagttcatatgtataaacctcttagaatgtcccaggcaaagaacaacacttcactcagatcaacatttatttagcatctactgtgtacccatgactattctaggtgatgaggagaccctctggttcttatgaggtagtgaggtgggggagggtgagaaccctaaacattaacgatggtgtgttcgcaggtgggaaaatcagtaaagtcgggtaaagggaatttgggagtgctgtgctcaagtcctggccctgccactttctggggtgcaagatacagcattgaatagggtggtcagggtaggccttattgggaaagtgatatttgagcagacgatctagatgtcggcacatattgctactgtttgatggtactaatatgagtttgagtttcacttgcaagtatatatatatatatatatatatatatatatatatatatatatgtgtgtgtgtgtgtgtatatatatatgtgtatatatatgtatatatatgtgtgtatatatgtatatatatatgtgtgtatatatgtatatatatgtatatatatgtatatatatgtgtgtatatatatgtgtatatatatgtatatatatatatgaaatttggtccatttatttatgctgatcaattaattgatgttgaaattataattgaatgttttattaataaacagatacccacatactattttttcagaaattgttaggttttggggttttctttagattttgattatttttatttgcttaattttcttttttcttttttttaattttatttttccataagttattggggtacaggtggtatttggttgcatgagtaagttcttcagtggagatttgtgagaacctggtgcacccatcacccgggcagtatacactgcaccatatttgttgtctgttatccagtgctcacctcctactcttccccccaagtctctaaagtccattgtaccattattttactcacccacattctttggcctgagatgctgagtggtcatgactcccagatcccttcttgtttctgtatcaaagatctttactaagatcctggcctagggaacctattccctttcctcatccccaatgggagaaggggcttcttccccagcttatttgccaactcataggaaaggtatgaaggagaggactgtagttgtcttgaagctggtcagatgttgaagagatgataatatttgctgatcaagagagacaaagcaatgctggaagaagaggctgtgttagttaacaccagctgcaataaccaataaaaccaaaaatctctggcttaagagtatgcatgagtgagaaatcaacttctaaagtacaactggtggccggatgtggtggcttatgcctgtaattctagcactttgggaggctgtggtgggagggtcgcttgaccccagtagtttaacgccaacctgggcaacacagtgagacaccatctctactaaaaataaaaaataataaagtgaaactggtgaggggtgcaatgaggtggagtggtgggtgactcaaatatggctcgactccatgcagtcactcagggatccaggctgttggaggctctccctgcttaaacatgtggcttccaaggttgttctaagagcctacattgagacagcagctggggaaaagggaaagtggagtgggaggtacttatgagggttcctggaagtggtgaacaacacttctgcctgcattctattgggtggaatttagtcatgtggcccaggctagctgcatgggaggctgggaaatgtagtctctgattaggctgccatttcccagtcccacttgtgaatctttagtgggaagctcaccatgtttgcaccagggattcagtctacctcccactcatgcctcaactatgtatcaggcactgtcgtaagtactttacatatcagcctacctaatgcaaacaactactcagtgggtgctttattggtcacatgtattagtgagaacatggaaacccagagccgttaaatatcttgcccaaggtcacacagctaggaagtggcagagttggaatttgaatccaggaaatctggctgcagagccccacgcttagtataaattcattgtagtttagaaagaggcagaaggaccctaaaattggcataatccattttttggtccctaaggaactgactgaattgactacttgtaaaagtgagtcctggacaggcaacagtggctcaggtctgtaattccaggactttgggaggctgaggcgggcagatcacctgaggtcaggatttcaagaccagcctggccaacatggcaaaaccctgtctctaaaaaaatagaaaaattagctgggtgtggcggtgggtgcctgtaattccagctactcaggaggctgaggcaggagaatcgtttgaacctgggaggtggaggttgcagtgagcaaagatcacgccactttactccaacttgaatgacagagcaagactctgcctcaggaccgccatggccccctgggttctaggtcagagtttctccgccacagcactgatgactttgggggctgcattattagctccaaaatgggagctatcctgtgcactgcctcaacttacttgatgccagtagcgcccgcgccccagttgtgagaaccaaaaatgtctccacacattgccaaatgtcccctgggaggtgaaatcacccctggttgagagtcactgttctagattgttaaatattatcttacactctagcacaagtccaaggcaaactgacttagaaattaccaaccttgcaaaaaatagaagatttcttaaagtcagtgagcatgatggtggcaagctgctgaaatcacacccccagacattagcagatgggatctggacagtattcatctagttaaaaattgacaaggactgggacactgcaggctcttcaaaagagaatcatttgaataacaaggggtcaagacaggggtaattggtgaaagcccctgctcataatttgaaaatataaataggcatcatgaaaattcatcctgcaaaagtcaaaagtcgaatgtgcagtgttatacatgatcagttgatttgggaggggaaattgcatgcacacacatgagagcttgcacacccacacacacacacctgttcaagtgtgtgtgccagtgctcagtgaggaccatctccccaacctgtctgatcatcttgctttggggtgaccctatgggtgaggcagaaattcttggatcatagttttctaatgaatattataattgttaacttctgatgggtgctgactttttcatctttgcaacactgcgtaggtatttttactctccccattttacagatgagacaactgaggctcagaaagattgattagctctacacgaagccaggatccaggcttagcctggctccaggaatcatgttttgagttacgtagcttccctgattctgagggacctccccacttctgaaatcttctactgttactccccatggccctttcctattgaccggaggcaccccagctcctcactcgtcccttatcttatgaaacatgaccatgatgtctgaattcaaaggagagcctgggctttgtggggaaaacgaagcagaaaaagaaaggtggaggttggtggttgtttttggcatggtgaggagcctgtcgttgcttgaggaaagcaagaaaggagattgctggggcttggatccatctctgggtgcctgtgggtctgtctgtaaaaatgagaactggtcgtgctcattagaggatttgaccgttaggccttgggatagcgatttgggaacttttttctgctaagacaaagaataatatggttcaggttcattttgctcctgctttcccaagccctacatctcttctgggcttttttttttttccttttctctccttcttcttcttcttcttcttcttcttctcatttttggatctggacttctgctgactcatctctctgagcaaggaaggagggaggaagtcagaattgctcattaaccgttttctttagtgactcagctgtgattcacattttaattaatggaggagaaaaacctgatcagtcctaaggcatctgcccaatcacgcataactccaggctggtgataataataatacttgaaaaaagtggggtgtcctgaattaaactatggctcattccccacattagtcttgaggactccaccaggccctctaagttccaggtctcaatggggctccctgaaccagagcagctagtccaagccccgagcagcatttctgcagagttagtctgaggtcaggacaagaaacagaggctcaagccctcctgggatcgcaggaggatcatgggaatgtaatattgtttcctgagctggtctttggctataatcccaggctcaagcctggcctccctcccctcggggcctgaaatttgtcagagcctattgcaggggcagcttctgtgctttttgtttgcccagagaatgagaaaagtccagataatcatgaccgctacttcctgagcacttactatgcatcaggtggtgtgctcagcacttctcatgaatgatcacgttgaatcctcactctgtccacaaaaagaaagagcttttatataattctccaacctccctatgaggaaactgaggcttggcaattgcccaatgtagacaattagtaaataatcaggcaggatataaacccaaccctttcccacctgggagccagagcttgcatctactatacttctctgctttccagtcagctgcaaagaaaaattggaagctgatagctcattcaacaaacacttattgaacccttccacctgctcagccctgttctagacaccagagatccatcagtgaaccaaagaggcaaatccatggtctcatgaaactgacaatttacctgcccaagtgtattagttactgtttataagttcctattaagtgtattagatatgcttgcagctgtaacaaagaatcccaacatgcataagggctcaaaacaataaaaatttcgttcttgcacagataaagttcaaaaggtgtattctttttttttttttcttttgcgacggagttttgctcttatcctccaggcatgagtgcaatggcccagtctcggctcactgcaacctccacctcctgggttcaagcattctcctgactcagcctccccagtagctggaattacaggtgcccgccaccacacctggctaattttttgtatttttagtataggtggggtttcaccatgttggtcaggctggtcttaaactcctgacctcaggtgacccacctgcctcggcctcccaaagtgctgggattacagccgtgagccaccgtgcctggccaaaaaaaaaatgtattcttaaacagcaggcacctctcctctaagcagtaagtcaggggcccaggcttgttccatattgtagctcctcatcttcaacccatggcttccaaagtctccatgcttcttgatatcaagccacagaagggaaaagagcatgagaagggcacaggagaaatgtttctgggacagacccagaagtagtccatatgacttccatctacctcccactggctagagcttacatggcggcacccacttgcagagctgggaaatggagtctaactgagcatccaggaaggagagacagacatgagtctttgcgtgggtcctcactgagaatcaagctccacattttgatcgatgtcaccagagcgtacatggcggcgcccacttgcagagctgggaaacggagtctaactgagcatccaggaaggagagacagacatcagtctctgcgtgggtcctcactgagaatcaagcttcacattttgatctgtgtcacctccttgcaagccctaccttaggacaattttaagggacattcctatcttcttccacccttaggacagttttaagggacactcctgagttcttccacccacctcctctgtttcttgggcttccagctctcaggatttgcctttgccttacaatggggtgaagcaagaatctggaagaatgtctctccccacaatttgaagtcttatttgaaaaaaagcagtagagcatccctccctcttgaggtagggaaatctagaatcaaatcctgcttctccagactttgacctcagaaactggggggacttcaaggtcttcaggtgggcagctttcatgaaccattcattcctcccacctcataccaatcagggtcctaacaggaaaaagaattaacttctagatggttcaaaagaagaccatgccatgaagagactccttaaagagataggaacaggtgagagaaatagataacggctgtttgaggtcctcagagagaagccatcgcgagccctacatttcctggaacccagtggaggcagagctgtgcagaagggactactgtcagaaccagggagggagcagggaagcaatattccaatctctttccctcccctcatcttctgccagcgcttcccctcagccaaaccaaaccggaaacggagcaaagcattctgggagttgtagtcttcaagggtccgcctcgagggcacagagcccgctggagcattgacctagagggcacacagggaatgactagtttgcaccatcatgtgacggactgcacgccctcgattatgtaatccactctataattcaactgcagagctgcatggtacagcaggatagccactagccacacgaggctatttaaatataaatgtacattcattaaaatttaaccaaatgaaaattttagccactgagccccatttcaaatgctcattagccacacgtggctcttggctaccatattggacagatcagaatagaacatttccatcatcccagaaagttctaggggccggcgcagctgtggtgtaacctgagcccatgcatgttatggaatggagaagagagaaaacagcacaagaggcagttttgaagggagacagagagctgtggatcagtagggaggagactctctaggcaaaggagcagttgagaagcaagaaagttgagtgagctgctttgctgcgatggaggcttccctcacggggaagagtagagtcagaaagctttagttcaagttcagctctgaaatgaaccaatgagtgttctgacaagacacctggccttccggaaccttggttttgtagtggccaagggcttgaccctctgaaggttcactgaaaaaaatcaactcacaaggcatattaattggagaaaaggcaggcagatttatttaatgtgtttgcacgagagccttcagaatgaagacccaaagctgcaggggaaattgtccgttttttaagcttaggttcaacaaagtatggacagcggtgtagaaatatgattgaacaaaaagtgtacaatgtaaatgctaatagactgagtggggaaacccaaaaagggctgtcttgattctccttggtctctctgagcatgcatttcttccgggtatgggacaagaccctctctggaatggagggggggctctcttggttctccttggtctctctcagcatgcattccttccgggtatggggcaggaccctctctggaataagggggctgtcttgattcttcttggtctctcagagcatgcattccttctgggtatggggcaggaccctctctggaatgggatccttataacctacggtcaaataacgtaagttagataatttcttttttttttttttcttttttttgagacagagtctgattctgttgcccaggctagagtacagtggcacaatctcggctcactgcagcctctgccttctgggttcaaatgattctcctgcctcagcctcccaagtagctgggactacaggtaagcaccaccatgcccagctaatttttgtattttttagtagagacagggtttcaccatgttggccaggctggtctcaaactgctgacctcaagtgatccaccacctgggcctcccaaagtcctgggatttgtaatcccagcatgagccactgtgcccagccagatcatttctttttctttttctttttcttttcttttttttttttttttgagatggagtctcactctgttgcccaggctggagtgctgtggtgcaaactcagctcactgcagcctctgcctcctgggttcaagcaattctcctgcctcagccttccaagtagctgggactagaggtgcgcgccaccatgcccagctaatttttgtatttttagtagagacagtgttttgccatgttggccaggctggtcttaaactcctgacctcaagtgatccacccacgtcggcctcccaaagtcccgggatttgtaatcccagcatgagctaccacagctggccagataatttttttataactagtttttacaaagaaaggtggagggaaagttagagtaacatttttaggtgttagggctgactttggggaaaagaggtctggtttctacgacccgccttagggaagagggattctagtttttgtggctagccccaggggagaatgggactaagagatagaagggcaggagaaggtcagagaaaaacttttgcttctgtggctgcttcggagaacttcattttggggtattgttttctgagccccaacagtttgcttatcagtgaagtgggtataggcgcccacctcccacagtgacgatgctgtgaacagggctttggaagagtagaactatgaaatatttgttgttgccttgtggggaaatggtcgttaaagccaaaattgttcaagagaagaagcaggaagagttcctttctttcctgcaggtatcctcttaagctgagtcttcagaatcccctgacaacgtttaatcaacactttattaaattcaccccaaccctgcttcaaaccttcacctggtcctcgagatcttccaactgtttcttgatgaagttagcaggcaattgtatggcgggatcatcatctcatgttttgttttgtttttttcctttttaccctctgactttgagaaatccttgtccttttacttttccaaacctgagagcattgcagagaagttagaattgagcaggacatgggcttaagacccagcccagccatgtgctagctgtgtgaactcgaagcagtgaccccacctctctgacctggaaagtagagggaatgataggacccaccaccgccacacttgtagggtcatcatggggattgaataaaataatgcataagacttggcccacagcaagcactcaagaaatgttagctacttcctaaatatatttttaaccttttattgaatataacatacatacagaaaagcacatgtatcatacaagtagagcttgagtgattttcaaaaactgagcccagtcatgtaaccagcgcctagttcaagaaacagaacatagccgagtgaggctgaggcaggagaatcacttgaatctgggaggcagaggttgcagtgagcagagatcatgctatcgctccccagcgtgggcaatgggggcggaggggaagagagagagagagagagagagagagaggaaggagggagggaaggaaggaaggaaggagggagggagggagggaagggaaggaaggggagagagagaaaaggaaagaaaagaggaagacagaaagagagagagaaaggtaaagaaagaaaaggaaagaaagagaaagaaagaaaagaggaagacagagaaagaaagagaaagctaaagaaagaaaaaaaggaaggaaggaaaatagggagggaagaggaggaggaagaagaagaagaagggggggagggagggaacagctgcagcttcgaggaaggaaggagggagggaaggaaggaaggaaaggaaggaaggaaaaaaaaacagcaccaacgtttagaaacccccttgtgcctctgaggtcaccagtaactccatcctgacttcaaacagtctagattagttttgcttgtttttgaactttaagcacatggggtcatacagcatgcatgcattgacttctttcccttgacgttgtatgtgtgagattcatctgtgctgttgctgttcatttgttctcatcgctgtgtgtgctgaaccacctgttcatttactctactaatggtgggcagtttggtgctttctactttggggctattccagagaaagctactttgaacacactcagatatgtctgtgggtgaccactcttcatatttctatgggagatattcctaggaccggaacatctgagtcagagggaggaattggtttagctttggtaggaactgcctaacaattggccgggcacagtggctcatgcctgtaatcccagcactttgggaggctgaggggggcaaatcacttgagctcaggagttcgagaccagcctggccaatgtggcaaaacccctggccaacatggcaaaaccccgtctccgcaaaaaaatacaaagattagccgagcatggtggcgtgtgcctgtaatctcagctactcaggaaactgaggcaggagaattgcttgaacctgggaggcagaggttgcagtgagcagagattgcactactgtactccagcctgggtggcagaatacatgaaactccatctcaaaaagaagaaaggaaggaaggaagggaaggaaggaaaggaaactgcccaacagttttcccaagtgtttgggatggaaggaaggaaggaaggaaggaaaagaaactgcctaacagttttcccaagtggttggaccagttaaaactcccaccacctgtgaatgagagtttgtttttattttgctcctggagtgcctctcctgtagcaggatcccactgaatgtctgggaattcaaatgtaatgcacttgttcatttcctcaagagcttcactccatcaattggattcatccattggctctcccatctccactgacactatgttctcacctctatttggaagacatcctgcctccacctgcccaagtcacattatcttctcattccagcctctcaaggagagttttctctttcaccacctcctctagccctggtgattggcaaggtctcgcaacagtacccttcaaaacactcatgactgtgaatgcactggccttcactaagtttcccattcttctctttctttcttttttcttttcttttctttttttttgaacagagtttcactcttgttgaccaggctcgagtgcagtggcacaaacacagctcactgtagcctcaacctcctgagctcaaggtatcgtcctgcctcagcctccttagtagctgggaccacagacatgcaacgttgtgcccagctgattttcttttttttctttttttttttttttttgagacatggtctcaccctgtcaaccaagtgcagtagcatgatcacagctcactgcagccttgacctcccgggctcatgcgattctcccacctcagcctcccgagtagctggggctacaggcacaagccaccatgcctggctaatttttgtacttcttgtagagaccaggtttcaccatgttgcccaggctggtcttgaactcttgggctcaagcagtcctcctgcctcagcctcccaaaatgctgggattacaggtgtgagccagcacgcccggccatggctaatttcttcatttttggtaaagacaggtctcactttgttgcctaggctggtcttgaactcctggactcaagcaatcctcctgtctcagcctcccaaagtgctaggactaccgatgtgagccaccgcacccggcaatttccccttcttgacttctccagagctctcatccctctcgagctcctgtctcttctagaatcacttacctcaccaccttatggggtttttgcctctgttcctactcctctttatttaagaaaacactgtactttaagagggcttcagaaaccacccgaaatagaaacatgtccttttgttcaatcctttactttaaaagacaaataaaatgaagaattgctctccatgtagaaggttaaggagcttgggaggaccttctgtgagtggggagaactttacattaaaggaaaaaaaatgctggagaatagctgtgaacccaggaagggagaaggacttcctccactgaacttgtaaagcacaaactctaaggcaaaaaaagacatgattacatgaaaactaagatatttgttcaaataaagatgcaattggggccaggtgcggtggctcacgcctgtaatcccagcactttgggaggccgaggcaggcgaatcacgaggtcaggagatcgagaccatcttggtcaacatggtgaaaccccatctctactaaaatacaaaaaattagccaggaatggtgtcacgtgcctgtaatcccagctacttgggaggcttaggcaggggaattgcttgaaccagggaggtggaggttgcagtgagctgaaatcacgccactgcactccagtctagcgacaaagcaagactccgtccaaaaaaaaaagatgcaatagcaggtggttcgggaaccaaaccttacatccagatgctggttgtcccatttcctgtgaatccttgggtgagttatcaacctctctgagcctcagtttcctcgtcaataaaatggagaaaatagtatctacctatggaattgttgtgagttttgaatgagttaatatttataaatcatttagaataggaattagcacatggtaaatagtggatagaatcataaaaaaaaaattgatcaggggttaacttctaactgctgtttgttatagaggtccctagcactgtgtggtcattttaaatttagatgatttagaattaaatgaaatttaaaactcagttcttcattcacactagccacattttaagtgctcaaaacccacaggtgactagtggctaccatatttggcagcacagattgagaacagatttatcatccagaaagttctgtcagacagtgttgatcaaggctacatgagggtctgggtgcagtggctcacacctgtaatcccagtgctttggaaggccaaggtgggaggatcactggaggccaggggtttgagaccagcctgggaaacagagagacctcatctctaccaacattttaagaattagccaggcaaagtgttgcatgcctgtagtcccagctactcaggaggctgagacaggattgcttgagcccaggaatttgaggctgcagtgaactatgagcgcaccgctgcactccagtctgggtgacagagtgagacctgtctctaaacataaaaaataaaaatgtaggtggggcatagtggctcccgcctgtaatcccagcactttgggaagccgagatgggcagattgtgaggtcaggagatcgagaccaccctggctaacatggtaaaaccgcgtccgtactaaaaataaaaaaaaattagccaggcatggtggcgcatgcctgtagtcccagctactcgagaggctgaggcaggagaattgcttgaacctgggaagcagaggttgcagtgagctgagattgcgccactgcactccggcctgggcgacagagcgagactctgtctcaaaataaataaataaataaataataataaagtaaaaataaaaatgcaaagactacctgagggaatgtctgcaagtcaaccagaataacacagcaaccccaataggaaaacaggccgaaaatgtgaacaggcggatcagggaagtgaagtctgaaaagctaatcagcctatgacatggtactcaaagtcatttgtaaccagaaagatggaaatgaaagcagtatctctgtacacctttaatattggggaaaaaatatgtgaataagccaagggtttccagcgatgcgggcacagaggaaagtcttgcaccactcaaaggggtgtggcccagggaggccactctggagacatatcggtagtactcagtccagtgaggtccagcaccatcagcgcttatgtccccaggcatccatcccagggacattcttaccaggtctgttaggggcaggtacgagaatgcttactccagcaccatctatataaggggagctgaaggccacctggtgtccctcctggagaccaggaggcggcatgtgacagcggcacccatggagcaccagaatgagtgagagctccagaccgcatatccgacagatactacgggatggggcttttagaaatatggttgttgccgggcacggtggctcatgcgtgtcatcccagcactctggcaggccaaggcgggtggatcacctgaggtcaggagttcgagaccagcctggccaacatggtgaaaccctgtctctattaaagatacaaaaattagctggacgtggtggcgggtgcctgtaatcccaactactcgggaggctgaggcaagagaatcgcttgaacccaggaggcagaggttgcagtgagccgacatcgtgccactgcactccagcctgggtgacaagagcaaaactctgtctcaaaaaatttaaaaaacaaaaaataaaaatatggttctgggtgaaaacaggaaacaacagaatgtgtctaacttcatcctgcttatgtcagttaaaaatagacacactcaaaatatcgcacgtgtttttgcgagaatgcactcctataaggccaaattaaacattctctcagttgtctctgggagggagaagaatgaaagtagggtatagagagatataggggaattaatgcatgaatgaatgaaggtataaacaagagacaggcgtcatacagaccaaaggtaaagatatcccgtaacctgaggagagcaaagaacttgactctgcatttgaagattcagaaaatgaatttcagaaatagttttctcgccagggggtggctcacgcctgtaaccccaccactttgcgagggcgaggcaggtggatcacttaaggtcaggagttcgagaccagcctggccaacatgatgaaaccctgtctctactaaaaatacaaaaattacccaggcatggtggcatgtgcctgtaatcccagctactcaggaggctgaggcaggaaaatcacttgaacccgggaggcagaggttgcattgagctgagatcacaccattgcactccagcctgggtgacagagcaagactttgtctcaaaaaaaaaaaaaaaaaaaaaagaagaggaagaaatagttttttcaagaaggggaaagctgggtgatttaagaatgaacttgaagaggatcactcagtccaacctaggagtggcaagaatatagactgtatgggaagtggttctgctccttggtacccatcttagaaatatttggcctgagtctgtaagaggcaggtactttatctaacctgaggttagggggccactacatccccatcccctcccctgctttctaaccatgctaacatcttctcactctcctgtctcctctccttctcactcccctaatctgcctattcacattttgggcctgttttcctattggggttgctgtgttattctcactgatttgcagacattcctctgtgtcatctttttaattttgttttaatttttagaggcaggatgtcattctgttgcactggctgtagtgacgtagctcactgcagcctcaaactcttgggctcaaactcctgtcctctgcctccacttctcaactggtaacctcacttctcttcatgaggtctctccagccccagggcctttgcacatgttcccctctcttctgagtggcatatggtagttgctcctctgtaaatatttattgacatcctgacttccaaccagcagagaattgacctccttcccatgctcaggctagtgaaggcatgagtttggctgaggtcccagtggggaaggtgagtggggtggcagagttaaccaggagcagcatggtagaatgggtaaaaccagacgtagcacgcaggcaccacatgttagctggacaagtagtttaaccccatgggtctcaatttccccatcaatgaaagggagaatagaacaagtccctggtaagcagcataaaatgagctctcagaatgtaaagtaacaagcacacaacctggaagagaatacatttagtgaatattggctcctttaatcagcaggttctgatatgacttagctacaattaagaaaataaaaatggaggccgggcgcagtggctcatgcctgtaatcccagcactttgggaggccaagacgggtggggtggatcacctgaggtcaggagtttgagaacaggctggccaacatggtgaaccccatctctactaaaaatacaaaaattagccaggcgtggtggcgcacgcctgtagtcccagctactcgggaggctgaggcaggagaaacatttgaacccaggaggtggaagttgcagtgagcccagattgcaccactgaactccagcctgggtgacagagtgagatttgtctcaaaaacaaaagaagtctggaggccaggaggttggttgcagggttggttccttggctcaacaatgtctccaaagagtccttccatctttccactctaacatcgtcactgtaaggactttttttaacatttaccactcacagccccaagacgactgcgtcagttctttctttttttccttcagacagagtcccgctctgtcgcccaggctggagtgcagtggcatgatctcggctcactgcaacctctgcctcctgggttcaagcgattctcctgtctcagcctcccgagtagctgggattacaggtgcctgccactgcatccggctaattttttgtattttttttagtagagatagggtttcaccatattggtcaggctggtctcaaactcctgacctcaggtgatgcacctgcctcggcctcccaaagggctgggattacaggcgtgagccactgtgcccggccgatgactgcctcagttctaaggtacttacccagccatccacgtagacagacacaaaagcatccggccaaagaagagggagaggaagggctgtctcttaccatgtgactcatctcacggggaaaaaatccttttccagaagcacccagcagatttttcacccagatcctgttaggcctacgaatgggtcatgtgacaagtgctcttattgcaaggaatcttgggaaaaagagactattaggcattttctgcctctttgatgggaggtgggctctgccagtaaggcgggtagtggtggtggctcttggatggacaactgtgtcttccattcttcttctttttttttttttttttttaagagacaaggtctcactctgttgcccaggcagaaatgcagtggcacaatcacagctcactgctgcctcgacctgccaggctcaggtgatccgcccaccttagcctcacgagcagctggaggagtgtaccaccatggccggctaatttttatattttttgtagagatggggtctctttatgttgcccaggctggtcttgaactcctgagctcaaacaatcctcctgcctcagcctcccaaagtgctgggattacaggcataagccaccacgcctggactctcttctttaaatactgagccttccacctcttctagaatatactctgttaattatcaaccacacttttctacatttttgcttcattattcattcagtaaacatttattgagtgcctactgtatgccaggcacagctttaggtgctggagatgctatgaacaaaacagatgaaaatttctaaaaaataaaataaaaaataaaaataaattttgcaaagccaggcacagtggcttaggcctatagttccacctactcaggagtccaaggcagtaggatctcatgagactgggagtttgagtccagcctgggcagcatactaggactctgtctctaaaaaagaaaagaaggccgggcgcagtggctcacgcctgtaatcccagcactttgggaggccgaggcaggtgaatcgcaaggtcaggagtttgagatcagcctgaccaacatggtgaaaccccgtctctactaaaaatgtaaaaattagccaggcatggtggcaagtgcctgtaatcccagctacttgggaggctgaggcaggagaatcgcttgaacctgggaagcggaggatgcaataagccgagatcgtgccactgcactccagcctgggcaacagaatgagaccctgtctcaaaaaaaaaaaaaaaaagaaagaaagaatagaaaatatctgccctacggggatggacatgctagaacatcaaagtccaatggaactttctgcactgatgaagtatgtatgtatgcaccagccacatgtggcttgggagcacttaaaacgtgactggtacaagcgaatttttcatttaatttaaatgaatttaaatctgtatttaaatagccatgtgtggctagtggttactttattgggcggtgcagctctctaaaggccaagagatacatcatcaacttctctcccttgacccatattcagttctctcccaccctgaaaatctcctctcctacccaggctcacatttccagttcttctcctcttgttctccctcaaccatcagcccccgcaagactgacgtgaccctgatgccgtatgaaatgcattcttcatcctttactcttactcacctctgtgcggccctggagaccagtgacctctcctttctcaaaatactttatttctgtgtgtttttgttgttgctattgtttttggggggttttcttgagatggagtttcactctcatcacctaggctggagtgcagtggtgcgatctcagcttactgcaacctctgcctcccaggttcaagcgattctcctgcctcagcctcccaagtagctgggattacaggctcccgccaccacggctggctaattttcttgtatttttggtagagacggagttttgccatgttggccaggctgatctcgaactcctaacctcaggggatccacctgcctcggcctttcaaagtgctgagattacaggcatgagccaccgcacccagcctcaaaatgcttttgaacttgactgtcaggtatgccattctccacaccagtctcctcccatgtctgtgtcttctccctctccactggggacccttggctttttccacttcactcatctaccctgggttatctggtcttccataaccctgtcctctgccacacctcacttattcacccaccacaatatttattgagtactcactaggccatgaaagatgctatacaaaaaaagcccctgtcctcgtggagctgacattctagaagaaagcatgaataataaatacgacttaataaacagtacggccaggcatggtggctcacgcctatcatccaaacactaagagaccaagatgagaggatcacttgaatccaggagtttgagaccaccttgggaaacgtactgggaccctgtctctacaaaaaaaatattaaaaattagctggatagggtaatgcatgcctgtagttccagctacttgggaggacaaggtggaaggattgcttgagcctgagaggtcaagtccgcagtgagctgtgactgtgcactgcacgccagcctgggtgacagagtgagatcctgtcttaaaaataaataaataaacaaacaaacaaacaatataattccagagagtgaagaggcaggatctctttagctaggaagttgagggatgttctctctgagaaggcagaatctgagtttcaacctgaagaattcgaagaggccagctaggcaaaagatgagagttgaaggaatggggacggcagaggagacagccaatatagtaattctcaataaagcagaaagtgagcttttcctgctggcagaacagaaaggaagtcggagtggccagggtgttgtgggacaaggtggtcagcaggagtcacatcacgcaaggtcatgtggtcatggtagactttaaattttactccaagcctgatggaagccattggaagattttaactaaggagtgacggaaaactggcatctcaaactcaacatgtctacaacccagttcttgatctttgaaaccttcttcctccatcttccccatctccattgacagcaacttcatccttcagttagctcaggccaaaaccctggagtcacccttgatacctctctcctgctccacactcagtctttccattggaagccctaggggctgccatattgttctccatagcacttcacaccgtctgacatactatatcttttcccactattgctttgtccttggtagcatctttaggcactctctgaatatctggcacatagtacgtgctcactaaatccttgttgaataaatgaatgaacatcactccgtggtcctttcagaaccagagccattcttctctttcttcaccaccgttgcccctcaccccgcccaactagtcacaggagttgaaggatgacacagtagagaactgggattctggagtcctgtggctggtctggggttcgagttcttactcagtggtaggaacctccatgtgggattaacttatctggtctttagtttcctcctctgtaaaatgggcctcaaactgccaaccgctgggatgcagggaggatttgatgagcccaggcaggctccctggagcacagcaatcaatggcagctatatataaaccggggcctcttttgtactcccactgcctttgtcctagttccagccctcattacaccagcctgctcttgcggctccctcctaacttctgctccatcaccaccaatctgtcctttcagctgtcaggcttgtcttctgaacgccaaccctaatcacatcccttcctgctccaaaaccttacatgactctcactgtccacaggacaagacccagcctctagttgacagcctccactgtccagcttacccaacctctcccctaccacataccctgagtggagccttctgcctccatagggctttcttagccagagaagcctcccttatcttcctgttctcctcctaattccttcttatccttccagggaggaggctgtgaggtaatgcatcttgggagccagctgggattgcacagggtggtgagattatctgcatttccgaggcttgaacaagttaaggcaatgggaaaggtcacacaatgagaaaatgcagggccaggatttaacccgtctgagatgttctgactgtgctatgctgcctccccggacatgagctctgcgataatgctgtccccaggctgtaatcattccctctttcatccctgcctcctctatccctggggtcagagggacttgtagttgaatctctcactcactcattggtgtggtctctccctaaagcagggtggagtttgtcttagcgttatcactgcatccagcacaacctccctggtccaggcttatcagcgttcaactgcgtcaatgcagttgcctcctcctcaatctcccagcttccggccttgccccctagagagatcatattttaatacaagtcagattacatccctcctcccctcagaaccctccatggctcacaccttactcagagaaaaagccaaagtcctctccacaacccacaaagccctgcaccatccatcacctcactgccttcgtcccctcacaccctcccccttgctcgctctgcttcagccacaccaactcatctctgtttctcaaatacaccaggcatggcctagctattaaatgcacggtccagcctggtgcatttgaagaacacggatgaattggtgtggctggaacagagtgagtgagggggagagcgggaggaggacctttgcaccagctggacctttgcaccggctgttccatttgcctagagttttccctgacatattcatatggctcactctcttgcttcccttgctttctcccagtctttattcaaatgtctatttctctgcacttgtgctgtttgatacagtcaccgctggccacatgtggcctttgagcacttcagttgaaacacatgaaagtgtagaatattgaccagattccaaggaaaaccatgtgcaaaatatcttttatctcttaagatacagggtctcgctctgtcttccagcctggaatgcagtggcatgatcacagctcactgcagcctcaaaatcccaaacttaagtggtcctcccaccaacagcctcccgagtagctgggattacaggcacacaccacaatgccccgcccatttttttaattgttattattttttttaatagcgacaaggtcttgccatgttgctcaggctggtctggaactcctggcctcaagcgatcctcctgcctcagcctcccgagtagctgagattacaggcaggagcttttgtgcccagcaggtctacgatcttcttagaatgcttcaggctgggcatagtggctcatgcctcaaataccagcactttgggaggccaaagcaggcagattgcttgagctcaggagttcgagaccagcctgggcaatatggtaaaaccctgtctctccaaaaaaaatacaaaaattagctgggcttggtggctcccacctgtagtcccagctacttaggaggctgaggaaggaagatcacctgagcccaggaggcggaggttgcagtgagccaagattgagccactgcactccagcctagacaacagggagaccctgtctcaaaataaataaataaataaataaataaataaataaataaataaacaaacaaacaaacaaaccaataaatgaattttacctgtttctttttacttttttaatgtggctactagcaaattttaattttttttttttttttttttttttttgagacagagtcacgctctgtcacccaggctggagtgcagtggtgtgatcttggctcactgcaacctccacctcatgggttcaagcagttcgcctgcctctgcctctgagtagctgggattacagatgcccaccgccacgcccagctaattttttgcatttttagtagagatggagtttcgccatgttggccaggctggtctcgaactcctggcctcaagtgatctgcctgcgtcggcctcccaaagtgctgggattacaggcatgagccaccgcgcctggctataaaatttcataagtagctcttaatagatttctcctgggcagtgctggtctaaacactttttttttttttttttttttttgagacggcatcttgctctgtcaccaggctggagtgcagtggcgcgatctctgctcactgcatcctctgtcacccgggttcaagctattctcctgccttagcctcccaagtagctgggactacagacacccgccaccacgcccagctaatttttgtatttttagtagagacgggttttcaccatattggccaggctggtctcgaactcctgaccttgtgatccgccagccttggcctcccaaagtgctgggattacaggcatgagccaccgcacctggctataaaatttcataagtagctcttaatagatttctcctgggcagtgctggtctaaacactttttttttttttttttttttgagacggcatcttgctctgtcaccaggctggagtgcagtggcgcgatctctgctcactgcatcctctgtcacccgggttcaagctattctcctgccttagcctcccaagtagctgggactacagacacccgccaccacgcccagctaatttttgtatttttagtagagacgggttttcaccatattggccaggctggtctcgaactcctgaccttgtgatccgccagccttggcctcccaaagtgttgggattacaggtgtgagccaccgcgcccggccctgtaacacttttaacactgaactgtttgccttccaggtggtaaagagcaggtgcctttactgatagaaatgtcaccactcccttcatcccgccagccccatgtcactgacgcgtcctttccccttgctctgtggtaactttctcctaagcactcatcgccctaacatctgtcatacaggtatacctcagagacactgctggtttggttccaggtcgccataacaaagcgaatattgcaataaagggagtcgtgccttttttggtttcccagtgcacataaaagttatgcttacactatagtctgttaagtgcatgatagcattatgtctaaaaaaaaatgtacataccttaattttaaaatccatcaaggctgagcacagtggcttgtaatcccaacactttgggaggccaaggcaggaggattgcttgagcccagggatttgaaaccaggcaacaaagtgagaccccgtttctacaaaaaaattctttttaaaaatagctgggtatggtgacgcatgcctgtggtcccagctacatgagaggctgaggtgggaggctcacttgagcctgagagattgagactgcagtgagctatgatcacaccactgcactctagcctgggggacagagtgagaccgtatctctcaacaaaaattaaaaaaaaaaaaaaaaaaggctgggcacagtggctcatgcctgtaatcccaacagtttgtgaggccaaggtgggtggatcacttgaggtcaggagttcaaaaccagcccagccaacatggtgaaaccccgtctctatgaaaaatacaaaaaaatagccgggtgtggtggtgcacacctataagcccagctactcgggaggctgaggcacgagaattgcttgaacctgggaggcgggggggagattgcagtgagccgagattgcactgctgcactccagcctgggtgacagactgagactctgtctcaaaaaataaataaataaataaataaataaataaatgttttattactaaaaaagttaacaatcatctgagccttcagtgagtcctcatcttgctggtgaagggtcactggctcagtgttgatgggtgctgactgatcgtgggggtggttgctgaagattggggtgcctgtgacattttcttaaaataagacaagaaagttttccgcatccatcgactcttcctttcacgaaagatttctctagcatgagatgcttgttgacagcaattttacccacagtagaacttttttcaaaattggagtcagttctttcaaaccctgccactgctttgtcaactaagtttatgtcatattctaaatctcatgttgtcattttaacagtgttcacagaattttcaccaggagtagaatccatctcaagaaatcactttctttgctcttccataacaagtaacgcctcatgcattgaagtttgatcatgaggctgcagcaattcagtcacatcttcaggctccacttctaactctagttctcttgctagttccatcacttctgcagtgtcttcctccagtgaagtcttgaactcctcaaagtcatccatgaggatcggaattgacttcctcaaaattcctattaatgttgatattttgacctgttcccacgaatcacaaatgttctttttgttgtttgtttgttgtggattgtttttttatttttaattgagttgaggtctcactatgttgcccagactggtcttgaactcttggcctcaagtgatcctcctgccttgatctccctaagtgctgggattacaggcatgagccactggaacagccacaaatgttcctaatggtatctagaatggtgaatgcttttcagaaagttttcaatttcctttgcccagatgcatcaaaggaatttatctatggcagctatagccttatgaaatgtatcccttaaatcataagacttgaaatagagaattacttcttgatccatgggctacagaatgaatgttgtggctgggcatggtggctcacacctgtaatcccagcactttgggaggctgaggcaggtgggtaacttgaggtcaggagttcaagaccagcctggtcaatatggtgaaaccccatcactactaaaaatacaaaaattagctgggcatggtggcgtatgactgtaatcccagccacttgggaggctgaggcaggagaattgcttgaaccctcttgaagacagaggttgcagtgagccaagatcacaccactgcagcgacagagtgagactctgtctcaaaaaaaaaaaaaaatgttgtgttagaagtcataaaaacaacattcatcttcttgtacatgcccattagaggtcctggataaccagtgcattgtcagcagtaatattttgaaagaaatcttttttctggctgggtacagtggctcgcacctgtaatcccaccactttgggaggccgaggcgtgtggatcacctgaggtcgggagttcaagaccagcctggccaacatggtgaaaccccaactctactaaaaatacaaaaaaattagccaggcatggtagcaggtgcctgtaatcccagctaccctggaggctgaggcaggagaatcgcttgaacctgggagtcagaggttgcagtgagctgaggtcgtgccattgcactccagcctgggcaacaagagtgcgacttcatctaaaatacatatatatatataacatgttatatgtaatataaattatatatataacatatatgtaatataaattatatatcacatataacatatatcatgtgttatatatatcacatataacatatgtgttatatatcacatataacatgtgttatatatcacacataacatatattatgtgtatatatgtcacatatattatgtgttatatatgtcacatataacatattgtgttatatatatcatatataacatatattatgtgtagtgtatcatatgtaacatatattatgtgtagtgtatcatatataacatatattatgtgtagtgtatcatatataacatatgtgtagtgtgttatatataacatatattatgtgttatatatctcatatgttatatataacatatattatgtgttatatattatatatatatttttttctgagtagatctcaacagtgggcttaaaatatcagttatccatgctataaacagacgggctgtcattcagtcttcattgttccatttatagagcacaggcagagtagattcagcataattcttaagaccttaggactttaggaatggtaagtgagcattggtttcaacttaaagtcaccaggagcactagctcctaacaagagagtcagcctgtcctttgaagctttgaagccaggcattgacttctcctctctagctatgaaagtcctagatggcaacttcttccaatagggcatttcatctacattaaaaatctattattcagtgttgccagcttcattaataatctcagctagatcttctggataacttactgcagcttctccatcagcacttatcacttcaccttgcacttttatattatggggacaccttctttccttaaacctcatgaaccaagatcttctagcttcagatttttcttctgcacttccccacctctctcagtcttgctgtgggcttgctgtggattaggctttggcttaagggaatgttgtggctggtttgatcttctatccagaccactaaaactttctccatgtcagcaagaagcctgtcttactttcttatcattcatgtgtttactagagtagcccttttaatttccttcagtaatttttcctttgcattcacaacttggctaacctctagcttatggccttttgtttgtttgtttgttttgtttttgagacagggtctcactccgttgcccaggctggagtgcagtggtgcaatcaccgctcactgcagccttgacttcctgggaccaagtgatcctcccacctcagcctcctaagtagctgagaccacaggtgtgcaccaccacacccagctaatttttttattttctgtagagatagggtctccctattttgcccaagctagtctcaaactcctaggctcaagccatcctctcacctcagcctcccaaaatgctcggattacaggcatgagccaccatccctggccctatctcagcttttgacacgccttcctcactgtgtttaatcatttctagcttttaatttaaagtgagagacgtgcaactcttcttttcacttgagcacttaaaggccattgtacagttatacactgacctaatttcaatattgttatgtctcggggaataggaaggcccaaggaaagcgggagagatggggaaatggccagttggtagagcagtcaggacacacacaatatttatcgatcaagtttgccatcttctatggatgtggttcgtggcacccccaaacaatgactatagtcacatcaaagatcactgatcacagaccaccataacagatgtaataattatgtaaaagtttgaaataccgtaagaattaccagagtgtgacacagagacgcaaagtgagcacacgctgttggaaaaaaaatggccctgatagacctccttgacacagggttgccacaaatcttcaatttgtaagaaacacaatatctacaaattgcaataaagcaaagcacaatgaaatgaagtcttcctcggccggtgtggtggctcacgtccataatcccagcactttgggaggccaaggcaagaggatcccttgagcccaggagttggaggccagcctgggcaacacagggagactccatctctagaacaaaacaaaacaaagcctgcttatatttattgggtttactctcagtctcccccacacagagatagggcctggcttgttattagtgctcagttgatgtttgtgaagtgaaatactaaggacttaaccactgcctgttctttgctgttcatgccctgacagcttttatgtgccagcacagaagaaaacaaggtgcaagaagagaatagtgatctctaagtcagaatttgaggaacccaaattagtaccagaaagctgggaggagaagagaaaaataaagtaaatcaaattaaaagttgaatgggccaagtgcagtagctcatacctataatcccagcactttgggaggctgaggtgagaggatcacttgaggccaggagttctagaccagcctgggcaatatagcaagaccccatctctacaaaaaaaattttttaattttctgaatatgttgttgtacacctgtagtcccagctgcttaggaggcagaggtgggaggatcgcttgagcccaggaggttgaggctgcagtgagctgttgttgcaccactatactcaagcctgggtgacagaataagtccctgtctccaaaaataaaaataaataaattcattttttgtaaagttgtatgtcatggcccctgcctactctggcttcatgacttgctgcttgaacctcaccatccaaatcccagtggtgacaccatgtcatttcttgaatttgccaagccctctttcagtcccaagctctctgtcatggccactctcagcctggaaagttctttccccactggccagatttctccccctcatctgtgggaacttgacttgaagtagggggtatcccaggccctggactagttaacacgacctgctgtgtgcccctcaaagccattgtcttcctagctgagaaggcatcacacctgcaacagattcactcattgtgtgcatgtttttcttaaccacttctcttctgcatcagctccatggggcagggatagtctcatatgtcactctacccagcacataggatacgctcagacgcccacttgtggatggtggaaaaggtcagcccaacctaatatgcccatctctcctctaggggtaatcttgagaaaaaaagttgggaacttgctttgtgttagtttaggatgacccagaatagatcctgaaacaagaatttagggcaatccttgtgcaagtagttcatctgagaggtgaccccagaagggttggagaaggagaggggaggtggggcaaggaagggtgagttgtcctgtaggcaactgagctccgtcctactgggagcccacgtggaactcacctcttaagtgatccagaatgaagggtgagggagctgcggtattgatccaccaactcccagcaatctttggttgagggctgctcccttaaagttcattccctgggcctgccccagatttggagacagccctaaggcaagaggtacagataccagttggccacagactgaagtgttaagacccaagcccctggataaaactgaaaaatcaagccagatgtggtggttcccacctgtaatcccagctactcagtaggctaaggcaggaggattgcttgagcccaggagttcaatgctgtagcgagctatgattgcaccactgcattccagcctgggcatcagagcaagaccccatgtctaaaataaaaataaactgaaaaatccccaagttatttgctgtgaccaaccttccattaaccacagaccctctggtattcagcatttcttgtccattatatgaagttctgatgacagtctcttttattgtattgtgccttgaccacgcactgtacatcacttagctctgaaatggacatgttcaggaaacagggccaggtgggaccctgtgtttcaacagcaatacttttacaaatgaggtctcatgacagggtcttgctcggagggtttctatggaagcctcatcccacctactgctatcatccttactaacttgcatttacaaaagggactctttttgaccagaggcttggggtctgtagctgccttctagccagctgatgctggctggtccacacaagcaggatcacacccatttttttgttttcttatttatttctgaataggttagcataccggtaacctgtgtgcctggcattgtgctgaccactttttgtcaacttactgaatcctcacaacccttggaggtattgatactattgttatccaggttatacaaaagggggaaactgaggcacagagcagggatgtcccttgcccaaggttacccaactggaaagtggcagatctgggatctgaacccatgcaggctgggctcttaacactgaactactttcctgccatttgttaaagagccacaaaccaggccaggcaccatggctcacgcctgtaatcccagcactttgggaggccgaggcgggtggatcacctgaggtcaggagttcaagaccagcctggccaacatggtgaaaccctgtctctacaaaaatacaaaaaaaagtacccgggcatgatggcgggtgcgtagtaatcccagctactcgggaggctgaggcaggagaatcccttgaacccgggaggcagaggttgcagtgagctgagatcacaccattggagatcgcactccagcctgggcaacagagtgagactctgtctcaaaaaaataaaataaaataaaataaagagccacaaaccccgaaaggtctgccattcccccagggccccaggccaccccacaatctattgtcattgtaggttgtgaaatatactgaatgtcaccccaaccttgagccatggggaagattccatttctctcattgcaacatttgtgcaacatgaaccatctgttgggggtcttcgtaaatcaccttttatcccgtgaggcaggtactgttaagaccattttacaggtgacaaaactgaggccagtggtgtcgagtcacctgcctgtggtcacccaaccaatacaggacagcttggaatcccaagcacccccgccctgctgtctgacccccaaaacccaccctctgttctccattctggcttctttctttcagcatcttggcgacagttgggacggagtttgacctacggacgctgagggcagttcgagtgctgcggccgctcaagctggtgtctggaatcccaagtgcgtgagtttccgaccctgacaaggggtttgctcacgggccccaggagccctcagtttcccctatgcagagcatctcaggaggccacatcctgccaccagcctgtgtgagggcagtctcttctttgggactccctatagggaaccccctaggaatatgactgtagctccccatgagctcctgaaagcaaactaggagccacacccatttattgagcacctactgtctatcgggagccatgctaagcaccacgtgtgatctcattcagtactcacagccctatgaagttgataggactgatgtctctattttatggagggggaaactgaggctcagagtggctgaaacattggagcagggttttgtggctgagaagtggcagaactaggagtgagcaagtgtgactccaagcctgggccgtaccactggtggcaatgaccattcccatttaatgagtgcctgctgcgtgcagggcactacagaaggactttacatgaattaccttatttcatcctcacagtcacccagcgaacacccattttacagatgagacggttgaggcttaaggaggttaaattactcacctgaattcttagagtggacagtaatgagctctaaaattcatactcattccttgctgctttctcattctccacagatacatctagtccccgtttaagggtggctgccatatgcagggtcaagattaagtataggttgagccaaaaaaaaatgtaaaaagcaaaaataaaacagggctgtcctttttctatcttcttgtcttggttaataataataatttagccaggcatggtggctcatgcctgtaattccagcactttgggaggatcacttgaggccacaagttcgagaccagcctgggcaacattgtgaggaacaccacccccacccccccgccaatatctacaaattttttttttttttttagaaattagccaggttgactgggcacagtggctcacacctggaatcccagcactttgggagaccgaagcgggcagatagagcgagctcaggagttttaagaccagcctgggcaacatggcgaaaccctgtctcaaaaaaaaaaaaaaattagcaggcatgatggtgcacacctgtagtcccagctacttaaaaggctgaggcaggaggatctgagcccaggaggtcaaggctgcagtgagctgtgatagcaccactgcactccagcctggacaacagagtgaaaccttgtctcaaaaaaacagacaacaaaaagtttaaaaacaaacaatttataggctgggtgcagtggctcatgcctataatcctagcactttgggaggccaaggtggatgggtggatcacctgaggtcaggagttcgagacctgcctggccaaaatggggaaaccccgtctctactaaaaatacaaaacttagccgggcgtggtggcgggcatctataatcccagctactcgggaggctgaggcaggagaatcacttgaacccggggggcggaggttgcagtgagctgaaatcacgccactgcactccagcctggatgaaagagtgaaactccgtctcaaaaaaagaaaaaaaaaaattaaaaagcacttactatgtgccagacattattctaagtatttccatttttttaaagtcctttatcctcccaacaagcctgtgaagtagtctcttttattatcaccattttacattttattggcttcgttcttccggttcattgctacccaggtttaaagagtaagatttcccagaggatcaccagcaggatctttttgtagaaagaagacacttctatccaaggtctctgcaagatcccagcagatgcctgcatcatattaaattaagggccatcccaaatctaatagtcaaaagagccaggtgcagtggctcacacctgtaatcccagcactttgggaggccaaggcaggacgattgcctgaggctaggagttcaacaccagcctgggcaacaaagtgtgaccctgtctcaaaaaatatatgtatattataatagcagtagtaacaagagtctctgtttaatgaccacctatgacttaccaggtacttcactgtgtgtgaactctctcatctaatcgtatgagggaggtactattgcagtccccatttacagatggagaagctgaggtttggaattcactagtaagtggatgactaggtcaggttcccttgaagcggatacttaggtgggtgttcagatgcacctgctttattgggggacggctcttgggagagacagcaggagatcagcagggtggggctggggaatggatagagcagggacgcaatttcagctggagtgtgtgtgacaccagagttgtcctccaatgcatggcaaggatgccggccttttgtacttctatagtcagtcactgtggatgggaggtagagacgcagtagctcccaggtgagatagcttttgatcaccaagggcaattctactaagaagagaggcagctgggaggcattagcaaccaacatccatagcagctggagggcgggtacaccagaaagaaaatgggatcttggccagacaccaagagtatccagcaccttaaccactgcaccacactgcatctgttagcacccacattacattttttttttttttttttttttttgagacggagtctcgctctgtcgcccaggctggagtgcagtggcgagatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagcacccacattacatttttaagcccttggagtggcatggcccctcgagctatcctgacagcttccctctcttactgtggtctccacccatcaagagccatgggaagttcctgcaatcaagaagcaaagcctcaggctatatgtttgaaccttcattttgatcatagactttcctagtagataccatagtggttacaaacataggatgttgtcatcgttcagacctgagttaatagcctcaagaaaaaaatggtagtggaaccaggtatggtgaagtgtgcctgtagtcccacctactcgggaggctgaggcaggaggctcgcttgtgcccaggaggtcaaggctgcagtgagccgtgatcatgccactgtattccagcctgggtgacagagcaagcccatctcaaaaaaaaaaaaaagccaatgataggcagagaaatactaactaaggctcttgctctgtcgccaggctggagtgcagtggtgcaatcacagctcagtacagcctcaacctccccagactcaagcaatcctaccatctcagcctcccaaatagctgggactccaggcacacagcaccatgcccagttaatttttttgtattttgtagagacagggtttcaccacgctgctcaggctggtctcaaactcctgagttcaagtgatccacccgcctcagcctcccaaagtgctgggattacaggtgtgagccaccacgcttggccagctattattattattaacattcttcgagtcttacaacagtggaacttttagtgcaggatgcgaatttcagtattaaccccttcctctcccaaaaggatttgaagcccagagtaattcagccgccatgaatgaaccatttgttagatgagaggctactggaggctgagcttggtaggataagagcttgcatggggtccctgattgatgacaatacccccagatttaggtcttcagatgcccagttgggtgtgtcttctgttccactgtgtcccttcggggactgttccctgccttctttctttttgagatggaatctcgcactttcacccaggctggagtgcaatggcgtgatctcagctcactgcaagctccacctcccgggttcacaccattctcctgcctcagcctcccgagtagccaggactacaggtgcccgccaccacgcccagctaatttttttgtatttttagtagagacggggtttcaccatattagccaggatggtctcgatctcctgacctcgtgatctgcccgcctcggcctcccaaagtgctgggattacaggcgtgagccaccacacctggccccctgccttcttattcaccaccatctttctgaattgggttgctcagaacagagaaagcaacatcagcacatgggcaaacatggggcttcatttcagatggacctgggttcaaatcctagttctgccttttttttttttttttttgagacagagtcttgctctgtcacccagactggagtacagtggcgtcatcttggctcactgcaacctctgcctcccaagttcaagcaattctccttcctcagcctcccaagtagctgggattacaggcgctggccaccatgcccagataattttttgtatttttagtagagatggggtttcaccatgttggccagacttgtcttgaactcctgacctcgttaatccgctggcctcggcttcccaaagtgctgggattagaggcgtgaaccgccgccgcgccctgcctagttctgccatttctcatgcattctctgggtgaatcacagcatctctgttagccttgcttcccacttctgtaaaatgagagtgactttacatgtatggccacctcaggggcttgtcactagaagccagtgaaataatgttgagtctggttccttggggttgaaattgggaccgccaaccgctttcctacccagagcagcaactagcctatatggcggccttttatgaatgaggaaaagacaccgcctcttggcagaaaaaaaaaattaagaaaatggctccctcttctgggtgcaagttgcccaacacccaggaatatggctccaaaagcaatggactcccacccctttcttgcccaaaagatcatcaaatggaacagcatgtcaaatacctttattaagtactttaaagttggctgggctctgtggctcatgcctgtaatcccagaactttgggaggcagaggctggaagatcgcttgaggtcaggagttcgagaccagcctggataacatagtgagaccctgtctctataaaatatatatatagatttatttgagacagcgtcttgctctgccactcaggctggggcgcagtggcacaatcatagctcactgcagccttaacgatcctcctgcctcagtccctagagtagctaggactacaggcatgcaccatcatgcctggctaattaaaataaataaataaataaatactttaaagttaaaagtgctttttaaaaaataataaggccaggcgtggagactcacgtctgtaatcccagaactttggaagaccgaggcgggtggatcacgaggtcaggagatcgagaccatcctggctaacacggtgaaaccctgtctccactaaaaatatgaaaaattagctgggcctactcgggaggctgaggcaggagaatggcgtaaacctgggaggcggagcttgcagtgagccgagatggcaccactgcactccagcctgggcgatataacaagactctgtctcaaaaaaaataaataaaataaataataataataataggggccaggtatggtggctcacacctataatcctagcactttaggaggctgaggagtttgagtccttggagaccaggggtttcaggccagcctgggcaacatagcaagaccccatctctacaaacaagttttaaaacttagccaggcatggtggtgcatgcctgtagtcctagctattgcagggactgaggcaggaggatcacctgagcccaggaggttgaggctgcagtgagctgtgattgtgccactgcactccagcctgggcagcagtgcaaaaccctgtctcaaaggaaaaaaaaaacctaggaagtgttgttcccatgataaggatcagcctccgtgtggtgcttccttcaccattgcccaatccccaggctcctgggtgcttaatgttccctcaggaacacacctgctttgtctgggagagacctgggcgtcttggtggcggggtttgggggtacttgctcatgggcttatggggcctctctctgtgtccccccaggtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacaggtaggtccacggagcatgatgcatctttccagttttctccttcagggacaagctcttgggaggattaggcaggggtgtgcttctttctcctggcagctgggaggaccgtctccttcagagagcactacaggagaggcagtgagtgaaatagcctctgagatcttagctgttgaaaggggtggggttccacagaaggtgacccagcagagaaagagtttatttgggaatgatcccaggaagcaccatcgggggaatgaggaagtgagcagagaaagaagggatcttttaaagagtgtgctatcaagcgggttaccacttaaaactgggactggatccccctgggcacctctgggagacagcaaagaacacacaactcagctggtcacggtggctcacgcctgtaatcccagcactttggggggccaaggcgggtggatcacctgagatcaggagtcagagaccatcctggccaacatggtgaaaccccatctgtactaaaaaatacaaaaattagctgggtgtggtggcaggcacctgtagtcccaattactcaggaggctgaggcaggagaatcacttgaacccgggaggcagaagttgcagtgagccaagatcacaccactgcactccagcctggcgaaagagtgagactccatctcaaataaataaataaataaaaatataaataaaaaaagaacacacacctcagagccgtcccagccaaggggcaagggagctggggtatttatacactggcttctttttgacattggtgaggactgctcctagagtgggaattaatgcctggcacatctggctgagtggaacaggtattctgggtgctttcagacctcgaccagtcctgacttctaaagcaagcaagaagtggggagagttgggccagaaaagggttattgcctcaatgcattgtgagtggtaccttgtggaaggtgagagacagagaagattccaggcacaggtgccatgctaaacgatagttctcatttattataggaacccatggatttattttgttctctgccctgagtgctgggtgagagtactggatgagtcctcctggtctcccccaacccccaggatgtaccagagataccccaattgggagtcctggcaccaaccaatcagaacctagcactcagcagcattctgcccctccctgactatgcccacattaacccttcagtggctgggtctgggggtagggtgagccccggaaaagccaggcagcgcagagacactctcccagggctcagctctgaaccagcagtgtggaagcagtgtgtccaccacgatccacactcaggaaccaaatagcccttggatacgttttcagttaaatctttgccatccaaactctagctgcttgctctctaaagctccagaatgaaatggaatcaagtaggaagggatgccttcagtatttcagtatttggaccactggccatctgggtgcagacagactgaatagcagttctggttctgatgatttgggtcaagggagctgtgaattgaaggagtggatagaaggaatcaagaagcccaaaggggaacccaggtgggcagagaaagaggtttcaggccccttatttgggaaaggcagccacagaagaagattctgtctgggagtggatttccacccaccctctccacccagtgacccccaagtggatccgcagaggcagcccctgagccctccctccccactcctccccacggggagggaaaacccactggggaaggtttatttgcaatggttggaggtttgggtttttttgtgggttttggtttgttggttttttttttcctctttttctcttgctcctcctgtctctttctctcctgggcttgtgaagtttgctcaatatggaatgtcctaattatttctttccccgatgaagaaggtgttaattgaggcagagctatttctgctcctggcctcgtcacccaggcggaaatgcgagagagagagagagagagagagaatgaatatggggcagggcctcttggaaaaatcagccgtgagcagagaaaccaggactcctggatcctaggtttctgtgaagttttattttatgtttttctaccctagactagctaaaggagaagaggccatggggttggcttgggtccgagtggggttttgaggggacagatgtgggtggtgccaccagaggggaggaagcctcgatttaggagaaagactgaaaagctagctcacgattaaaaatataagacgtgtgagtaagagacagatatatacagacacccaggcagtgggttaattttaaaatgtatttataaccgaattcctcagacactctggacgcttgtttttctagaagcaacgctcagagtgtttcgtgtcggtggttggggggttgagggggattgcaaagctgctaaagatagacccgttttcagtagcattcctcagtgtcgggagcccagttcctgtgtgcccagcaccgtgccaatcgcttagaaggaagcaaagataaagtggaaggcttcctgctttctaagagcttccaaaatagttagaggaaacaagacccctcatttgcagccatttttaacagtgaaggctaatgtgtgattatacccacgcccccctaaatatgaaaattcagtagctattgtatgcctgaaaggggccaggtgcagtggctcacacctgtaatcccagcactttgagaggctgaggtgggagtatcccttgaggccgttagtttgagaccagcctaggcaacatagccagaccctgtctctgctaaaataaaaatttaaaaattggccgggtgcagtggctcacgcctgtaatcccagcactttgggaggccgaggcaggcggatcaaaaggtcaggagttcaagaccagcctggccaacatagtgaaaccccgtctctactaaaaatacaaaaaaaataaattagccgggcatggtggcgtgtgcctgtagtaccacatacttgagaggctgaggcaggagaatcacttgaacctgggacatagaggttacagtgagccgagatcacgctactgcactccagcttgggcaacagagtgagattttgtctcaaaataaaaaaatttaaaaattagccatgagtggtggtacatgcctatagtcctagctactcaggaggctgaggaagaaggatcacttgagcccaggaattggaggctgcaaggctgcagtaagctatgatggtgcccgcactccagcctgggtgacaaagtgagaccctgtctcaaaaaaaaaaaaaaaaagagagagaggaaggaaagaaggaaggaagggagggagggagggactggggctgtgttaactgggctacacaaagaggctacatggagggtgggaattgagccagacttggacatggcgtggagacagagaagattccaggcacaggtgccatgctaaacgatagttctcatttattataggaacccatggatttattttgttctctgccctgagccttatgtttaaaagatttttgccttccaacctgtatttatcaaataatagttcatgtaccaagtccagcataagtgaggaaggcgtttccaacaacttaagttcatggcgaggctagacttggagtttctattcagccagagcttgaaaggccaacaagattcattcattcagcattggtttatttccctctgctgtgtgctcagtcaagggagcagagaattggtgctgcgaagtctgtagcacatacattgagagatatttttgttgagtaggaagcttgagtttacacacactcagctgtttgttttcttgtccgacaatgccacggtcgtctttgaaaaccttcaaaagcatcgctcacagaataaggtcctctcagacccgctgtgctggtaaaatgaggacactcccagatgtgagctttcctgcctccctaccccatcaataccttaagatttggactgacctttagcgttcagcctgactgccacctccccaggaagctgtctttggtttccagcaaaaggggtgtctgttggcacgtttctctctccttgtggcattttcacagcctgcctcctgctatttggggagaaagctcagctcctgttccttacccttaggcaagggtaggaactgtgtgtactggtgtccctcacccccagaacagctccctgagcccagtacatcccaagaagaaaaaaatcagcaaggcttataggagaataacacaatgcgcttgacaaatttgtcctaatggatgtcggaagaaggctgcacttaccagctacaccatgcacacggcacatttactaaaactgactatattatggaccataaagtttgtctcaacagaggtcaaaaagctgaaaaaaatacaaatacaaaacatattttctgaccgtaatgcaattaagctggaaatcagtaacaaaaagagaactctaaaagtgtttgcagattaacagacatgcctctcatttatggatgaaatgatatgatgtctgagctttgctttaaaaatattctaggctgggtgcagtggctcacgcctgtaatcccagcactttggaggccgaggcgggcggatcacttgaggtcaggagttcgagaccagcctggccaacatggtgaaaccccatctccactaaaaatacaaagattatccaggtgtggtggtggccacctataatcccagctacttgggagcctgaggcaggagaatcccttgaacctgggagtcggagattgtagtgaggtgagatcatgccattgcactccagcctgggtgacagaatgagactccgtctcaaaaaaaaaaaaaaaaaaaaattctagtggcaaggcaaagtgtttggaggggatacagaggaatagatgaaacaaaatttgccagaagtaaataggtaagtgtctaaattggtgataggtacatggtgaatcattatattgttttatacttctctctcgctctctctctccccccgttctctccctgtcttcctctcccctctgtcttcatatatatatatatatatacacacacacacacacagacacctaataagtttttttaaaaaacaaatacatctaaattacccataggtcaaagaagaaataataatggaaattagaaaatattttacttgaacaataatgataatgcatgacaaaatgttgagatgcaggtaaagccacacttaaaggcaatttatagccttaaaggcagttaatccatccatctcaaaagtttaggaaaagaatagaaaaaaaaaaaaaactcatggaaaacataaagagaaaagtagtaaagctcagagaagaaattaatcaatagaaaaccaataatagacccccaaagccaaacattgatctctttgaagactgatcacgtttgtcccaaaagttattcgttccaacagcattatagagtcactggtccctatttctcagagctggttttccctgctccttcccctgacttttctccccttcccttttgtagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatgtaagtgatgctgggacagtgtgtgtggacaatcagagtctcagggaggtggcctcctgggaccagtgagactccaaggctgcaatggagggaccctgagctgggaaaggcagcccaaggacaacacagccccactgaagctggcctgaggctcaggcttttgaagattacaggggctcatgagcagaactctaactatagggcatagaagtctggagggcccccagatgcaacatcatttttcattgtgcaagtgtttagatataattttagatttttgaatacggaaaggttatgtgatccaaaaaccaacacagataaaagatagagtaatatctttggacgtaggcgaggggtccctgccctgaggctcacccagtccttctccagccataccactccccgtgggatgagaagttcctggagccaaggggatgtgtctaccaagagcttgtgccccactttgtaggccatgttttaagttaccaggatcctggaattccctgcccatggccagattccatgaacttgcgtgcaattctcatatggatctgttcgtaacccaactgagggccaaggacatccgaggggtggctgttaacacaaatgtggccagagcttggatgtacaagctggaatgcccacacatatgtgtggagcccctctggcaggacagagccatgactaagaagagaaagggacaggacagggctggctctccccacaccttgacccagtgcagatatccggattctaaattccaccctgaccttccaaagtgtaaaggaaggtatatttgcaaagtagaagcacacagcatgttttatttagttaccttttcaatatttccccgtagtatgtggtctgcttttgtactcttgccctagatcttaaaaatgttagggatgtttctggaaagatgtatccctgcccccacttgcatgctacttcctcttcccacaatatgcaacccctttagttcctcagaatatccttccaatgtttatttatgcaattataattataagcataatcgaatctatgtcctcccccctctttcttatcccaaggagtagcattctatacatgctgttcaattctgtgatttttgttttctcataaccacacgttctagagatctttccactgcaggacatggacagtctcttcacgggtgcacactagtatgcccagctaatttttgtagagacagggttcttccgtgttgcccaggcaggtctggaactcctgggctcaagcaatcctcccgcctctgcctcccaaagtgctgggattacaggcgtgagccaccacgcctggccttctttattcttttgcacagctgcatagcattctattgtgtggctgcccatagttttatttgtttgccattaagagaaatgcttgactggcttcctgtccactgacatggaacatgatgctgctctgccaggagcatgttgcacgtacctcttcatacttttgcagatatagctagggggttggagggtctccattcccagaagtgggattgcaggatcaaagactaaatgcatttataattttatttttggggaagatttttgttttgtttttttggagacaaggtctccctctgtcgtccaggctggagcgcagtggtgtaatcatagctcactgcagccttaaactcctgggctcaggtgatcctcccaccccagcctcctgagtagctgggaccacaggcacacaccaccatacctagctaatttttaagaacaattttatagagatggggtctcactatgtttcccaggctgctctcagactcctggcctcaagcaatcctcctgcctcagcctcccaaagtgctaggattacaggtgtgagccactgcacccagcctaaatgcatttataattttgatagatatttaggtgtgcaagttttaaaccccactctgtcctcaccacagttcaccttccctcacctactatgcaggtaagcagtccccaggcaggtcacttgtcagcagctggagtggggcagagccaaggattcaggatcaaacacaaggatgccacaactgtagtgaccccatagagcaccctggggctgctccatacacacagctctgttgaccagtggaggtctcctcttcacctgccctaagggctgaaattaccattgaagtttaggccagcggttggcctgacccgggagcaatacctggcttcctcctcctgtacatagagaagctgaactttcctcttggtcctagtgtatgttccttaacaacccatttatgcctagtgttccattattggaatgctaatcctgtgggagttatttacatcctgctgctcaaggtcatcactaaggtcggatttttcacacacacaaaaattgcaacctccggcataaatgggttaaggaatttccccacttgtgggtggagggagatttgcaaaaactcatccttgtaatcctgatcaacaaaggcccgttttagttgggagtaggcagcaaaaggagccacatgaacagttgcgcctgtcacgcactgcacaagaatgtcattcatatcatagacaacatacgatttctactgttatcctgataatttattgacagaaaaaaggatgtggggaagggacatggtgttctaatttgcatgaaaacctcgtctgagtgtagcatctctgggaacatgcagcagatccgagctcaggccctctcttggccgtcacctgcaaacagcttggacaaagggtcagcccaattggccaaaactcactggggaatttttgtgggttctaggtttttactttgcaaggctggtgtgagaggaggttccagcaggaaatgaaccctcctgagagggaaagagactgggaaatggagaaggctgggaactcagggagagaatgggagtggggaatgggagctgaaaaaaattgtgagcataaaaaagggatatgtcacagggttggatgaccagagaaagcgtctgggggttcagattaagatgctgggggcgtgcccagtggtgggacaggaagcatgaatttccagagggctcggttataaacatcattgtccaatgggtgtttcccttggaagcctctaagcttagagctaagccacctctggggacacaaactgagtggttaagagcagagactcaggtgtcagcctgtctgggttccttccgactcttccacttccttgctgtgcagccttcggcaaggtgcttggcctctctgtgccactatttccacatgtgcaaaacgaagagaagcatagtcccacctcacaaggcacgaggactaagtaaggtggattcgcatgaagtgtttagaactgatcctggcccggggtgacctccgtgtaagtcaaattcctcaccctgcatggtgttccttttagaaatgtgcatgaatttttcattagaacagctccagcagtgcctgaggaagtggagtgaggtgtgagaggtcttactttattcccctcgctggccctgctattaaccactaactcagagtagctttctagcactttccacacatttacatcccaccctcgtcctttggttagcagcccatgcaatgatttggccttaatgtgaacctagaacacagcttctcgcccagggatgatttctgcccccaggggacacttggcagtggctgcagacatttttggttgtcacaactggatgggaagaaggaggatgctattggcatcaagtgggtaaaggccacggatgctactcaacattctacaatgcacagcatcccccacctctgccccaccatagagaatgatccaggcccaaatgtcagtaaggtttctgtcaggaaaccctgggtcagaagaccaaggttccttgaggacggggatgccttatactgcaatcagctgtcactctctgcctctctctggggctgctgtgatcacctggcctgcatggacaacccctaggagcagcccccatccagtgcctggagaagtcagtggataaataccccagctccctccctgtcgggcgttttgctctgccctgcatctctccagtgggatcaggctctggttgcccgcagggttaacctggtcacgtacacacccttcacttgccaccttcccttccctgtctggtatttcctgggatgaacttttagatttatttcctggggctgctataatgaagcaccacagactgagtagcttaaaacaacaggaatttatggtctgacagttctggaagccagaagtccaaccccaagatgttagcagagctgacaacacgcccctcaaaagcctccgggggaggatccttctttgcttcttcctggcttttgctggtttcccacaatctttgggattccttggcttctagagccttcattctccattccagtcttctgtcatctaatagcatcctcccagcccgggcacagtggctcacgcctgtaatcccagcactttgggaggccgaggcaggcagatcacttgaggtcaggagtttgagaccagcctggccaacatggtgaaaccccatctctactaaagatacaaaaattagccaggcgtggtgggcgggtgcctgtaatcccagccacttgggaggctgaggcaggagaatcacttgaacccgggagatggaggttgcagtgagccaagatcatgccactgcactccagcctgggtgacagaatgagactccgtctcaaaaaaaaaaaaagaaaaagaaaagcatcctcccttcgtgtgtctgtgtgtgttctcctcttcttagaaggacatcagttgtattggatcagaacctaccctactccagtccaacctaattttaactaattacgtctgcaattaccctatttccaaataagatcacattctgaggtaccagggggttaggacttaaacatttttgtgtgtgtagcaggaggacgtaattccatttataactcctcctaaataaaacgacttgcatgtgaactcttgtctggggcttcccaaagtgagataacccctctctctacccctaaaacaacgagtagcgtctgtcaatgccagggtgcaggggctaaggtgcccatctttgagtttctgctgaggaggacacagctgctacgttggagcactcttgggttctgccttcgtgcccagccatctcccttgggctagccctgccctgggtctatcctagaatgagcctcgatctgtttggccataggcaagcagagtgtctggaaatctttgtcctccatgactggtgctggagccgaagccagtgggtgtggccttgccagccaactccatttacccagctctgaacaagctagtagttgagatcaacggagagtccagacagtcgctccaagcatcttggaatccatggacacaggtgtaccgcagaggcttcccacctgggtaggcagccctttgtaagatcctggcaccacatttattctcttaacatcctttcagttatccagtaatcatttattgagcacctactgtgtgccaggcaatgattaggtgattggagacactgcaacgaagaagacagactaaaatctccaccctggtaggagagacagatgcaaatggtaaacatgataaataatcaatcacccagaaagcaggagacactaagcaaatgtgtatgtactatgggaagcccaataggaacgaaagctacacaagagaacaagtgatgggtggttccttagtctaggtcaggcaatcagggagggcttctcagaggaggtgatgtttgagcagagaaggagggagccaggcagatgttttggaaacagcattctcagcatggagaacagtggcagctcacctacaggatgtgtttgattcccttccagattttgtattcgtttcttgtttttctcccttggcttcctggtttaaatgccttttgaagaaatctaagctcaactaatcagcgatgctgttgaaggtttatatcaggatatgcatcccagagttatttacaaaattagaacaaaactggaagcaattgaaagcctgacaataggagatcagttaaataccgtatggtccttccgtatgatggcatattatgtcatcattaaaaatcgtctgctgggagaatattaaggatacaggggaaaggctcaccatataatgatgagtgggggtgctgggcgcagtggttcatgcctgtaattccagcaatttgggagtctgagatgggtggatcacttgagcccaagagtttgaggccagcctgggcaacacagtgaaacccaatctctacaaaaaaaaaaaaacaaaaatacaaaaatcagccaggcatagtggcgtacatctgtagtcccagctactcaggaggctgagacaggaggataggatcacttgagccctggagtcagaggtggcaataagccgtgatcacgccactgcactccagcctgggcaacagagtgaaaccctgtcaaaaaacaaaacaaaaaaaatgatgagtgggagaaacaagtttttaaacagggatcaaggaggccaggcatggtggctcacacctataatcccagcactttgggaggccaaggcaggcagatcacctgaggtcaggagtttgagaccagcctggccaacatggcgaaacctcatctctactaaaaatacaaaaattagccaggcatggtggcgggcgcctgtaatcccagctacttgggaggctgaggcaggaaaatcgattgagcccaggaggtggaggttgcagtgagctgtgatcatgccactgcactccagcctgggcaacagagcgaaagctgcacgagagaagaagtgatgcatggttccctagtctaggtcagccaatcagggagggttcctaagaggaggtgatgtttgagcagagaaggaggaagccaggcagatgttttggaaacagcattcccagcatggagaacagtggcagctcaccctgtctagaaaagaagaaatgataagaggggaaaatgagtttttaaaaaggaatcaaggggaggtaaaccttatgatctcaaaggtacaaatatgaaaatataagtaaagaaaaactggaggacactgtaccaagctgaccttcgggtggtgggatttgggaatcttgatattctcaatacttctttgtatcttcaaatttctctatgatgatcacagtttactttttttttttttttttgagatggagtctcactctgttgcccaggctggagtgcagtggtgcgatcttggctcacttggctcacctctggggttcaagcaattctcctacctcttcctcccaagtagctgggactataggcatgcaccagcatggtcagctaattttttgtatttttagtaaaaatggggtttcatcatgttggccaggctggtctcgaactcgtaagttcaagtgatccaccaacctcagcctcccaaattggcttgagccaattaaacttgtcttgctaaatggttagcggggagaaagaagaaggtctcgggtcattcctagaccaggaggcagggagaaagggaggagaatgaacctttcttaggcaaacagtgtcctaggtgtccttatcttacataatctgtcgagagagtcacactaaaataaatcattgattgattgattgatacatcaataataaatggccagccttggtggctcacatctgtaatcccagctacttaggaagctgaggtgggaggattgtttgagacaaggagttcaagaccagcctgggaaacacagcaagactcatcttaaaaaattttttttttttaattagccagatgcggtggctcacgcctgtaatcccagcactttgggaggccgaggcgggtggatcacgaggtcaggaattcgagaccagcctggccaacagggtgaaaccccgtctctactaaaaatacaaaaattagccaggcgtggtggcacacgcctgtagtcccagctacgcaggaggctgaggcagaagaatcatatgaacctgggaaacagaggttgcagtgagctgagatcacgccattacactccagcctgggcaacaagagcaaaactacatctcaaaaaaaatgttttttaattagccgggtgtggtggtccatgtctgtagttccagctacttgggaggctgaggcaggaggattgcttgagcccagcagttcaaggctgcagtgagctatgatcccgccactgcactccagcctgggcaacagcaagaccccatctcttaaataaacacataagtaaataaatgatcatttttattttattattaaatacacaagataaatgaaaaacaggcaaatctttcttacaaaagaattccatttaaagtatgtaaacttcactccccactgccccaggaggtggagactaatctcccctactttgagagtgggctggatttagtgactcatttccgaagaatagagtaggtaaaggggaaaatagaagttttatagcggaggaacagatagataccactttaaccaaatgatgaagattagtatcccccagggatgtggatattatgtaacccttgattttatgcctatatagcgttcttcccaaaaactcctaatcccagttttttggggttttgctctgtcttctaagctggagtgcgatgatgcaatcatagctcactgcagctcaaactcctggtctcaagcgatcctcccacctcaacctcctgaatagctagggctgtaagcacataccatcatgcccagctaattgtatttttttggtagagacatgttctcacacattgcccacgctgtcctcgagctactggcctctagtgatcctcccaccccagcctccagagtcactgggattataggcatgagccactgtgaccagcccagaatttttttttaaggagttgtgatgtcgtttaagagatgtgattcttcataacacatcaacaacaagtcccagcgatgggttggataagtcttgggatttcatgggagtattaagcttaaaagactttgcatgatatctgtgaactatatgtgatttctgttggtaatgggggtcactgattctgcggtttgccacctccaatcatcatggaagaaaatgttccacttccagtgaaagtaagaggaagtaaaggggtaattattttctatctaaattcacgaactccttgaattctgtccacagacccctaagtgtttcctccccaaggtgaaactgagagaatcttgccagtgccttccgcagtcactgtggctagaaaacccctcagaagaggtgatagtttagcaggtaactggagttctcaccatccgtgtctggctcagcccccatcacaaccagttacccagcccaaaatgtcagtagtactgaggttgagaggctctgctctaggaggccaggcctctcagaggaaggaggattggggtactggctgggcctcaagatgaacctaccccctaagagctttgggatggcgtgagtttctgtccatacccaaggactacaaatgcaggtttactggaaattctgtgccaaaagtgaggtccaactcacttctaactgctacaaaacaaacctccatcaacatagcccatctctgttcttgacctggaagctccaaggtatccacatggctcccatgcccactagacgggcctcttccctggaccttcctgggccagagaaggctctgggtagccttgtggaatcaagatgggtgatcagccacttcctctgtgccaccctgttttggctacttccctaggcatcagcctgggattccttgatggtaaaaatataaaactctctgagctagggcctttaatatccccattttacagatgaagaaactgagtcccagagctgtgcacagcgattgagagtcagaattcagctctgtctcactcagtgtcaacatcctcagattctgccatttatagcctcccacagcaaataggattgagggctgcttctctgagctcaaggggatagaatggggaaccccatgagtactgcaacaaaactgtttgctggagacaagagctggtggctctgtgttgttctagtgacaggtggcctcatttcacagggaccccctcaccctatgtgccccatgtggctcagaaaagccagaaattgtctccactctcacaggggaaggtccctgaccccctctttgccagctgggccaaggcaaattggggtcacttcatggggtacaggacctaccctctcttggttgcccccaaggaggggatgtggaggggctggggacctggcaggaccagggtgtcttgagttaatttggggctgcctttagccgagggcttctgtgtgcctggcatcagctttacattgtgtcttgatccgtaaaacagccctgtgaggaaagatatttttaaccccatcttccagatgaggaaacggaggcccacagggtgacgtgacctgccaaggtcccctagccaagagtgacaaagccagggttcacacacagctctggacacaattcatcacccttcatccgtctctctctgactctttctttttccctctctctctttgtctctcttttttttttttttttttttttgagacagcgtctcactctgtcacccaggctagagtgcagtggcgcaatctcggctcactacaacctccatctcctgggttcaagcgattcttgtgcctcaacctcccaagtagctgggattacaggtgcgtgccaccacacccagctaattttggggggttttgttttgttttgagatggagtcttgctctgtcgccaggctggagtacagtggcgtgatctcggctcactgcagcctctgactcccaggttcaagtgattcccctgcctcagcctcctgagtagctgggactacaggcatgcaccaacacgcccagctaattttttgtattttagtaaagacggggtttcaccatgttggccaggatggtctcgatctcctgagctcatgattcgcccgccttggcctcccaaagtgccgggattacaggcgtgagccactgtgcctgccaattttttgtatttttaacagagactgggtttcaacatgttggccgggctggtctcgagctcctgacctcaagtgatctgcctgccttggcctcccaaagtgctggtattacaggcatgagccaccatgcccagcctttgtctcttttattcttgtgttctctctctctcttccttctctttctccacctccttctccttctctcccttctcctcacccttctttgtgcttttctctgtgagtttctcttcttctctatttctctcctttggtgaatgtcaattagaaaagcagaaaaactgcgtttaatttgtgatcataaatgcatgtccctggccaggcgtggtggctcacgcctggaatcccagccctttgagaagctgaggcaggaagattgcttgagaccgggagttcaaaaccagcctggtcaaaaagcaagaccccatctttaaaaaagaaaaataattaattagctgggcatggtggtgtgtacctgtagtcccagctactcgggaggctgaggaaggaggattgcctgagcccaagggtttgaagctgcaccgagctgtgattacacccctgcactccagcctgggtgacagaaccagaccctgtctcaaaaaaaacctaataattaaaaataaataaataaataaatgcgtgtcccctggccagtggttgctaatgtttggaatcacctttgacccatgccctttttcattcatagatgtttgtcttgaccaaaatcaaagcattagactttggactataaatcactggttcattcaacaaccatcattgaatgcctactgtatgcagacactcttctggacacagaggagttgacgtgttggtggggaaagccagtgatcagttgggataaaaagggcagacagcagacattaaatagtttaggctttgtgggccagatggtctccatcgcaacgactcaatctgctcctgtagcgtgaaagtaacgacagataaagcgcgtaagtgaatgagcatggctgtgggccaattaaacgttaacctataaaaacaggtggctggcccgcgggctgtagtttgtggatcactgccttagagatagtgttagagggtggtgagaggtccgggatagaataaaacagtagagagtttgtgcattgtcaagatgagaggttgcagttcttcttatacaccccgaatggccgggcaccgtggccattatgatctataattctaacactttgggaggctgaggcaggaggatcccttgagccctagagtttaagaccagcctaggcacatagtgagaccccatctctacaaaaaaaaaaatttaaaaattagctggacatggtggagcatgcctgtaggcccagctacttgagaggctgagatgggaggactgcttgagcctgggaggttggggctgcagtgagccgatcatgccactgcactccagcccggatgacagagcaagaactgtctcaaaaaaaaaaaacaaaaaaacaaaaaaaacagacctgaaggaacaaatcatatgaatgcattaaagtatcacatgtatccaaaaaatatatacatctatcagcctggcacggtggctcatgcctgtaatcctagcacattgggaggccaaggcaggcagattgcctgagctcaggagtgcaagaccaccctaggctacatggtgaaaccccgtctctactaaaatacaaaaaattagctgggcatggtggcaggcgcctgtagtcccagctacttgggaggctgaggcacaagaattgcttgaacccaggagacagaggttacagttagccgagatcgtgccactgcactccagcctggacaacagagcaagactctgtctcaaaaaaaaaaaaaaaaaaaaaaaaaaaaaaatatatatatatatatatatatatatatatatatatatatatatatatataatcaattaaaaattttccttaataaataaacatttctctccttctctcccttggtgaatgtcaattaataaagcaacaaaactatgtttagttagtgatcattaatgtatgtccctggctgggtgtgatggctcacacttgtaatcccagcactttgggaggctgaggcaggagaggatagtttgaggccagcaattgcttgaggctttttgaaagacatgaaggagatgaagggagccatggagatatctcagggaacagcagccgaggtagatggaacagccagtgcaaaggtcctgaggcaggatgttcctggcatttgtgaggacatgtagctgcccagatgtccagtggggagtgagtgaggatgaaggaaggagctgatgaaggaagatgataaaatacttcatggatcagccaggcatggtggctcccgcctgtaatcccagcactttgggaggccaaggcgggtggatcacaaggtcaagagttccagaccagcctggccaacatggcgaaaccccgtctctactaaaaaatacaaaaaagttagccaggcgtggtcatgcacgcgtgtactctcagctacttgggagactgagactcgagaatcgcttgaacccaggagatggaggttgcagtgagttgagatcaccccactgcactccagcctaggtgacagagcgagactctgtctcaaaaaaaaaaaaaaaaaaaaaaagacttcgtgaacagacagcctatataatttatgatccaaaccaggacagttttgagagtgaaaggggaaaaagagcactgaaaaaataattagcaggcctggcatgatctataacgggtataaagtgggacacacagcctctctcacggtcactgtcagacttcagctttttcacactcaaatccacccccatgtttatcccatatactggagaaacgggtgttctcctgagctgagttttggggttttttccttttgttttgttttgtttttgtttttttaacatcctgtatactttttctcaatgaaccatgctcaaaaaaattagaggaaaataaaccgtaaaacagaaggcacttaaggattttgctgggactcagccattagtttgtttgatgagtatttatggagcgctttctaagcaccaggcaccaccagcgatactgggatgaatcagtaacatccctcacccttgaagctctcttgggcccattgttatttacttaaaatactatgcaagtacggagaaggggtgaagtgggaaaaaatcagttggttgtaaaggccagaatgacgggtctagtcccacccatgccatctgcaccctgtgtgatccaggcacatcatgttgcctctctcagcttcagtttctccatccaccaggcacagagatggcgggaatcgaggaagatgtggggagtatttcatcagcccaaaaagacttggctaatgcgaccataattctgccttctgcctctcctttcccagaaaaatagcttaatcatttggatttgggataaacacatttcctgtgtttattatttaaatgatccaccaagctgggcatggtggctcacccctgtaatcccaactctttgggaggctgaggagggcggattgcttgagcccaggagttcaagaccagcctggccaacatggcgaaaccccatctttactaaaaaaatacaaaaaaattagctgagcgtggtggtgcgtgcctgtaatcccagctacttgggaggccgaggcacaagaatcacttgaacctgggaggcagaggttgcagtgagcctagatcgtgccatcacactccagtctgggcgacagagtgagattctgtccctaaataaataaataaataaataaataaataaataaataaaataaatgatccaccaacaggaaccccaggaacatttgtattgactatgcaactaatgcttagtgagcacctactatgtccctggtgctgatctggacactgggatttagacaggaaaaatctctaccctggaggagctgatgatcaagatgacaatcttgaaatgcataagttgacaagatgattcagacagtggaacgtgctgggaagagaatgagatgtctggctgagctgcaggaaggggcaagtccttttgattgagaggtccaagaaggcttctctgatgggggcacaatggatctaaggttgagtgataagaagaaattggccaagccaagacctaaaggcagagttgctccaggcataggttcagagaatggaaataattggctgattgtgatcttgaacttgacctttcttttcttctgctaactttgggtttggtttgttcttgcttttctggctccttgaggtacgtgttgggttcttaatttgtaattttttttttttttttttgcttttttgagacagagtctcactgtggtgcccaggctggagtacagcagcatgatcttgactcactgcaacctctgcctcctaggctcaagtgaacctcccacttcagcatccccagtagctgggactactggtgcacagcaccacacccagctaatttttttatttttattttttagagatggggtctcactgtgttgcccaggctggtctcaaacccctagctcaagcgatcctcctgccttagccccccaaagtgctgggatgagaggcgtgagccaccaacatctggcctctgttttttgtgatgtaggtatttgatgctataaacttccctcttagttgcttcttggccctttagctaaggtcaagtgtaaacttccctcagcactgcttctgctgcatctcacaggtgttggtgtgttgtgtctctattttcattcatttccaaaattttttaagtctccatcttaatttctgcattgacccaatggttgttcaggagcatgttgcgtaatatccatatatttgcatcatttctgaaattcttcttggtattgatttctagttttatcccacggtagtctgagaagatgcttgacagaattccagtattttaaaatttgttgagagttgttttgtggcctaacatgtggtctgtcttggagaatgtccatgtgctgatgagaagaatgtatgttctccatcagacatgcaagagacagacactttctcacctgcctcatgggatccataaaagagtcaatcagaagttggcatttaagaaagaccagaaggaggctgggtgcagtggctcatgcctgtaatcccagcactttgggaggctgaagtgggtggatcacctgaggtcaggagttcaagaccagcctgaccaacaaggtgaaatcttgtctctattttaaaaaatacaaaaattagctaggtgtggtggcgggcacctgtaatcccagctactctggaggctgaggcagagaatcacttggacccaggaggtggaggttgcagtgagctgagatcacaccattgcactccagcctgggcaacagagcaagaccccatctcaaaaaaaaaaagaaagaaaaaaaagaaagaaagaccagaaagaggtgaaggagcaagctacagagatatcaaactgtatcaatctggctgggcgtggtggctcatgcctgaaatcccagcactttgggaggctgaagcaggaggatcacttgagcccaggagttcgagaccagcctgggcaacagagaccccctctctacaaaatataaaaatttaattaaaaagatgtattggtcagggcagccaagttatgctgcagtaacaaacatccccaaagcctccatgacttttgacaacagatgtatttcctgctcatgctacatgtccagtgcaggttggcagtggggaagaagggggctctgttcagtgcagtcacttgagacctagctaatcacctagaacattgccacttgctattccagaaggaaaaaaggaatgctagaaggtcccacactgaaagttcaatgctctggctccaaaatgacagctatttccactcactcctcattggccagcacttagcatgtggtcctcagccaaccccaaagggactcaggaaggaccatcccaccatattgctggaaatatttgatggcagcattaatggggaacagtgttccaggcagtggaagtctttgagcccttggaagaaagacaaggcgatctctagagcacatccttcccaatattaatgaatttaacaaatgagcaagccatcctcccccactctccttcccgaattcagacttgtgcatatccctcccttaacttgaactgccaaagaagagatgagaaccaggagaagagatctgtgaccccatctttgctgatgaactaccacagaacagccatggcatctccagtccttgtgcttgtaaaatgtacttttcattttgctcctgaacgaaatccacccacccccacccccaaaccagggaaagctcatctcctaatccaaaactgcacccagccttccaccaccttcttccctgggaattgttgattccagagtatggaattgaataattggatgagtttggaagagaaaaagtgtctctaaaatcaggcagcagaagcccactccccagagaggatggtgcagatgagagttcaggagggagcttggcttggggttgacgatctgagctatgcagggaacttggacacacctctcaatcagtcattcaacagacaccacttattgagcaccgactgtgtgccagatgttgtcctagggggctgggaatacaggaatacagcagggaacaaaaaggacaaagcccctccctcttgtcgaatggacattccagccaggaagacgagagaacaagagaaataagtaaagtatataggcggtgaaatgcaaatgggaaaaaagaaacaatggggaccagaaatgagggatgcaattgtaaagggccatcaggggaggcctccctcagaaggtggcatttgagtaaaaaacctgaaggaggtgaggggaaaccatgtagcaatctcaggaaagagcattccaggcagggagggacagcctgtgcaagggccgaggtaggactgtgcttggcgtggttgagaaactgcaaggaagccaggtggctggaaccgaatgagcgagggaaaaggggaggagataaaagcaaggagatgggagggttggaggccccctctgccattcagtaactgagtaacttcatttatttcctgtagcttgaaccacaaagaaccacaaatagagtagctgaaaacaacagaaatttatttattctctcgcagttcaggaggccaggagtccacagaccatcaaggtcagctgggccacagaccatcaagatgtcagctgggccatggtgcctcctgagacttggtctgaaatcccttcttgcctccctcctagcttctggtggtttgccaacagtgcttggtggtccttgtcttgtagacgtatcaccctgatcccgccttcatctccatttcacatggccttctccctctgtgcaaggttgtctctgtgcccaggtttctccttttcttattatttacttatttgtttgtttgtttctttattttagacacagggtcttgctctgtctcccaggctggagtgcagtggtgcgatcatagctcactacagcctcaaactcctggcctcaagcaatcctcctacctcagcctcctgagtagctgggactgcagatgtgagccactgtgctctgcccagatgtcctctttttataaggaaacccgtcatttaggatgaggttccaccctaatgacctgatcttaacttgattccatctgcaaagaccctatttccaattcataggtaccagggattaggacttcttcaatgcatctttttggagagacccactgcaacccacaacagaactgtgggcatgtaacttgacctctcggccaggcgtgatggctcacacctgtaatcccagcactttgggaggccgaggtgagtggatcgcctgaggtcgggagttcgagaccagcctggccaacatggtcaaaccccgcctctactaaaaatagaaaaattagctgggcatggtagcaagcacctgtaatcccaactacttgggagggtgaggcaggagaattgcttgaacccaggatgtagaggttgcagtgagccaagatagtgccattgcactccagcctgggtgacagagtgagactccatctcaaaaaaaaaaaaaaaaaaaatagacctctctgtgcctcagctttctcacccgggaggatggggataattatatacccactcctggggttcatgagaggattaaatgagctcaaacagtccaagcctccacgtgtgtctgttgtggtgctgggtagcatgtcctgtggccagaggttcccaagcttgtcgaggacccaggcaagggcagattcgggtcttgttggcagcacctgagatggacgggctgccttggtatggaagggcctcggctgtttttccctttcagtcctgtccctctcccccatcctccaccctgtccctgtcatctgagcctgctcctcgtgatggctcagagtctccctactggcggccggtgcagagtttcgttccctgggctatatttagccctgagaaatgggaacgagaaccctcagccgccaaagtgatggagagaggagcacaaagccagtgctgccttctgtccagcaatgttccgctgactcggttctttcttccagaaccttccagaagcaaagcattggcatttctgagctcgttaaaacaaggatgtgggctggtggctggcacattcattgtccccagaacctgtctgtgtccatgattaaagctgactttgttagttttattttcagtgcttttttttttttttaatccatggcaaaacacacatgacataaaatttaccatcctaatattttttttaactttgtaacattttttaattgacaagtaattgtacttattcatggggtacatagtgacgtttcaatgcatataatgcgtagtgctcagatcagggtaattagcatatccatcttctcagacctttattgtttctttctgttaggaacattcaagctcctccttctagctatttgaaaccattaatatattgttgtcatcctaaccatttttaaggatacagtttcgtgaaattaagtataatacattcacattgttgtgcaactgtcaccaccatccatctcccaaacttttccatcttccaaatgtaactctgtccccactaaacgcgaactccctgttccccctcccccagcccttggcacccaccatgctactttctgtttttataaatctgacgactctagggacctcctataaatggaatcatacaggattttcccttttatgactggtttatttcacatagcataatgccctcaaggttcacccatgttgcagcacgtatcagcattttctttctttttaaggtaaagttgactattaaaaaaaaacttctgccgggctcagtggctcacgcctgtaattacagcactttgggaggccaaggcaggcagatcaggaggtgaggagttcaagaccagcctgaccaacatggtgaaaccccatctctactaaaaatacaaaaattagccaggcatggtggcgggcgcctgtaatcccaactactcaggaggctgaggcaagagaattgcttgaacccgggaggcagaggttgcagtgagctgagatcatgccactgcactccagcctcggcaacagagtaagactccgtctcaaaaaaaaacaactttttaagaattgaagtagaataaacatacagaaaaatccgcggattataagtgaagagcttgattaattgtcacaaactaaacacatccatgtaaccagcacacaaatgaggaaacagaaacttctcagccccagaagcccccctcatatcctgttcctagtcactacctccccgcaagggtacccctaccaggactttgagcatcattcaccagtttagcctgttttgtattttgcataaatgaagtctggcttcttttgcttgacgttaactttttaagatctcatgtgacctgtggcattgttcattgcatgtatcctctctctcctattgataacagtgtggattgtttgcaatttggagctatgatgaataccattgctatgaatgttcttgtgtgtgctttctgttgtgtaattattcagaattactatttcggaattactatctaattgtagtgatcttggatcagtaactatccaagaattactgggtgttggcaaaggtacatacagttatacactgcacaatggcattttggtcaacaacagatcaaatatgtaacagtggtcccataatggaccgaatacataacagtgattatcatacagtatttttactatagcttttctgtttttagattcttttttttttgagacgaagtctcgctctgttgcccaggctggagtgcagtggtgtgatctccgctcactgcaagctccgccttctgggttcacgccattctcctgcctcagcctcccaggtagctacaggcgcccgtcaccaggcccggctaattttttttgtatttttagtagagacggggtttcaccatgttagccaggatggcctcgatctcctgacctcatgatctgcccgcctcggcctcccaaagtgctgggattgcaggcgtgagccaccgcacccggcctgtttttagatatttttagatacactatagagttacaattgcctacagtattccatagaataacatgctgtatgggtttgtagcctaggagcaataggcgagaccatgcagcctaggtgtgtagtaggctataccatctaggtttgtgtaagtacactccatgatgtttgcacaacaaaatgacctagtgacacatttttcagaatgtatgcccattgttaagcatgacttaattaattttagcatagaaactctcaaccaatttttcaagtagttgtaccatgtgttatgggttttattgtctcaccccaaaattcatatgttgaagtcctaacccccagtacctcagaatgtgaccttatttggaaatagattcattgcacatgtaaaggttttgccattggcaaaactgccgttatttttgcaccaaccatagcagttaagatgagatcattagggtgggtcctaatctaatacgatggtgtccatataaaaaggggagattttggcacagagacaggcacactcacaggaagaatgccatgtttaaacaaaggcagagctcaggatgatgcctctacaagccaagaatcagcaaagattgccagcaaaccgccagaagctaggagagaggcataaaacagattctgtctcacagctctcagaaggaaccagcccttctgacaccttgagcttggatttttggcctctataactgtaagacaataaatctttgttgtttaagccacctaggttgtggttccttgttacagcagccacaggagatgaatacagcatggtgccctcccattggcagattatgagggttccagttgctccacagcttcacagacacctggtagtaatgacctcatcttaacttctttctcattttagcctttcttccaggcagcagcagtgtcatacatgcttttaaaggtgggcttttaaagccacacttgagagccctgcattctgcaggtgtcacagggtgatcaactattcaaaggctacccctgccctgacagctggaggcaaggcttcccagcacagaggttaagcccatggactctggggccaggtggttagtgcaaatcccatgtccactagtgaataactctgtgatcttgggctgatgattttgtctttctaagcctcagtttcctcaatagtaacatgggcattataacatagaggcatcatgaggattaaatgactaagtgagctaacatacataatgtgcttaggaaggtgccagcacaccataaatactctgtaagtgctggcttttatcattcttttctctctctctctctctctctctctctctctctctctctctctctccctctctctctctgtctctctttctctctccaccccccaacctcctctccttgattttcttcccctcatcttacttccttcttgctatagtgttctattttctgtttcagagagtattctatttgtggacttttttcctcttgaaaattgagctgaaacttctgagaattttttgtgattggcattaaggctgcagggaatggagcagggagacacttgaggaaagggctcatggaccatctgtctggcttggtgatttcaccaggccatcagactctgtggtcatgcatctcctctaaggggagtctatgactgtgttgggagaagagaaggaaccagggattaattaatccatttcaataggttttgtgttttgtttggtttactttttccttctccttctggactgtggtctgggaagtcctcttgtgtttcttactccgttcccaggtcaattatgttatgtgaggagaacataattaagagagagctttaccctttggatgttttcttcagaaaacgttcctccatttccccctctgggatgccagagccccagaactccacaagccaagaacatttaagacagagccacaagagaaccgagcttccccttccctcacctgtcaggttctatctgagtcccagtcaactctcacctgctttccctcctcacaccctacagagcaacgatgcctcagggaacacttggaactggttgtacttcatccccctcatcatcatcggctccttttttatgctgaaccttgtgctgggtgtgctgtcagggtaagtttctgctactccccaccccatcccactcactcctctttgctaacttctttccaagtagaggccattgaagctttgttttcattcactagacagagaaaaggcttcttcccttgtttgggttaccagactgttattagcaagccatgcacaggtgcagaggttgtgtactgctaggggtacccagtgagagggttcatatgggctttactttctttacattttttttaaaaaccaatagtttgggtttacttctcccccattttccaaatataaaatcatagcatatgctctaacggtgtattttcctgacccatattgtcctctatccccaagatttttttggcttaatcataaatgggcttcatttttcttaccataagaagtctgggcacttgtatggtggctctatggcaccatcagcaaccccagattcttccagctttccattctgacatctttaccagaggcttccaatctcgtggatacctcatggtcttaagatggctgcctcacgccctccggatggccacttcatgttccaaacaggaaaaggaagaagggaaacaggaagaggtgggacctatggcagagaagccaacctgctgcagaaatctttcattcatggcttattggtctaacttaaaagagggctgaaataattattagccaaaagtatgaagagaatgagaatgaggtatgcagccagtggtggttggcatggcatggttttatcctttcggtttttttcttttttattgtttttttttgagacggtgtctagctttattacccagactggagtgtagggggcgatcatagctcactgtaacctagaactcctaggcacaagcgatcctcctgcctcagcctcctgagtagctaaggcaacaagtgtatgccaccatgcccagctacattttttatttttcatagagatggggcccactgtgttgtccaggctggtctcaaattcctggccttaaatgatactcccatctcagcctcacaaagtgctgggattacagacatgagccactgtgcctggcctttttctttacctaggcacagttgtcgggaaatgtgtgaagctggcagaagcacccatcactataatatcccagtcttttcccagaagtcctgactcctcctgttgaaaactcctgacctccagggacttctgaatccccaaacacacacacacacacaaacacacacacacacacacacacacacacacaaacacacacacaaacgtttcctaacattttcaaaacagccatactctggcttttctatgcttctccagggagtttgccaaagaaagggaacgggtggagaaccggcgggcttttctgaagctgaggcggcaacaacagattgaacgtgagctcaatgggtacatggagtggatctcaaaagcaggtgaggccctttcatcctggggcccagggatggagatcccaggccacagagtacaaagagagtcatgcagtttggagaaggctaagctgggagggttatgatgggaggagaaagagaacctgaattggtagtcccaaattttatcaacaagaatccagagtctgatatgaagaagtctaagatgaagccaggatctgacatcacgtaacttgaattctgaaatcagacgctggtttacatcccggccctgccactttttacccatgcaccacacatccctgtacctccgtttcctcagctgttacatggaggcgatggtagtgcctaagtcatagtactattggagtatttagtaaaataatctcagctgagtcacttggggagagaagtgcctgatacacggtaggcacatatttatttgttcagccatttaacaaacatttagggagcacctgctgtgtgccaggcactgatctaagcactgaggatatgggagtaaacaatacacaccaaatccctgccctcagagctctgatattctaatgagagagataaagcaaacaaatacatgtcatgttgggaactcccaaattcagagaaggaagataaaacagactaggaagataaaacagagtaggaagttggccgggcgcggtggctcacgcctgtaatcccagcactttgggaggctaaggcgggcagatttcctgaggtcaggcattcgagaccagcctggccaacatggtgaaaccctgtctctactaaaaatacaaaaattagccaggcatggtggcgcacgcctgtaatcccagctactcgggaggctgaggcaggagaattgcttgaacccaggaggcagaggttacagtgagctgaggtcgcaccactgcactccagcctgggcaacagagtgagactctgtgtcagagaaaaaaaaaagagtaggaagttagaggcagggtggtcagggaaggcttctctaaggaagtaccctctgagcagagagacctgaaggacgtgaagaaggaagctgtggggatgtcaagggaaggggcattccaggcagagacagcaagtgcaaaggccctgagctaggaacgtatttgagacacagcaaggaagccagtgcagctgaaacagagtgagaggtggggacagctggaggagaggaagacaggaaggtgatggagatcagatcaagcaggggcttataggctgtggtgtggacattggtttttattttgcgcgaggtggggagaatgttggctattgctactgttgcggaggtggggcttgaagtcacaaaccacccagcagcatgttttttggtcggttgagctgtcaccatcagtcagcagagaatgggggtggccgggcagacccttcttcctggtccaagggagaactcatcctccaaatgcaggagcttaactctgtgctcttcctcttcagaagaggtgatcctcgccgaggatgaaactgacggggagcagaggcatccctttgatggtaactgctctaaacccacctcaggggtgggtcccaggggagaagggagaagctgtggtggggagtcgggggagagcaggtgactggttctaaggatcttgcagagggtagacgttcctcttggaggaattttaggacttccatgcagagtttccctattctggcctccacttttttgttttaaccatggacctggttttttctgctttgtgccttggtttttctcatctgcaaaatgggtatgatataaacaataccctagctcacgagattgtttctcagaatgatattcgttatggcaaatagaacacctgggatagtgcctggcatggggtcagcacgtttctgtttgctaaataagtaataattccaccaataatccagtttactgtgaacggctgctgtctcccatgttagaaacttaacgagacagaaccatgactttctttcttttcttttttttttaattgagacagagtctcgctctgtcacccaggctggagtgcagtcacacgatctcacctcactgcaacctctggctcccaggttcaagcaattctctgcctcagcctcatgagaagctgagattacaagcatgagccaccatgcctggctaatttttatattgttgatagagatggggtttcgccatgttggccgggctggtcttgaactccttgcctcaaatgatctgcacaccttggcctcccaaaatgctgggagtgtagatgtcaattcatggtcccctggaaacctgaatatgaaaggagggaccattaaaaaggtgtccaaaagcccaacctccccagcatagctgggagtcaggggacagactgtaagagtcactgtgtatccaacctgaggcttcatgaaagtaaagtttcctagaatttagagatagggttggatgcggtctgtctgtggctcacatctgtaatcccaacactttgggaggccaagacaggaggaacacttgagcctgggagttcaagaccagcctgggcaacataatgaggttccgtctctacaaaaaataaacttagccagatgtgggggcacacgcacctatggtcccagctactcaggaggctgaggtgggaggatcacttgagcccaagaggtcgaggttgcagtgggcaccactccactccagcctgggtgacagagtgagaccctgtttcaaaagaaaaaaaaagaatttagagataggccagaataatatgtctgcaatataataataacagcaataagaaaaataatagtactccctgaaaaatgcaacttcttgcttgagatttatcttctcatactttagaaaactggttagacaggggctgggcgtggtggctcatgcctgtaatcccagcactttgggaggccaaggcgggtggatcacttgaggccaggagttcaagaccggcctggccatcatggcgaaaccccatctctactaaaaatacaaaaattagctaggtgtcatggcacacgcctgtaatcccagctactcaggaggctaaactacgagaattgcttgaacctgggagacggaagttgcggtgagccgagatcacaccactgcactccagcctaggcgacagagcaagactctgtctcaaaaaaaagaaagaaagctggttagacagggtgatgacttttgattaaaaatctgagagatttgagggaaataaaagaactggcactgcgtcccagaaggttataaaatgaattttattatcttagttggggaggggagattacctaactcccctaaatgagttaggtaatctaactcatttagggtacctaaatctttttattggaagtctacacctgaacttgtctgctgtggagcccctggggtgtatagcttgaatatgggggcagaatcccaaaattgcagcctgcctagcgagtatgctacaggtcaaggggtggactgttttcataagaaagtgaggtttcttagaatttaaaaatagaggctgagtggggcggctcacgcctgtaatcctagcacttttggaggccaaggcaggcaaatcacttgaggtcaagagtttgaccagcctggccaacatggcaaaaccccatctctactaataatacaaaaattagccaggcgtggtggtgcatgcctgtagtctcagctactcaggaggctgagggaggagaatcgcttgaactcaggaggcagaggttgcagtaagccaagatcacaccactctctgggtgacagagcaagattctgtctcaaaataaataaacaaataaataaataaaccagaaggaaaatagtggctgagggcccagacctggagtcggactgaacccgacttgattcttgtctttacccctttaagcaaagtgatagtgccaccttgaacctcagtttacacatctgaaaaatgggtatactattagttcccgtgagaacagttgccgtgagagttaaatccaaggacacactgtgtccatatggtctgtgttgcaaaaagggtaacgtctttttctcttgccatgtttccattgttggagctctgcggagaaccaccataaagaaaagcaagacagatttgctcaaccccgaagaggctgaggatcagctggctgatatagcctctgtgggtgagtcccttcctctgccacctatcagttgttcatcacctatcgcccaagagacatggtggggtgggggcagagggcttgcaaaccgtgctgcctggatttgggtctcagctccaccctttcccacctgtgcgtgtgtcctgggcagattacatcattatgggaataacatccgtgcctagcttctcattattttgtgggaattcaactaaatgatccccatgaagcatggcaaaccagcacctggcagggacgaagctcccagtcaagttggtgaatgtttgtgactcattcgggaagtattcatgggggacctgcttatattaggtgcttggttgcaaacaagacaaggcagtcacgaggctgagctgggaggatcacttgagcctgggaagtggaggctgcaataagccattattgtgttactgcactccagcctgggcacagaaaaaaaaaaaaagacacaaactgagccaggcacagtggctcacgcctgtaatcccaacactttgggaagctgagatgagcggatcacctgatgtcgggagttcgagaccagcctggccaacatggtgaaaccctggctctactaaaaatacgaaaaaaattagcctgtagttccagctactctggaggctgaggcgggagcatcacttgaacctgggaagcagaggttgcagtgagctgagatctcatcactgccctccagcctgggcaacagagcaagatcctgtctcaaaaaaaaaaaaaaaaaaaagacacaaaccaaatccctacctacatggagctcacagtccagtgcaggaaatagaaattaaacagagaattacacaaataaacctgtaatggtaatggcacttcagggagaggctctgggcttagcttgctctagaaggatggggagcagtcagggaaggctacctggaggaagtgacggttaagctgggaactgaaggatgggtaggagatcactgtggtggtgatagcagaaggaacagtgtgagaggcagggctcagacctttgccaccacaagggccagagttcgagggaggagggaacatttattctttcccttctcactcctctgtcctattgattcattggctgtgatgatgttgattttgaccttctaaagtgagaatgtattgttattgttgttgttgttctttaatgggtttttgtttttaatggaaggaagagcatccaggcagaggaaataagactggaataagattgaggggagaaggaatttaggctgcttgggaaactgtgtggccgcagtttagaggaagaaaggatggcaagagaaagaggaagggaggaagagaaggagggagagaagtgaaggaaggagggaagttagtacatccatgtgtttctgatccatagtttctgatccactatttcgtattccccttttatcgctcgcccctagtttataaccttattgctgagtttaggcataatttccattgcgatcacatatctcgtagggtggatacactatggtttgtttagccatagctctattatagggtgtttgagttgtttccaataatttctcttacgaagaacactgctgtgcacatttacgtacaatgactccccccaccctttgggcgtatttccttggggataattataggatcaaagatattaacagcttttcaactcattattcaaagagccattctgagtttcaaaaacatggaacccatttataaacctgccaagtatgcatatgttcatggattccccacccaggccatcgaatattaccaatttaatttcctttcccagttaagtgggtttgtaatgaaaccttaaagcttgttttcatttgcatttttaatttccagccaaaacacgcttttctttgtaatggagaactcattctgcttccactcgtgtgtgcatctgtttaatttcctgtaagcaaatgtcaagaattggagcgctcagtaggtgtcttgagtatttgatcaattatgtctgtctcacgtgttacgttacctccattgtttaaaatctgttttatgacgaggtacagtggttcacgcctgtaatcccactgctttgggaggccagtgcaggaggatctcctaagatcagccgttcaagaccagcctgggcaacataacaaggctccatctctgaaaaacaaaatgttgaaaaacttagccaggcattatggcacacacctatagtcccatctatttaggaagctaaggcaggaggatttcttgaacccaggaattcaaggttgcagtgagctatgattgtgccactgcactgcaacgtgggcaacagagtgagaacctgtctcttaaaaaaataaaataacatacattcttaaaaatctactttgctggccgggcgcggtggctcacgcctgtaatcccagcactttgggaggctgaggcgggtagatcgcttaaggtcaggagtaggagaccagcctggccaacatggtgaaaccgtgtctgtactaaaaattcaacaattagctgggtgtggtggcgtgagcctgtaatcccagctactcaggaggctgaggcacaaaatcacttgaacccgggaggcggaggctgcagtgagctgagatggcgccattgccctccagcctgggcatcaagagtgaaactccatcaaaaaaataaaaaatctgcatatacatatatatgtatatatatttttaatttttttaatttttttttttttttctgagatggagtcttgctctagcacccaggctggagagcaatggtgccatctcggctcactgcagcctccgcctctgttaacaaggcaggtgacattgcagctttctaaacagacccaaaacccaggccagtggcttgttctttcatagccacgtttgctacaggcaaatccaccaaaacccacctcatcagcctgattactcaaaaagacaaagaaaggagcccccaatctagccagtggttttctagaccaccccaaaagagatctctggaattccaggattctggcaaggaatcacatttagctttatttatttatgtaaagaatgcaacaatacaggctgggggtgtggtggctcacgcctgtaatcccaacattttgggaagctgaggtgggaggatcgtttgaggtcaggagtttcagaccagcctaggcaacatagtgagaccctgtctctatcaaatattagctgggcattgtggcacacgccagtagtcccagctactcgtgaggctgaggtggatcacctgagcccaggaggtcaaggctgcggtgagccacagcatgcccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtcttatataattggtgattctactgcgctgttgaatcagttgataaacgcactataaagcaggttcattcctaattgatgaacttactgctgaaataaggaacttgaatcatttacatgaaaagttgagccatgttgctgaaaggatatcaatttttttttcttttttttctttttttttgagatggagtcttactctgtcgcccaggtgggagtgcagtggtgcgatctcggctcactgcaacctccaccttccaggttcaagcgattctcccacctcagcctccaagtagctgggactacaggtgcacaccaccacgccctgccaatttttgtactgttagtagagatggggtttcaccatgttggccaggctggtctcaaactcctgacctcaagtgatctgcccacctcagcctccgaaagtgctgggattacaggtgttagccaccgcgcctgacaggatatcaaatttcatttagactgcaggaatacgttcaagagatctattttgtacagcctggcgactgtattaataacaatgtattatatacttgaaaattgctcagagagtaggttttaagcattctcaccgtgagaaaagtgataagcatatgtaataatgcatatgttaactagctcaactgagccactccatagtgtatacatatggtcaaaatatcatgttatgcactataaatagatacagcctgtatctgtcaatttaaaataaatgaataataactttaaaaagaaaaataacagtatggctgggcacggtggctcacacctgtaatcccagcactttgggatgccaagacaggcttgaggccaggagtttgagaccagcctggccaacatggcgaaactttgtctctaataaatatacaaaaatcggctgggcatggaggcgggcgcctgtaatcccaactacttgggaggcagaggcatcacttaacctgggagatggaggttgcagtgagccaagatctgcactccagcctgggtgatagagtgagcctttatttatttctgtaaagaatgcaataatacaggcctggtgcggtggctcatgcctataatcccaatgttttggaaggccaaggtgagaggatcatttgaggctacaggcgcatgccacagtgcccagctaatacttgatagagacacggtctcgctatgttgcccaggctggtctcaaaaccctggcttcaaatgagcctcccaccttggcctcccagagtgttgtgattacaggtgtgagacactgtacctggcctgtattaaaaaaaaaaaaaaagaagaagaagaagaagaggaggaaagaagaagaaggaagaaggaagaagaagaagaagaggaggaggaggaatgggaaggggaaggggaagaagaagaggaggaggaaggggaaggggaagaagaagaggaggaggaaggggaaggggaagaggaagaagaagaggaggaggaaggggaaggggaagaggaagaagaagaggaagaagaagacgaagaagcagcacaatgataaataagtaaaatgtggagcatatgaaaacaaaacaaaaaaaagttgatccattatgaatggaagctgccattgtaactctgcttttttaggaaaaccagaccccatttagatgattttatttgtttttaaaggcaggttcttgctctgtcactcaggctggagtgcagtgatatgatcatagctctctgcagcctggagctcctgggctcaggcgatcctcccagcttagcctcccaagtagctgggactacaggcaccaccacacccagctaatttgttgttgttgttgatgttgttgttgagatggggtctggctatgttgcccaggctggtctcaaactcctggcctcaagtgatcctcctgccctggcttcccaaagttctgggattacaggcatgattttttattaatttatttgcagctgacaaatggtaattgtgtatgtttatggagtgcagtgtgatgttttaatctatgtatacatcatagaatgattcagtcatgctaattaacacatccatcgcctcaccacctcaccgttttttgtgtgtggggaaggcattaaaaatctcttagcaattttgaaatatgcaacacattactatttattaataatgcaatataaatacacaataatgtattaatgcatcactaaatgcgatgcaatgcaatgcaatgcaatagatcactaaaacttactcctccagtctaactgcaacttataccctttgatcaacatcttctccttctcaatccctcctcctcccctgcagcctccaggaaccaccttcctgctctttctatgagatcaattttttttagttttaagctcccacatgtgagatcatactgtaattgtctttctgtgccagcttattttactcagtataatgtcctccagttctgtccctgttgtcacacattacagaatttctttcttttagggctgtatagtattctatttgtatacataccacattttctttatccattcatccattgtgggacacttagtttgcttccatattttggctattgtgaataatgctgaagtgaacgtgggagtgcagatgttctgaaaagacttaaatgtcagacctgaaatggtaaagatgctccaagaaaacataaggagaaagctccatggcattggtctcgggaatgattttttggacaggacctcaaaagcacaggcaacagaagccaaaatggacaaatgggatcgtatcaaactaaaaaatttgtgcacagcaaaggaagcgttcagcagaggaaagagacaacctaaggaatgtgagaaaacgtttgcaaacaatacatctgataaggagctaatatccaaaatatataaggaactcaaacaactcaacagcaagaaaacaacccaattaaaaatgggcaaagacagctactcgggaggctaagatgtgacgatcccttgagcccgggaggaggaggttgcagtgagctgacattgcatcactgcactccaccctgggcgacagaaggagaccgagaccctgtctcaaaataaaaaataaaaatgtgcaaaggatctgaacatacatatcccaaaagaaaagacatacaagtggccaacaggtatatgaataaaatgctgaacatcactcatcatcagggaaatgcaaatcaaaaccaccattagctatcacctcacacctgttagagtagctattatctttttgtttgtttgtttgttttttgttttttgttttgtttttgagagggagtctcactctgtcacccaagctggagcgcagtgttgtgatctcagctcactgcaacctctgcctcctgggttcaagggattctcctgcctcagcctcccgagtaactgaaattacaggcacacgccaccatgcccagctaacttttgtatttagtttcactatgttggtcaggctggtcttgaattcctgacctcaaatgatctgccctccttggcctcccaaagtgctgggattacaggtgtgagacactgtgcccagcctagagtagctattatcaaaaagacaaatgaggtttgttgaagttctaacccctggtacctgcaaatgtggccttacatgaaaatagggtctttgcaggtggtaatcaagttaagatgagatcaaacttaattagggtgggtcctaaatccaatgactgctgtctttataagaggagaagcaggctgaccaacatggtgaaaccccatctctactaaaaatacaaaaattagctgggtgcagtagtgcacacctgtagtcccagctactcaggaggctgaggcaggagaattgcttaaacccaggaggtggaggttgcagtgagcagacgtcatgccactgcactccagcctgggtgacagagtgagactccatcttacaagaaaaaaaaaaaagacaaatcataacaagtgctggcaaggatgtggggaaacggggatccatttacatcattttaataacacaggctctatatgggtggtattgagttcccagagttgccattacaaaatgtcacaaacccagtggcttaaaacaacagaaatttcttctctcacagttctagaggccagaagtccaaactgaaatcaaggtgtcagcagagccaccacgttccctcagaaggttttaggggagaatctgttccatggtattttcttagtttctggtgctgccagcgatacttggtgttcctcagttcatagatgcataattccagtctctgcctctgttgtcatatggtcttctttctgtgtttctgtatgcgatttcttttttttttttttttttctgagacaagtctcactccatcacccaggctggagtgcaatggcacgatcacagctcactacaaccccaacctcacaggctcatgccgtcctcccacctcagcctcccgagtagctgggattacaggcgtgtgccaccatgcccggctaatttttgtatttttagtagatacggggtttcaccatgttggccaggctggtctcgaactcctgaccttacgatctgcccatctcggcctcccaaagtgttgggattacgggcacgagcccaccgcacctggccctaattactttatttttttgtaaatttttttttgtaaatttcatgtagcctgagcatacagtgtttataatatatacaggagtgtacaataatatcctaggccttcacattcactcaccactcaactcactccctcaccaagagcaacttccagtcctgcaagctccattcatgccaagtaccctatgcagctgaaccaccttttctcttttatactgtgtttttactgtaccttttctatgtttagatatgttcagacacacaaatactatgatgttacagttgcctacagtattaagtacagtaacatgctgggcaggtttgtagccgaggagctacaaaccacgtagcctgggtgtggagtaggctacaacatctaggtttatgtaagttcactttaagatgctcacacaaggacaaaattgcctaacaatgcatttctcagaacacgtctccctcattaagccacacatggctgtattacaatttacatataattttaagcgtatataaattgccagaaatcaccagatgaatccttggcggtgacataccccttcccccaccatagaacattgcagactggcccggacgcccagtatctcatgcctgtaatgccagcactttgggaggctgcagcgggcagatcacttgaggttaggagttcgagaccagcctgaccaacatggcaaaacaccatctttactaaaaatacaaaaattattcggacgtggtagtgggcacctgtagttccagctacttgggaggctgaggcaggagagtcacttgaacttgggaggcagaggttgcaatgagccaagatcgtgccactgcactccagcccgggtgacagaatgagactctatctcaaaaaaaaaagaaaaaaaaaaaaaaaggaaaagaacatttcagactggtaccagttacaccggctcttgatcccttgaatgtggctgaccctgaactaggatgtacttcataataacacgtccggctgggaatacttagtacaaaagaaagagtataaaatatcttttgaatccaccttgatattgattccatgttgaaatggtaatattttggatgtattgggttgaataaaacatctcatgaaagtgatttttaaaaatctagaaattgtctgcaattataattccagaccacagagaaaaacgagagacaggaatgtatagaaaaagggaacgtgggacaaagtgagtatgaaattcaactaacagaagtgacagtgcctagcatggggtccagcacttagtaggtgttcaattaatattcatttccctctcccttaccagtgaagggtatgcctgtcgtggggaatgtgtcttcaggctgagtgatcaggaaggactttctcaatggctggcacgtgaacctagtcatgatttcagctcttgaggttgtactagaagatttatatccaataatcgtaaggtaccacttagcatcacgctaagatgtattaattcatttatgcctttggatggccctttgaggtaggaagtgtggttgtctccagtttaccaaggtggcttgcccaaggtcatctgctggttggtgattaagccaggttttcagtgtggctccagcaggagtgggggctggggaccttctacctgctgtggtttctctctctctctctctctctctctctctctctctctcgatctgtggaacatcccccctgtcccccaaggtcccaagggtcttatttcttttggccaagccctttggagacctgcagatctggacacatctttgagagtttcaggaactagggccagaaatgctgggcagggtcatgaggagctgccactggggttgagaaggtgatggacatgaggggaagggtctttgcagaaaggagaggcgtccctgtaagcaggtcacagccactgggcctggccaactgcagccgagtggaatgtgcccctgccccatgaccatatgccccaggtgtgcaatgtggcggcccagagcacacactctgaaccatcttgacacatcttcactggttactagacccccctcagcctgtttccttggctgtaaaatggggatgacgctggtccctacttcctagggctctgagcaggagtaagtagcttgtcgtataaaacatgttccctgcagtgcctggtgcctgctaaatgttccataaacgtcagctgttattttcattcaggggaagctgaaatccatattttcatggaaaatctcccagtttttaaatgtggaccaataatttcagctttcacaaacccagtatgagtcggtatggcccctagggtgccaactcaaaatctctgttgagaattttgctgataggaagtggcctccttggaggtgtttgctgtgtcctgtgtctggcaagtggggtggttttgataaacgtgctggatggatgtatgggtgaatggataaatggaggaatgaatggagaaacaaatgagcaaatgaataatgaatggatggatgaatggatgagcgaatggatggatgaatggatgagcaaatgaatgatgtacacacaaaggaatggataaatgatgaatgtgctaatgaatttaagaatgatgaaagaatgaatgaataaatgaacaaatggatggatgaaagaatgaatgaatgtactaatgaatgaatcaatcaatgaagaaccatttaaaaatgaatgcaactgagggtttataagaaaaggtatcttaagcctgggcatggtaattcatgctggaatcccaatgcttagggacgctgaggcgggaggatcgcttgaacccaggagttcaagaccagcctgggcaacacagggagacctcattgctaccaaaaacaaaattgttttaattaagcgggcatggtggtacgtgcctgtagtcatagctacttgggaggctgaggtgggaggatcgcttgaacccaggagttcaaggctgcagtgagctaggatcaagccactgcattccagcctgggcaacaaagcaagatcctgtctcaaaaaaaaaaaaaaaagatgtattttagaaggtaaattcaatctgtccaaaactgagctctgaccttcccctaaacctgtgcccattcagtggatgagagctccatcccttaaggggttcaccaattcatccattcctttgtatgtacatcattcattcaccttggctcatccctctctcttacatccacaccgttccatcagcaaatgttgaatctgtcttaaatgattcatcccaaatcctccccgcttaactaccacccaactccagcccccatccatcatcatcatcacttgcctggatgggttcagtcacctccagcctggtctcccagctcccgtcctcacctctcactgtctactctcccactcggcagccagagggtgcctgtgaacacccaaatcaggttccatccctcctctactcagaaccctccacggctcccccctcactcagggtaaaagccaaagtcctccttgtggtccaccaggccatgcatgatctgcctgtcacctccctgccttcaccaccttcctcttttcccctcaaccactccactccagccacactgacttccttgtgctcttccccaaaaatgtcgggcagacacattcatgcttcaggaccttaaatttgctgtttcctctacctaagatactaaagtgacaagtcaacacactcaccttgaccatgcaatttaatgttgcagcctaccctgtggactctccaagggctcccagtccctctgtgatgctttactttttctcttaaaaaaaaaattgttatttaaaagaacttgtctcgctgtgttgcccaggctggtgtcaaactcctggcctcatacagtcctcccattccagcttcccaaagtactgggattagaggcatgtgccactgcacccatcccaactttttttttcccatagcacttttcattttccatcccactgttaatttacttattacgtccactgtctgtctcctccccttagagggtcagaccccggaagtccaggctctgttgcctaatgtatcctgagcccctggaacagagcctggcacaaaataggtactcaataaatgcataagagcaaaactatatgtaggcagaggacacacccagcttattcctcagtgatcacttctaaagttaaatgtccatggaaaacagtctcatccacatctctttctggaggccttccaagcgtgctccatgcagctctgttgcctgcccctgcatcagggaatggaggctctgctttatcctgccctgtggtgtgactcccagaggcatcagatgtggctgggagtgggagacatggaaaattggctcctgcaacagagaactatcagccttcccatcaattggttacttctaattctgttatttttcaggggcactgtcttctcataagctccatctatgcaaaactaagcccatgggtcatgatggttccctcaggccagaggcttgctggagagactaatggatcccctggctaaaatctgtgcttgggctgcacattggttaatttcttctgaaggaacagcctgagcctgacattctccatcttttccctggcaggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttgtgagtatcacccagccccacccctgccaactccctgatccctccctcacaccctttttccacttctctttctctggtagtatgtgtatcttctttggtcctcattgaatctgccctttcctttagccatttctataactgtcactggggccaatgttactgttgctatgacaatggaacccatctcccttagacctgagagctggaagctggaattcagaccaacaaatgctcctgtgattcctttctaagagagagggacagaggggtgctggtgaaggggatgttggaagagagacagagaaagacggagctcataagatagacagatagaaacagaaacatacatgtattaataatttttatgtacatctctggaaatgttcataacttatggttaagagaggatgccttagaaataaggagtggcttatatgttgccctcattttctctacttatttctgactctacttctctcttctttcaaaccttctgcttctttcctgttaggttggtgcaaaattaattgcgttttttgccttttttttttttttttttaaccacagttacttttgcaccaacctaatacttcctcccctgccctttttggcttccttattcattcatagaacatcccctccagtatctgcgagagcgttttgctccctcaaggtacaaggcccactaaggctttgccctctgggcctattcccagattctatgtgagttagcatgagatagtatcaaaattgagggccaagtgagggtgaggaaaagcagcaaaagatggggagatgtctgagcaggatttaaaaagtaaagagctcgaggaatcaacaagagcagcgactggggccaggcatggtggctcacacctgtaatcccagcattttgggaggctgaggtgggtggatcacttgaggccaggagttcaagaccagcctggccaatatggtgaaaccctgtctttacaaaaaatacaaaaattagccagatgtgatggtgcacacctgtaatcccagctactcaggaggctgaggcactagaactgcttgaatccaggaggcagaggttgcagtgagccaagatcatgccactgcactccagcctgagcaacagagagagtgtctgtctcaaaaaataaagtaaaataaaataaaataaaataaagagtagtgattgggcagtgaggggggcaggtggatgccctggctttggctcacaggccccaagtaaggacttctcaaaacgtcttttgcctactggctgtctaatttattcactgaccttctgacctggttcagaattgacttaggacagcaagaagagacagtctagtctttgacctagaaaggcccgtgagcctagtccaggccattgtcttcttataaccctccttgttcccagtcacgttggctgaccccccaggacacccctcaggaaccagttctccttcccagggccctgacctagtttcaaacttagtaattgtttttagtccctctggagtctcttataaatgaggactctacttcgtgttttaacttcctctaatactctatttttaatctcctatattctctctactaatcatcttgtacagtctgtcctggttcaggaacaagggactgagacttcctgcctgggtcctcagtgtctataaaggtcctttactcattcccactttccctttgagaaaactgagacacagagaggttaagtagattgcccaggatcacacattagcttggcatgatggcgggcgcctgtaatcccagctacttgggaggctgaggcaggagaatcgcttgaacctgggaggcagaggttgcagtgagcccagatcatgccactgcactctagcctgggcaacagagctagacgccatctcaaaaaaaaaaaaaaaaaaaaaaagatacacattaatttcagagatgtcaaaatataaacaaaaatgtatatcttggcatcagtgaagtgtagttgtttctctggatctcagactccacatctatgtggtagaaaccggatttgatggtcctgaaagttcttccagatgcaacaatgctaaggataagtaattctttcaagtcttgtgcatcacctgctatcatgtttccatggtaactgaggaacaagatctcagaaactcttcagtcctcccagagttacttctggtgggtctaggaatgtgtcagatgttacaaacagacttcctctgctgatattttggtcctaggaaccctagagttcccctcagacactaagatctccttagcgtcctataaataaggagaaattttggtgataaatactgtgaaggactttgacggtcagttcaaaacacctcttaaaagcatgacatagcaaacacccttggcaaatatcttagttcatttgtactgctataacaaattacccgagactgggtaatttgataagaacagaaatttattttctcacagttctggaggctgggaagcccaagatcaaggcattggcaggtttccctgtctggcgaaagctactctctgcttccaagattgcaccttgaacactgtatcctctggaagggaggaacactgggtccttacatggcagaaggtggaggagcaagagggacaaacttcctctgtcaacctcttttataagggcacctaatcccattcatgagagctctaccgtaatgacttaatcacctcctgaaggccccacctcttaatactgttacattggcaattaagtttcaacgtgaattttggaggggacacaaacatttaaaccatcacaaccaccaaacacaattagctttgtggccttaattagctatatgaaattcatggaagttagtttcagtcctctgtctctttcctttctgtatgctttctgctcctcagaaaccctcctcatctctcctttctatccattaagtacccacgcccttcctaactcctcatcttcctaccctaccaagaaagccctctcagaaaaggatctgatgtcagccatttatttgctggagcaaatgcatatccatgttttacccctccctgaggcatttgcaattttatgcttgctcatcaaagaacaaaaggctttgtcttactcaagactttttaggtcactcacaacacaggatttctaggggacataagacaagttttctgagttaggagaaaagccataccttaggtgggttgcctgtgtcgctccaactaagtacttaacttcaggattacaaataggatatcattatgatttctatttccttttatcctttggagctcagtcacgtagaagtagattaaatataattgttagatcacagcaccctggcattatggggccgttatggtccattgttattatgtgaattattcagttaattagtttattttttaaatgtgataaacacccaggaacccaccagtcaacacaaaagtccttggcaataatctatatccgatccttctcatcgaaccagggcaaaaactacaagatggagacccactgatatttttctcattccttttaaaatcggcctaaggttggttagcttgttggttggagggtagggcataattgttgctttttttttttttttttttttttagacaaggtcttgctctgtcacccaggctacagtagggtggcccaatcttggctcactgcaacctccacctcccaggtttaagtgattctcatgcctcagcctcccaagtagctgggtttacaggcatgtgtcaccacactggctaatttttgtatttttagtagaggcggggtttgccatgttagccaggctggtctcaaactcctgacctcagttgatctgaccgcctaggcctcccaaagtgctgggattacagacgtgagccaccatgcccagccagctcttcctttttaacagaggggaaactgaggcccatgggaaggacaccttggacagggcgtggccacagtgggtcatgtatataatcccagcactttgggaggctgtgctgggaggatcacttgaggccaggagttcaagaccagccagggcaacatagtgagacccccatctccacataaaaattttaaaaagaaaaaagataagtcagaagttgggtgtggtgacacatgcctgtagttctagcatgttggaggccaaatcagggaaactgtttgaggccaggagtttgaaaccagcctaacagcatagcaagacctcatctctacaaaaaataaaaagtttaaaaatgataataaaaggaaagtcagagccacctggaacccctaccctcagcaagcctaacctcctctctgtttcctccttctcccttctagactatgcagaattcattttcttaggactctttatgtccgaaatgtttataaaaatgtacgggcttgggacgcggccttacttccactcttccttcaactgctttgactgtggggtaagtgctcttgtttctaagagttcatttctccagctcttgcctggaatgacagatacctggacacattaaagggagaaaggtaaagtcacccctgaatatgagagactcagatggatgcagaaggaatgagaaaacaatcccaaacactggcaaggatacagtgtacccagaaccctcaaccaccgccagtgggaggaaaacgtatagaccccctttggaaagctaagtgggggacataagacaagttttccaagttgggagaaaagccatgccttaggtgggttgcctgtgtcgctccaactaagtacccaacttcaggattacaaacaggacatcaatatgatttctatttcttcttttcctttgtagctcagtcatgtggaggtagatgaagtataattgttagattacaacaccctggcattatggagccattatggtcctttgttattttgtgaattactcagttaattaatttattttttaaatgtgattaacacccagtaacccactagtccacacaaaacctaagtcctggagaataatctacgtccaatccttctcatcgaaccagggcaaaaactacaagatggagatatgacccagcattccattgctaggaattcatcctagaaaatctcacccagatacctaggagacacaggccagaatgtccctgcagctggaagtgaaattaaggttgttcgcaaataagtggagaatgcctggcccagggcagccctaatcatttaccatagtcctgttggtctcagaaaggcttaataatttatttatttttttttattttttgtttttattttttgtttttgagatggagtctcgttctgtcacccaggctggagtgcggtggcgccatctcggctcactgcaagctccgcctcccaggttcactccattctcctgcctcagcctcccgagtagctgggactacaggtgcccgccatcatacctggctaattttttgtatttttagtagagatggggtttcaccgtgttagccaggatggtcttgatctcctgacctcgtgatccacccgccttggcctcccaaagtgctgggattacaggcgtgagccaccacacccagccagcttaataatttataataactgaatgttgtactgttttctgccattatagaaaattatgttgttggagaaaacaaaatacatacaaacaagcaaaccttccctacataaatgacccaagtagttaaagaataaaaccaatttctttccattaaaaagaaaagaaagccgggtgtgatgcctcatgcctatagcctcagctattcaggaggctgaggcagcagaattgcttgagcccaggagttgaaaaccagcccaggcaacatagcaagaccctgtctctacaaaaattaataataattagccaggtgtggtggtgcacacctgtagccccagctactcagaaggctaaggtgggaggattgcttgagcccagcagtttgaggctgcagtgagctatgatcacaccactgccctccagcctggacaagagagtgagaccccatctctaagaaataaaagtaggccaggcacagtggctcacacctataatcccagcactttgagaggcggaggcaggtggatcacctgaagtcaggagttcaagaccagcctggccaacatggcgaaaccccgtctatactaaaaaaatacaaaaattagccaggcgtcgtggcacatgcctgtaatcccagctacttgggaggctgaggaaggagaatcacttgaactggggaggcagaggttgcagtaagctgagattgcaccactgcactccagcctgggtgacagaatgagactccgtctcaaaaaaaaaaaaagaaaaattttaaaatgtcctgagcaaccttgtttgtaatagttccaagtctcaatatccgtgtatccctttgctgtagaacagataaatattttgtggcatatctatataatgaaatactctgtgacaatcaaagtccaccaacagcagccacatgcccaacaacaggaatgaatctcacccatgtaacatggcacagaaggaggcaggagctagcaacgtaagtccatacagttcatgcaaagttcaagtggacaaaattaaactctctctctctctctacatatatatatatatatatatatattttttttttttttttttttttttttttttttttttgagacagagtctcactctattgcccaggctggagtgcagtggcgcaatcttggctcactacaacctccacctcccgggttcaagccattctcccgcctcagcctcccaagtagctgggattagaggcatgcaccaccacccccggctaattttgtattttttgtagagaccgggattcagcaatttgcccaggctggtctcgaaatcctgatctcaggtgatccacctgccctggcctcccaaagtgctgggattacaagcgtgagccaccacgccccgccttaaactgtattttttaaggatgatacttgaatacgttaaaaaggcgaggaccttgaaaacacaacgctcggtaaaagaaaccaaacacaaaaggtcaagtattgcataattccatttgtatgaaatgtccagagcaggcaaatccatagagacagaaagtagattagtggttgctagggtctgggtgagggagagtggggagtaactgctcatggggacagggcctcctttgggggtgatgcaaatgttttggaacttgatagaggtgatagttgcagaatattgtgcatgtacctaaaggcactgaattgtgtaattcaaagtgtgaattttatgttatgtgaatttcacctcagttttttttaaggtaagaaaatggttattacaaaattcaggatggtagttatatcacagtgtctctggaaacttccagggtatccacatgtccctttttattttattttattttttattttatttgagatagggtcttgctctgttgcccaggctagagtgcagtggcaggatcatgaccctctcctgtctcaaattcctaggctcaagctatcctccctcctcagcctcctaagtagctgggactataggcacatgccaccatgcttgactaattttttttttttttgtaaagtcagggtttccctgtgttacccaggctggtcttgaactcctgggctcaagtgatctgcccacctcggcctcccaaagttccagaattacaggcatgagccactgccctagccttctcctaattgttgacataggtagtagttgcatgacattcactttgtaattatgtgtttcaggaattctcaggcctgtgggagctcttaataaataaaaaagaggccaggtgtggtggctcacgcctgtaatcccagcactttgggaggccgaggcaggcggatcacgaggtcaggagttcgagactagcctggccaacacagtgaaaccccgtctctactaaaaatacaaaaaattagccgggcgtggtggcgggtgcctgtaatcccagttacttgggaggctgaggcaggagaatcgcttgaacctgggaggcggaggttgcagtaagctgagatcgcgccactgcacaccagcctgggtgataagagcaagactccatctcaaaataaatgaataaataaaaataaataaataaataagaggccgggtgcagtggctcaatgctttggaaagtggaggccaacagttggagagaccaaagcaggaggatggcttcagcccagaagtttgaggccagcctgggcaatactagcgagacactatctctataaaaatgttttaaaattagccagatgtggtggggcacacctgtaatcccagctactcaagaggctgaggtgggaggatcacttaagcccaggaggacagtgctgcagtgagctatgattgcgccactgcactccagcctgggtgacacagtgagacccggtctctatagataaatgaatggatgaatgagggggtcaaggatcctcacccggcttccatttggagggaggagtttggttgagttcttgcaaggttggtacctaggaaatgcttgccagttctggagcccagacactgtccctggacatgagaccaggttctctgccctaggttatcattgggagcatcttcgaggtcatctgggctgtcataaaacctggcacatcctttggaatcagcgtgttacgagccctcaggttattgcgtattttcaaagtcacaaagtaagtctttggggttcctggacatttgtacagggggtggggatgggggacatggtggggccgcctccagaaagttgggaaagtgagcctcgtgtttcgagggctgactccggggccctgcctcccccgcctggcctgagtcctcgcctggcctctgtcggcaggtactgggcatctctcagaaacctggtcgtctctctcctcaactccatgaagtccatcatcagcctgttgtttctccttttcctgttcattgtcgtcttcgcccttttgggaatgcaactcttcggcggccagtaagtccttcacaggaattccaactcctggttccctggggtcaggctcagggaacacacagtcccctccaccgtgcaggctgccttcctcgtagcccagacacccattgcggtcacccaaatgggcagggccctgggtaccactcagggtttcctggggacagagatgatggagacgttcgtttccttggagatgagatactgagccacaccctcagagcaccccgggtggggccaacgtgaaatgtctgtgtcctccctgcaggtttaatttcgatgaagggactcctcccaccaacttcgatacttttccagcagcaataatgacggtgtttcaggtacagcctccacctggccccacgggccaacacctctcagtgtcacagatgaaagtgcctgctccacatccaaggggcttccctgaactcctccttctctacctggccttttcacaccactttgaaacacagattttatggttatcattattcaattatggtgaggccaacagatcaggagatgaatgtcattggaaagatagtttgtggctgggcacggtggctcacacccataatcccagcactttggccaggtacggtggctcacacctgtaatcccaacgctttgggaagcccaggtgggcggatcacttgagatcaggaattcgagaccagcctggccaacatggtgaaaccccatctctactaaaaatacaaaaattagccgggcgtggtagcacatgcctgtaatcccagctactcgggagatgaggcacaagaattgcttgaacctgggaggcagaggttgcagtgagccaagatcgcgccactgcactccagcctgggcaacagagtgagactccatctcaaaaaagaaaaagaaaaaaaaaaccactttgggaggtcaagatgggaggactacttgaggccaggagtttgagacaagtctgggcaacatagtgagactccgtctctgcaaaaaaataataataataattagctgggcatggtgatacatacctcctagctactagggcagctgaagtggaaggattgcttgagcccaggaggttgaggctgcagtaagctacaatcacaccactatactccagcctgggtgagagagcaaagccctgtctcaaaaacgaaaagaaagtttgttatactcacagatcctcagagaaggagcacaccatgcaggaccaagcagagaagcaacagggtcaagcaggaagagaaggaaaatgtgggcaagaggcttgattgtggtttccatgggacggaatgggtgaggcagagtaaacagctcgagactggctagtttggatcatttcagtgggctctggggcagaggagctgttcctacttgtctaggacctggccttggggtgattagggcaggtggatagtgctgggaagataaaggaggtggttgggatatgggctggttgggatattgtttggtttgcttttaaaaagcctgctcagggctaaattgtttactacctctagggactggctagtgctggaccgggcagtccctccagagtcagcaagaccccagatgcatcagaataaagaaaataaaatgcgtggccaggccaatgaggtggttcatgcctgtaatctcagcactttgggagaccaaggcgggaggattgcttgagcccaggagttcaaggctgccgtgagctccagcctgcaccacagagcaaggccctgtctcttaaaaaaaaggcagagaaaaaaaatggctaatacacccatcaaatctgaagataccttggtctcatattccagggtgatcaacccaaagcaacttctgcacccatgtgggcgcattccctgaggcttgggactggcccagccgggaccttcagagcatctttggtggattctttctctttgagggactgagagtgtatagaaaatgtgacttcactctctccttctcctggggaggtagtttctaaatgagaccccaagacagggagttgaagaggaaaccttccatgaagggaagttctgagcccccacataagcgattttttttttttttttgagatggagtctcgctctgttgcccaggctggagtgcgacggcacgttcttggctcactacaacctctgcctcctgggttcaagcgattctcctgcctcagcctcccgagtagctgagactacaggtgcataccaccatgcctggctaatttttgtatttttagtagagacagggtttcactatgttggccaggctggtctcgaactcctggcctcgtgatctgcctgcctcggcctcccaaagtgctgggattacagacatgagccaccacacctggcccataagcgattattaatagcactgatcgctagtcatgtatctttagctcagaggttctcacccaaggacaagtctgtcctccaaggacatgtagcaatgtctgcaagcattgttggttgtcacagctagggagagggtgctactggcatctggtgggtggagactaggaatgctgctcaatatcctacaatgcacaggacagccccaaatagaataatctggccccaaatatcagcagtgctgcggcttagaaaccctgttttagcagattcatgtttttggagttctttaacatttactttatcctcatggggatatggatagaaggaaggaagttggatcttttttaaaggagcatgtaggtgctgtttgaatatccccttggttctttcagtatgcatcagcacaacttgcgtctgtcaacacctaatcctttgccttggtctttctctggtcccctgctctgcccccaaggaactgcagtccagcagtactgtgaattttttgtgccacaccttaaaaggagcagccgttggtggataaataccccagctccctcaccctcaggtgggatgacccctagagctccccagcaagaccaagccccggttacctacagtggaaactcgcttgatcacatactgtttacgttccaccctcttttcccttttctcacttctcctctcccctactggtgcttcctgagatcacctcccagacaaaccacttgcacccgaacccttgttccagggtctgcctcaggcagggggaccccaaacgtgtccttgtgctacatttgtgctatccacgtagtagcttgtttaatcatcaccatgaccacatgaggaacacaggtaaatattaaaatcctgtcttagtctgctcaggcagccataacaaaataccacacactgggtggcttatacaggaaacatttattctctcatagttctggaggccgggaagtccaagatcaaagtgttagcagggttagttagttcctggtgagggccctcttcctagcttgcagatagccaccttcttgctgtgtcctcatatgtcaaagagagagagagagagttgtgatgtttcttcctgttctttttttttttttttttttgagacaaaaatctcaaaaaaaaatctattttttttttaggcaaatcacatttttttgtcacccagcctggagtgcagtggcacaatcatagctcactgcagcctcaaactcctaggttcaaacgatcctcccacctcagccccttgagtagctgggactacagatgggcaccagctaattttttttaattttttgtaaagatggggtcttgctatattgcccaggctaatcttgaactcctgggctcaagtgatcctcccaccttggcctcccaaagtgctgggattacaggcatgagccatggcatgcggtctcttcctgttcttataagggcactaataccatcatgaagtcccccatgacctcatctaaccctagttacctcttaaaggccccatctccaaataccatcccatcataggttagggcttcaactcatgaatttggaggcgggcacaatttagtccataacaaatccccttaatcacatcaagtaagacagagttacaggagggtctgtgactcctccagggtcccattttcctagaagccaggctaagagccccacgacgcaggaacggccctttctactcgcaaacaaagagaaaagccaaggagaagccaacacggagtctggctctgcaaaccgggcaggattgttaaagacctcctgggcttggggatggggtgggcggattccggctccacagctgcatctccaaggggcccgtggctgagaggggggttggctgtgtgtttcttcctcccctttcagatcctgacgggcgaagactggaacgaggtcatgtacgacgggatcaagtctcaggggggcgtgcagggcggcatggtgttctccatctatttcattgtactgacgctctttgggaactgtatccttcatggagagagagaaggggacaggcctggacctctggcagaggagaggttgcaggggctcaagggagggtactgagagacccagatacccagggcccaagtggtgtcccaccagtggttgcttttcctgactcagacatttgcagacaccctcctgaatgtgttcttggccatcgctgtggacaatctggccaacgcccaggagctcaccaaggtggaggcggtgggagaatgtttctctggcaaagttaccacctgcccatggcagatcaggacgggggtgggggtgggggtgggggtgggggtgggggcatgggaacagggttagaacttttgccggggatgcaccatgcaaagagaaggcgcctctccccccactcccagaaacagactgtccctcatcaagcaaattctacagccaagagggtgggaagggggaaggcagtgaggtcgctgcaggaaacggatggcaaactcaaccaaaaggccgtttacagggagtaagcagggtttccaaggaatggtgtagcccccaggctagtggatgggagagggagtgctgttatggggacccagtcagagctggggccaaggaaaaagggctgccaccagccctgggaccttagagaacccagaaccatggcaaggcacagatggagtggccaataaatgtccccaccttctctcttcctctggcttcccgctggagcctccccttagccaaacgcagcatgttaagagctagcctccgtccagcctaagcctctccccaaggaccctattaagttaagattacatgtaacaggtacagggtcttcctctcagccctggggtctccctcagcattgcagccccacctccagtgcctcgaggtattcaggacatgtttgtgaaattgaaccaaaccaagcagacgttgccaacgctccatctgccggccctggcaggagggagagagagtttcccggccccagctcccagtggagggaagcggaagtctctgccatcccaagcacacggccacaagcctggccactgtggagctggctggcatggctgagccgagggctgatccagccatgagctcatccaagttccaagagtccatccttaggggctggtgcaggagggtagcagaaggggagggagaaaggccagttcgtttatctcctgggaggtgtggacattcctctccagatccacattctttctttcattgatcctacaagcatttcttggtcatttaatacgtgtttttaatcctattcagtcctcatggaaaccttaggagccaagttctctgagccccattttacagatttcatcattcagtaagcacttaatgagcacctactgtgtgaccaaggccctggtctaggacttagggattaagcagtgaacaaaaaaaggcaaaaatccctgcctccgtggagcagggattcaagaggggagacagacaagaaacaagataaatttgtaaacatacgtagcttgtcagttggtgataaacacaacagagaaaaattcagtagggaaagtcagggagagttggaattttagatgagatgtgtgtcgcacagagaggttgagagacttgcccaaggccacacagcagtaagttgtggagctgggatttgaacccaggccgtctgggtctgcagcttgtgctcttaactgctgtgtaccagttgcttgaatttgggcatgttttatgctcacttgggaacctgtgggaaatgcagattccagggcccagcactggttctatagattatttggggagcctgaggatctgcattttaggtgtttctgaggcagatggtccagagacctagctctgaaaaatgctgggaatggtgccaggaggggtgggggtggccctatgagagcagggtggccagccagatcccatctccatgttgtctctgacagtgtcctgatctgaccatttccaaggtggtaaggttgctccccgttccagtgattcggagcacagcgggagagctgcctgcaatggcatgacttttcttatgggcgggttcatttctggccatttctttctcgttgccttttctttgctttttctttgttggcttttctgttttacgaatgaggccctgcatgaaggctgaagaaggatttaaagtccaaaaacgtctttttctgtatgtatttttaaaacctcttcccccattctcctcctctctgaacctaaccaccagtgagcagcagcaccctgggcagttggctgtagcccaagtgccctgctctcctctccccaccgccttcctgtcatgggggctgggaatataaattcctctcctcattctccttctgggggctgttgacagtgcatggcaggggccatcggatgccaggctcttctgtgtgtgagggtagttggtgttttttgaaagttggttcagagagttcacatggctcagaaagcctagtgagaggaaaatctttgcactgctttccagctcattaagacaggatgcaggggccaggcatggtggcacatgcctggaatcccagcactttgggaggccgaaatgggaggatcatttgaggccagaagttcaagaccagcctgggcaacatagtgagaccctgtctctacaaaaaaaaaaaaaaaattaaatgtatacaggcatagtggcatgcacctgtagtcccagttgcttgggaggctgaggtgggaggattgcttgagcccaggagttcaaggttacagtgagctatgattgtgccactgcactccaggctgggcaaccaagggagactctgtctctgaaaacaaacaaaagaaaaaaaaataggctgcaggaaagtcttcattgtaggaagagaagggacatttttattttttgttatctggctgtgtgttaaaataggcttcataatgagttagatgtcaaacttatacacagaggggatagcaatacacttaaccaatagcaggtacccattccaattggggagccttggttctgattggtcgaaatatttcaaatgttgcccctggtcagcaacagggtcagaagtgagtccccaaggcctagttcatgttttgtgaacaaagattccacgtgccttttaggacgagcaagaggaagaagaagcagcgaaccagaaacttgccctacagaaagccaaggaggtggcagaagtgagtcctctgtccgcggccaacatgtctatagctgtgtaagtgcccctaatccctgggatgctaccctggctcctgaacgtccacactatcccaggcacagatttgggaagcagtgggggtggtccttgacagaactgagctttaggaagagacacttcttgtccttccacccactttcactcaataaatatttggttagcagctgttatgtacccagcactgttctaacttctggggatacagcattaacaaggaggaaaaaaaaaatcccacctgtgtgtagccattctagcaagggaaggagtcaataaattagataaataagtaaattatatattgtgttagaaggcgatggaactacagagaaagtaggggagggaaatagcaaatgctgggagtgaagagagttgtgattttaaacgaagttgtcagggaaggcatcacctagaataggggtccccagtcccggggctgtggactggtaccaggccgaggcctattaggaacggggctgcacagcaggaggtgaacagtgagcaagcaagcattaccgcctgagctccacctgccgtcagatcagcaggcagcattagattctcataggaacacaaacactattgtgaacggtgcatctgagggatctaggttgcgtgctccttttaagaatcgaatgcctgatgatctcaggtgaaacagtttcatcccaaaaccaccccccacacctaggtctgtggaaaaactgtcttccacaaaactggcccctggtgccaaaaaggttggggactgctcacctagaaggttacatggcctgaaggaggtgagggaggagccactggggggcctggggaagggcatcccaggcagagggaacagcataggcaatggccctgaggcaggaacatgcctgatgtgaaggaggcctgtgtgactagaatcgaatagtaagtgtgaggaggtgaaggcaaggaggtgacaagcagattacacagggccttctgggtcaggggggaggacttgggcttttgcccctagccaggtgggagccatggagggttcttgagcagaggaggctgggacctgactcagatgctcacagactcctagcattcagtggggagtagagggtggagagcaggagtgggaggctgagatgtgggttggttcgcctgggtcatccatccaagctacagtgcctagcaatgctctaagtcctgtgaccatgccactgcaggaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaagtaagtggaggtgacctcgaatccgcagaatgacggtaacattaataatgacaacagccaaagtagcacgtgctgtgtatttgtttataaaaatatattataaaatgctgtatttggccaggcgcagtggctcacgcctgtaatcccagcactttgggaggccgaggcggatggatcacgaggtcaggagttcaagaccagcctggccaagatggtgaaaccccacctctaataaaaatacaaaaattagccgggcacggtggcaggcgcctgtagccccagctactcaggaggctgaggcaggagaatcgcctgaaaacagggggcggaggttgcaatgagccgagatcacaccaccgcactccagcctgggcgacagagtgagactctgtctcaaaaaaaaaaaaaaagtgctgtatttggccaggagcagtggctcatgcctgtaatcccagcactttgagaggccgaggcgggcggatcacttgaggtcaggagttggagaacaggctggccaacatagtgaaaccccgtctctactaaaaatacaaaaattagtggtggtgcccacctgtattcccactactcaggaggctgaggcgggagaatcagttgaacctgggaggtggaggtaggttgcagtgagctgagatcgtgccatcacactccagcctgggcaacagagcaagactctgtctcaaaaaaaaaaaaatgctgtatgtttttgtttttttgacacagggtctcgcctgttgcccaggctggagtgcagtggcagtcatagctcagtgcagcctctacctcccgggctcaagccatccgcctcagcctcacaagtagctgggaccacagacatgtgccacatgcctggctaatttttgtagagacagtgttttgtagagacagggtttcactgtgtttcccaggctggtctcaaactcctgaactcaagcattccgcctgccttagcctccctaaagtgctgggactacagggttgagccaccacactcagcctaatttttttacctttagtagaaatgaggcctggctctgttgcccaggctggtccccaactcctggcctcaagcaatcatcccacctcagtctcccaaagtgttcggattagaggcttcacagatggggaaactgagagattgagtgagctcctcaaggtcattcctctaaccagtgtccttgaacccaggctctctggcaccagaggccttgagcatttcagggaaactattaagagaagccccactgtcgtccagaattatatagtcttctgtgttcttgctgtgtgacttttgcaaagtgacttcatatctctgggcctcacacaatggaaatagtgggatctaattgggtcattgccaggattgaatgaggtaatgtatgcaaagggcctggaagagcagctgacacataataagtgctcggtaaatttagagcatttttggccattttcagccaactctatttacctaatgctattctttggaagtttgaaaagccactctgttgggaggccaaggtgggaggatcacttgataccaggagttggagaccagtctgggcaatagaggcagaccccatctctataaaatataaaaaattaaacagatgtggtggcatgcacctgcagtcccaactacttgggaggctgaggcaggagggtcactggagcccaggatgtctaggctatgatgagctatgattgcaccactgcacttcagcctgggcgacagagcaaggctttgtctcaaaaaataaaataaaaaataaagaaaaagaaaaggcactttgggccgttagaattgaagggagagcagagtttcaaagctttggatgcagcgggatgtggtggctcatgcctgtagtcccagcactttgggaggccaaggtgggaggatccacttgagccccggagttcaagaccagcctgcgcaacatagtgagacctcaccttttaaaaataaataaaaatgttagaaagcttttgaggcatcttccaggccagcaacttatccattcagaaccagcatcctctttttcataacgacattttgtaatactttctagcagatgctatagtgattctgcatatagggactcaacaacttacccattaaaatagacatcgtagacattgtcctattacaaattaacctgctcttagtcctcttttatattaccatcagggcataatattgatttttttaatgatgggtttaagtgatcctgttgtatgacatatgaggtaggccagcacttctcaaaatctaatgtgtatgtgaatccccagggatcttgttaaaacacaaattgtaattccgtagggctaaggactcagtggagcctgagattctgcatttgcaacgagctcccagatgaggctgatactactggtccagggaccacattttgagtaatgagactctggaggacatagtgaagtaattctgatatgtacaccatacacaaaatcaccatgaagtgacaggcacaaatgatggctaactctgggttgtgtggacaattcaaaccacatgaggggagttgccagcagtgtcaagatgttccacaatgttgaacacctcttggcaaagttccatatacaaaagagtctagtctttcttccatttatttaatagttgcattgcaggaaaatgcaatgtatattaaaaacatacaaaaaatatgttgtgttcttatgtaaaagagttaggtttaaactaaaagcacaggatcaggtgcagtggctcccacctgtaatcccagtgcattgggaggctgaggaaggagaatcgcttgaggccaggagttcgagaccaacctgggcgacataaggagacctcgatctctacaaaagaagttttttaattagccaggtgtggcggcaggtgcctgtagttctagctacttggaaggctgaagcaggaggattgcttgagcccaggagttcaagattacagtgagctatgattatgccattgcattccaacctgggcaacagaacaagtccttgtctcaaaaaaaaaaaaaagaaagaaagaaagaaaaaacccaaacaaacaagcaaactaaaagcacaggtaattacaagcaagatttttcacctctttgagggacattagaaagtcatgaagaggaaaagataagtctttcccatatgggactgtcatgtacatggtagggtatttagtataactgcctaccattctctaagtgcctgcagtgcccctcaatcattatgttattaggtttccacgtagttctacaacagttttctgaaaaccattgttctaggtcattctttcgcttcaatcttctcctatgggtttatgcattcattcagttagtatttactaagtgcctactatattctaagctcatgctgtgagttcagtcacacaactgcaagtgaagtggtctgagacattctgagaaatacgaccaagaaactgctcccagggtctcagggcaggtttccagaggagcaatctgagaagggagtagagtgtttcagtctaacaacagcatgtgcaaaggccctggggtggaccagaaggaggccagtttgcaggacatgactagtgacgagaaagtgacaaagaaattgaaggtgcattgatgagactctggggctgtcagtcactcaggggaatgagagatcaaaacgggagtttaggtggaataaagtgtttaccacagcactctctgtatagtaaagaccaatgaagagccaggtacaggccagtgtgatggttcacgcctgtaatcccagcactttgggaggcagagacaggtggatcacctgaggtcaggggttcagaaccagcttggccaacatggcaaaaccctgtctctactaaaaatacaaaaaattagccaggcgtggtggtggacgcctataatcccagctactcaggaggctgaggcacaagaattgtcctgcgaggcagaggttacagtgagctgagatcacaccactgcactccagcctgggcaacagaacaagactctgtctcaaaaaaaaaaaaaaaaaaaaaaagccaggtacagtggtatgcacctgtaatcccagctactcaggaggctgaggcaaaggattgcttgagcccaggagttcgagaccagcctgagcatttagagaatgggaggccagtatactaaataccctaccatgtacaagacagtctcatatggaaaagaattatcctttcctcttcatgactttctagtgctcctcacacaggtgaaaaatcttgcttataattatctgtgcctttagtttgttggtttatttagggttttgtttgttttttttttttttttgaggcagggtcttgctctgttgcccaggttggattgcagtagcattgctcattttagagatgagcaagacctcatgtctaaaaaaaaaagaaagaccaatgattattaattactcttgctattattactaatattactgttattatcagccttattaacagatctactgttattgaaggaggcagagtgacagggacaaaatgtctctccctaacaatatgccaggaagagtttttgaaagacaacagtaaacattggaaactacaagagcagcaaagcctggttgtgaaaggcaaggactttggggcaggcagtcacattcctgccctatcacttccaggctgtgtgactttcagaatttcactcctctctgggcctccatttcctcatctataaaatgaagataagaatagtagctacctccttctctgggtataagatttaactgagccgggcgcggtggctcatgcctgtaatcccagcactttgggaggccgaggtgagcggatcacaaggtcatgagttcaagaccatcctggctaatatggtgaaaccccatctctactaaaaataccaaaaaaaaaaaaaattagccgggcgtaggtggtgcacgcctgtagtcccagctactcgggaggctgaggtaggagaatggtgtaaaacccgggaggcggagcttgcagtgagccgagatcgcaccactgcactccagccggggagacagagcgagactccatctcaaaaaaaaaaaaaaaaaaaaaaaagatttaactgagttagtacgtgtaaaatgctttgagtggttcctggcttataccaagagctcaataaatgttagcaattttttgtagcattttggggtctcactatgttgcccaggctggtgtcaaactcctggcctcaagaaattctcccactttggcctcccaaagtgctggatttacagacatgagacaccatgcctggccatgttagctattattaatatgaatattattaagtactcaatgaatgctatttttagcagtaatagtaagcactcaggaagtgtcagctaatactgttagtaatactctcatcaataaacataaaaagcaataaggacccagcttgcccaaatcccacagatggttcctgctccctctcttcttcagaggaagaaactatctccccactttcacccccatagcctcagctggccagacccccattctgaaccaggggagtactgctaattccattattaatagacacatcaaacaatctggccgggagagacattattcatttggctgataaagaggttctaaggctctttggaaataaaagttcatgaagattcatgcactttaagagaaaaaaattcaagatcagtcattcatctgctttaaaaaaagtggcaaagataaaactttatttgagaatataaaataataaaaagacattttcgttctctgttgtgacaaagccagtggccttcggaggtctgccttgtacatttttcctcttcttcagtcattccttgaggctttttgcaaacgtaccctgtgtttttcattctccagcatattgataattttttttttttgagacatggtctcgctttgtcatccaggccccggagtacagtggtacaatcatggctcactgcagccttgacttcctgagctcaggtgattctcccacctcagcctcccgagcagctgggactacaggtgtgcatgaccatgcctagctaatcttttgtattttttgtagacacagggttttgccacattgccaaggctggtctccaactcctgggttcaagcgatcctcccacctcagcctcccaaagtgctgggattacaggagcgagctaccttgccaggccgatcatatttttttcctttttattcactttgtcttctcctcattcctaccttcatctgtctttcagtggctcactccagtgaaaagtggactgacgcacattctatttcatataattcaatggctgctggccccagatcccccataccaggtggccgagcccagtggccctgcagggtggacaaaatgagggtggaactttcccagactgtcagtaaaaatctatggaggacagagcttctgcctctcccttgcaaccaggcagtgccttctcccaggcctatctgcttgcaaagggaacttttgccaagacctgctccactctagaattcttatctctgctgttcgcatcctaattccacctgcatctgtcaccatgacaacctgctccccaaaaggaacaggaagagagatgctggacttttgagctccacagtttatcctgcatgggggtagggagtggttaattacttagcactctaattcttacggtacccccaatgggcccaagttggtttttttaaaaaaaaacagtcttgctctgttacccaggctggagtgcagtggcacaatcatagctcactgtagcctcaaactcctggactcaaatgatcttcccacctcagcctcccaagtaactggaacaacagtctcgtgcaactacgcccagctaattttttttttttttttttttttttagagatggggtctcactatgttccccagactgatctcaaactcctgggctcaagcgatcttccttcctcagcctcccaaagtgctaggattacaggcgtaagccactgtaccaagctgccccattaaagctttgaacaccagagagcccagctcagctgttttccagctgggtaactctgggtaactttgcctctctgaacctcagtctcctcctgtgtgaaatggggctgatcactatacccatctcggatggtggtagttgcagggattaaatgagttaatacgtgaggtccttaggacagggggtggggacacgagataagcaataaacaggaactgctgttattatcacccccacataatccgatctcagggtctgagtgtgccccaggcaaggtgtccacagccctctgcagaaggatgcccaagtgatcagctggcacaagaacgccacgcacagcaggtgttatgcaactggccacctattccaggcagaggatgccagatccccagggagaagggggtaggggtgcagcttcaaagttttctgccccttttgagttctccttggagacactttggaaatgaaacctcccggaaattgatattaggcctctgcaggctgagcttgttaaaatttcccaacaaacagagccaacagacgctctacaaggaagcaaaaacaagacaaaacacattggcagacccttttccatctgctcttggtagatggtattcctctaagaaaatgccgccacgagtttctccatggcttcttgagctggtggccaaaggatttaggttctctttgaaattataacttaactgggcctgctttatggcagggatatcactctctgaaatgtgtatatatatgtgtatgtatatatatacacatatatacacatatacatacacagggccaggcgtggtggctcacacctgtaatcccagcactttgggcggccaaggcaggtggatctcttgagccccaggagttcaataccagcctgaacaacatagtgagaccctgtctctacaaaaattaataaaaataaccaggcatggcagtgtgtgcctgcaatcccagctacccagggtgggaagatcgcttgagcccaggagttaaaagttgcagtgagctatggtcataccactgcacttcagcctgggcaacagagcaagaccctgtctcttaaaaatatattattattattatacacacacagacacacacagacacacacacacattacagatgatgagaaaatactctcagccaggttttcatgatacacaacttctcaaaaagcatcacaagcaggttagaattagggatttctttgtggactgtccaagatgttgaggaaatattggtttagaatttacctcatttaggccagaaatggtggctcacgcctgtaatcctaacactttgggaggccaaggccaatggatctcttgaagccaggagttttagcctggccaacatggcaaaatcctgtctctactaaaactacagaaaaaaaaaaaaaaattagccgggtgtggtggcacaggcctgtagtcccagctactctggaggctgaggcaggagaatcacttgaacctgggaggcagaggttgcagtgagccgagatcgtgcattacacttcagcctgggtgacagagcaagactccatctcaaaaaataagatagataagataaatatatataatatatatgttatatatataatatagaaactacagaacaagtgatctttgtatgtttccagaatataacagcgggacaggcataggatagacgttcccattgcaaaagggagaaattggaagggataaagaggtcaccagtcctaagcaagtgctaaatccagcaagacaaatcccattaggtttcaaggcctgagaataatcctcggtgactctcagctcattaacatacttagttctcagagccagactcaatgaggttacggcccgcatgttatgggtcaggaactgaggctaagtaactcactggagattatgtggtaaagaaggtccaggatcattgcttcagtctccaggatatggggaaggttctactcctgttatcccaaattttaaaatgtgggaactaaggctcagagaggttaagcaaatcacacagggttgcacagctagtgatgttgctgagatttccctgtgtgtagtggctcatgcctataatcccagcattttgggaggctgaggcaagagggtcgcttgatcccaggagtttgagaccagcctgggcaatatagtgagacctcatctctacaaaaagaaaaattaaaaagttagccaggcgtggtggcaggcacctgaagtcccagctactgggaaggctgaggtgggaggattgcctgagcctgggaggtggcgattacagtgagctgagatcgcgccactgcactacaacctgggcgacagagtgagaccctgtctcaaaaaaaaaaaaaaaaaaaagacattgccgagattcaaacccaggtcagcctgtcttctgaaatgtccctctatgacccactcacaaaactgagaaggcagaaagttgcttggacctgtctatttcccctgtgcagtctcagagaaacagtggaactgcctcggtttctccttccgggaagtattcatagaagcatcccacttacctactttggtctgaaaataaattagcttgtctctcttccacttactaaaaacaccgtgggtttttgcaagttaaaatgcaaaaataaaatgaggagaatggtgctggtagtttagccagtgggaagccctctggggaaagccagccttttatttattacttatttatttatttattctttctagatagatttatgggaaaccagggctgtgttgtccaggggtctgtagtccagaaggcatcagatgggctactaagtgagtctttgtccacctgtagatggcaagaggcagggcccaggtgtccatggcttggagaggcaggggttgatgggaggtttgaggctgtgggatctctcctggggcctcagtatcctcatctggataatggggacattctggccaggcacggtggctctatatatccagcacttagggaggcctataatcccagcactttgggaggctgaggtgggtggatcactgtaggccacgagttcaagcagcctgggcaacatggcgaagccctgtctctactgaaaatagaaaaactagctgggtattgtggtgcacgctggtaatcccagctattcgggaggctgaggcacgaggatcacttgaatccacgaggcagaggttgcagtgagccaagatcctgccactgcactccagcctgggcaacagagtgaggctctgtctcagttaaaaaaaaaaagaaaaaagaaaaagaaagaaagaaaaagaaaatgggggtattcatttatcatttgacagtaagtttacccagcattgactgtgtgagaggccctgtactaggcagtgaaaactcagctaagaataagaaagttaaaaacaagctgggcattgtggtttacgcctgtaatcccaacattttaggaggccgaggaggaagaatcacttgaggccaggagtttgagaccaccctgggcaacatagtgagacgccagtctctacaaaaaattgtaaaattagccagacatggtggcgtgagcctgtagcctcagctacctggaggctgagatgggaggatcactggagcccagaagttcaaggctgcagtaagctatgatcctgccactgctctccagcctgggcaacagagtaagaccctgtctgaaaaaaaaaaaaaaaaagaggccaggtgcagtggctcacacctgtaatctcagcactttgggaggctgaggtgggtggatcacttgaggtcaggaattcgagaccagcctggccaaaatggtgaaaccccatctctactgaaatacaaaaaattagccggtcgtagtggtgggcacctgtaatcccagctactcaggaggctgaggcaagagaatcgcttgaacctgggagccagaggttgcagtgagccgagatcacgccactgtacgacagagcaagaaaaaagaaagaaagaaagaaaagaaataagatgatggggagttgtggaaacctgtccatgggcacgtgaaggtcttgacctctgaccaagaagtgaacaggctcctctcaattccaggcactgcagggatctgggacatgacttctccatgaccaaactgtaccctttccttttcttttttgtttttttggtgacagggtctcactctgtcacccagactggagtgcagtggggcgatcacggctcactgcagcctcaacctcccaggctcaagcaatcctcccacttcggcctcccaagtagctagaactacaggcacacagcgccacgcccgtcaatttacacattttttgtagaaatagggtctcactatgttgcccaagctggtcttgaactcctggccttaagcaatcctcctgcctccgcttcccaaagtgctgggattacaggcgtgagccactgcgcccagcccaaattgtactcttgaaagatggaatcttagctaggatcctgaactgttgccttttatcctaaatcagttgttggttctttttcattcacttgccttcctcagagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaaggtgagaccctctgctctcacatcactgggcaggggacctggcgtccctggagccagaggctctgctgagtgaccctggactgtgaccccatctctctggcctcagtctcctcccctggaaaatgggcataggcgtagtttcctaccccacagggctgtggagggttcagtgagataatttgtgcacagtgcctggcacggggttgtgttcagtcgggttagcaatatcttctacgtccttccttcccaaggggagccaggaagccaccccatttgaggagcaatagggtcctctgatggaagcttgagggggtcagatgattgattctctcggcccagcactgtccaaaagaaatgtaacacaggccacatgcaaatgtcagtttaaactctctagtcgccacattaaaaaaggggccagatgtactggctcatgcctgtaatcccagtacttcaggaggccgaggtagagtgagccaagatggcacctctgtactgcagcctgggtgacaaagcgagactgtctcaaaaaaaaaaaaaaaaaaaaaaaatggtgaactgctgggtggattatgtcttaagttcatctagtgtcagttctatgtgagagattttcatgagtttgctggataaaggctttccatggtcctgagacctaagatcctaaggtcttgtcactgtgcccattttatagatgtagggactgaggctcagagaggctcagcctgcccgtgggcacataagcaggctgggctgcagaatggaagctccagaggctgatggctcctccccctgagtcaagagaggggtgctaatgggggcatgccatgcagtttatgggaggtctcagtatttctatctgttcagtgggtctcttggcactctccctacctgcctgcaagtgagggtgtgaaggtccaacgaggataggggcaggtctgtgttaatatcccatgagggccccaccgcactcaaggctatagagtggttgagagcaggctctcgggggccaggccgcctgggttccaaatgccagctctgccacttcctgctgtgtgaccttagacaagtcactttacttctctgtgcctcaatttcctcatctgtaaacaggagatcagaatatatcaacctcagggctatacaagggttcagtgatgtcataagatgcctggtatatacagcaggcactttagaaatgtcagccgcttcttgcctgccctgggagtacacaggagttcccagagacttgtgggaaattgtggagggagccctgtgttggttcttgtcccaacagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccgtgagtatggcccccagcaagggcagggggggcctggggctcccaccagggtggcggaagtcaggccagatagagggcaatgagtgagtgttgaccaccatgagtccagggatacctttgaacaagttgaaaatggatgctccttccgtaagtcaggtaagatgatttgtcacaatatactttgttggaagagacccctgtcctgccatccactagaaaatcattgttatttatgacaataaataaacaaatttgtcataaataaacaaataaatttgtcctaaacaacaaataaatttgtcataaataaacaaatcttcactgtgatgtaagaggcacccccttagaaatggctgccttgtgcagtacacagcctgaacaactgcacgtggcagccctaggacctgaactctgtttctaacctagactctgtaagggtttagattctgggcggatagtgtctgagttccatggccttctgtcttgggcatctttgaaatggatagactatttaggggagaaatttatcccatgaatgtcgtagtggctcggaggttgttttagaattgaatgtctcccagggatatttcttgaaagcctgaccgctcaaaatgcttcttgacaatgaaggatcatgtcagataagatgggggagaagctgctttctataatctgcctcttggcaactcaccctgggtagtaataaataaaagtacctttaaagtacttttttatttagttgacttatcgattttactaaggaaacacttatgtggtatctactcagtgccaggcactgttctgagtgccttaaaattttttttaatttctctgaggttgttactatgcttagctccatttgacagatgaaaaaactgaggtccagagacgtgaattcacctgcccaaggtcacacagcaagccagtgggagagctggagtttgagcccagacactggctctagcctccttgttcttaaccactcagctctgctgccattcacacaaccttatgaactatttattattggctccacttattaagaggttaactggcacatcccattggcacattcaaggctctgataaggcctgcaattcataatttcaataactaactttttggagcccctatcatgagccaggcataaattaagtcttgggtctcatgattttgtgaagtaagcactagtattacggctattttacagatgagggcaccaaggcacagaggggacaagtaacttgcccaaggtcacacagctaatttttaaaaagaaagaaagaaatctacttaacccatagattcacaatattgtttggccctgggacatttaatatcgaaaagcctttttatctcctacagaattaaggaccgtatttcttcaacctagcttggggatcaagatacttcaagagggtcgtttgggagtgataggaactttgctaaacagggcatgtgaatgtcttctctcaccgaggtcccctctgccttcttggggttccaggacccagagagggcccccacctggaggagtttaatagtttgttgtgtaggaggccttgggggttggagatctcagtagtggtaggtaacatgagattatggaagaaaagggtttgtgagcctgtggtctgagtggacctctgcacgcccatctgtctccaacagccttcgccgcctgtgccattacatcctgaacctgcgctactttgagatgtgcatcctcatggtcattgccatgagcagcatcgccctggccgccgaggaccctgtgcagcccaacgcacctcggaacaacgtgagtcccacagagcacaccccttcctagcctggctgctctgcctcaggccactttctcctgcatccaaaatgctcataggtagggtgggatgttggggtcacccctaggcatagcccttatggctgctggttgagaggggaagctctgattccttggggatgctcttgggagcaagacattccttgaggcagtttctctgtgagcctggtggggtggaggtggcccagagtgactggggctgaaaattgctggattctctaatggaggcgtgagactagcaggatatggatgttgcacattctctacatggaataggggggttactggggcaggggcggtgctcagaggtggtcccctccgcagtagacatttccctttgtacacgaagctttgaaagaaacaactatttggctcagaaacacagcctaagcttttggtttttatgaaagcaagcccctttgcggatggtgggtctgttgacaacccctgttaattgagcacttgctgtgtcccaggaagaaactcagcatgcagtatctcatttaatcctcacaatgcgcccccccaaccccccgcccaggcatccccatttgacagatgggaaaactgaggctcaggggaatgagagagtggtaagtggcctgtccagggtcacacagcagaattccaactctgcatcccccaaagctcccactgcttcccccaactgtctgcatttactaatcacctactgtatgctacggatgggtgtgcatagcccctttgagtcctgacaagcaggaatgagtgcatgcttgtggttgagatggggaaaccgaggcaccaacaggcaagggcgtgcctcagtcatgggctgcgggcagaggcttgaccccagggcctggtagagggtggactggtggctcctgtttccctccccagctccctcccccaacccttccctcccaacccagagccaaaaaagtgtgttttctgctggtccaaggctctgctgccctggctaagtaggttaggacccaggcaaagctggcgagccccatccctcaagcccgcccacagcttaccatgcactttcccttccttcccaggcctggcaggcccccctggggacctgatgggggagatggaaggaaataattagaacgcagctcctggaggaagctagagccagtgctcagcctcctcacagtccgcttagttgcttcccgcagcctggtttcccccaggggcctccaggagccaggcgtggggaggaggtgtccctggaggggtccacaaaccccctgctgacgcgaggatgctgaagaaggcgttgccttcggcagggagggcacaggcatggatgatccagggggcacggcagctcccagggctgaagggaatctaggcagtgctcagaccaggccccagggactgtttgcaaagagcgttcagctccccggccccctccctcgtccatctcgcagtcgaaacttctctacaagaacactgtggccccataacgttcacaccacgtaaccaccatccagggcaagaaatagaacaaaaacgccccacgcggcatgtgcctcctcgatcccccacccccaccgccttctttccctctagagctgctggggacactgtctggagacatttttggttgtcacgacaggaggggggaggtgctcctggcatctggtgggtggaggccagggatgttgctcagcacccgccgatgcccaggacagcccccactctagaggatgatccagacccaaatgtccacagagcccagcttgagaaaccctgccttaccggtaaccacgaccccagcttctggaatgagcgtttttggcttctctctttttcccacctgcacaggctttttttttttttttttttaagagacaatgtctctctctgtcgcccaggttggggtgcagtaacgtgatcatggctcactgcagcctcaacgtcccgggctcaagtgatcctcccacctcagccccccaggtagctaggaccacaggcatgcaccaccacacccagctaatttttaaatgcttgtagaaacgggcctcgctatgttgccaggctggtctcgaactcttgacctcaagcaatcctccctcctcagattcccagagctctggaattacaggcatgtaattccaattcttacatgcctgtaattggccaacactggccaattcttaaaaactgaatttatgtttgctcttctgtaacattcaataaatgagacacttctatgcttcgcattaaatgagtacatgttgcttttgcaggattgatgggcattcttttttttttttttttttttgagatggagtcttgctctgtcacccaggctggagtgcagtggtgcaatcttggctcactgcaacctccgcctcccgggtttaagcgattctcctgcctcagcctccagagtagctgggactacaggcaggcgccaccacacccggctaatttttgtatttttagtagagacggggtttcacactatcagccagactggtctcaaactcctgacctcaagtgatccgcccgccttggcctcccaaagtgctgggattacaggcgtgagccaccacgcccggtcaatgagcattctttatgatgctgttttgagatttactgtgtggcatgggatgtgttatccatcccctgttgacagatgtttgggttgtttctaagtgtgaatactgtccccatgccacgcccctcaacatgtttcctgagtcacctggacagtaatttctccaggaggccagatgcagtggctcacgcctataatcccagcacttcgagaggccaaggtgggagcaatgcttgaggccaggagttcaagaccagcttgggcaacatagtgagacccccacctctaccaaaaaaaaaaaaaatttttttttttttaattaaccgagcgtggtggtgcacacctgtggtcccagccacttgggaggctgaggtgggaggatcacttgggtctggaaggtcaaggctgtagtgatccatgttcataccactgcactccaacctgggtgacagagcgagaccctgtctcaataaataagaattcctccagggtataaaccaaaagcgaagtttctagagcatataatttgcaagtggttggcctcagtaaatgcagcttgaatgtttattggacaataaacacagtgaccctttgggaggccaaggcgggtggatcacctgaggtcaggagtttgagaccagcctggccaacatggtgaaaccccgtctctaccaaaaatacaaaaattatctgggcgtggtaacacacaactgtaatcccagctactcgggaggctgaagcacaagaatcgcttgaacccaggaggtggaggttgcagtgagccaagatggcgtcactgcactctagccttggcgacagagcgagaccctgtctccaaaatatatataaataaataaaaataaacacagtgggccgggcacagtgggccgggctcgcacctgtaatcccagcactttgggaggccaaggtgggtagatcacgtgaggtcaggagttcgagaccagactggccaatatggtaaaacctggtctctactaaaaatacaaaaattagccgggcgtggtagcatgcgcctgtaatcccagacacttggaggctgaggcagaagaattgcttgaacccgggaggcagaggttccagtgagccaagattgtgccactgcactccagcctgggtgacagagcgagacaccatctcaaaaaaaaattaaaaaataaatgaacgcagtggcccttgcaccagtagctcatgggaactcctgttcttccacatccttgtcaacacttggtactgtcgactgtttcatttggccgatctgctgggtgtggagtgagatcttattggggttgtgcttggcatttccctgtaatgaatgagatcaagcacttttttggattagactgagccacaggaaataacattttcaaatagatgaaaaagatctaagtattaggaatacttgaacctaatttattggtcttttgatttcctcttgcacagcttattaagagctccagaattagattcacctgacccccacggcctgccctttcccagctccctctcttccttctttccttccattcattcctttagtaagtatttgataagcaactactatgtgccaggtactgagcgagccagggaggattgacagggtatgagatggtccctgcactcccagagcccacaaaccaccaggcctttgaccaggctgtgcccactgcctcgtgcacctgaaatactctcccaccaccatcccctctgcccacccaggtctttcaagccaatccccttgcaccagcccctccctccaggaagtcacctcaccctgaccccaggcactctggtctctgattcctcttcaagcaccacatataacaggaatataagttataaccacacagatcacagagcccagctcctccaggacccagtacagccccaactgttgatgcattcattcaacaaacatttcttgagcacctactgtattcctgaccctgtattataagctggagacgccatggtgacagacagacatccctgtccttgtggggctgacatttgggtgggggagatggacaatgagattatcagtaactacaacaaatgttcagggagtgataagtggccgagggtgtggtgggcagagggaaggagagacttcgtaaagaggatctcaagcaccaggagatggaatttaaacagccggtcaggggagtcctcactgggaaagtgttatttgagctaagtcataaaggaggagaaagacggaatcaaatgggatgtgggggaaagcattccagagagacagaacagcctgtgcaaaggccctgaggtggaagcatcttggggaacaaaaggaagtgagcaagggagagaatgagaggaagtgagggcagggagctgaatggtcagatcgtgcaggggcttgagggcctcggggaggactttgacttttatccctgaatgaggtgggagccacggaggattgtaagcaggggaaggatgtgcctgacttctttggtgttcacagcgccctctggtggccatgttcagtaatgctcagcccttgcagcttctgggtggatctgattttttttttttttttttttttagacagtctctgtctcccaggctggagtgcagtggcacgatctcggctcactgcaacctccgcctcccacgttcaagtgactgtcacgccttggcctcccaagtagctggaattacaggcacacgccaccatgcccagctaattttttatatttttagtagacacggggttttgccatttggttaggctggtctcgaactcctgacctcaagtgatctgcctgcctcagcctcccaaagtgctgggattacaggctcgagccaccgtgcccagccggtgtccaccccctgtctagcaccagccagacactgtgccggcgcaccctcatcttcaggcctgggtgacaccagaggtgtgctatggtgtgtcctggacaggggctgggccagaggacattgctcgtccaggcagaaacatcaggcctggggaggggcacaggaaaaatcaacctaccctggcaggggcctggccttgaagcaggaagagatgccgtggcaggaagttggccccagtgtttaaaaaaaccacgtagcaactatttctcgcccaggatgcccaggaaagcaagggtactgggggattagatccatcaccaagaaggatacagtcagccctgaacttctctggggccgcttctaatccactacagggcttggggcaaattttaaaaggtacccttcccgtgggttagcgaactggcctagtacagtgatttttttgttaggatttgctgccatctgctggacaatttcattcacaacatacaaatctgcagtatgaaaagagatgggaggggcccttgtgcagtgcacgccctgcgcaactgtatatagcagctgtgtttcctcttctgggtagaaactctgctccccagtaggcgatcgttagttttaccggggctctgctggaacaggccagtgatccactgctctcttgcttttatcccttacaggtgctgcgatactttgactacgtttttacaggcgtctttacctttgagatggtgatcaaggtgagtgcagattataagtgagaacacacggtaatttttttttttaagcaagtgcagggctgggcacagtggatcatgcctgtaatcccagcactttgggaggctgaggcaggcagatcacttgagatcaggaggttgaggccagcctggccaacatggtgaaaccccatctctactaaaaatacaaaaattagccgggcatggtggcacatgtctgtaatcccagctactcgggaggctgaggcaggagaatcacttgaaccctaggctgcaatgagccgatgtggaggctgcagtgagccgagatcttgccactgcattccagcctgggtgacacagcgagactctgtcaaaaaaaaaaaaaaaaaaaagagctgggattccaggagatcctgagcctccaagaatgccccccttgagaggatgagtctcccagaggattagaaatgcctggtgtgtttgaagagcagcaaggaagctggtgtggctgggcggagtgagagaacagtggggaaacgaaggacagagagatgagtggggaggtgagggggcaccttgtgccggggatcacagagagggctcttcggctcttactttgagtgaggtgagggccatagagtgttctgagcagaggagggacttgatccaggtgttcacaggtgccctttggcatctgtgggaagccagaggacctgtgagcaggtgatcacactggtccccatgggcgatgacggggacaggatcaggctggtgaccaaagaagaggtgagaagtggacagattcttggaaggttctggaaatagagccagtgagttttgctgatagagccaccaatgagggatttgggacaaagaggcatcaaagaggatcccaaagtttggatctaagagccggcaagccagagctggcttccatcaggcaaaggggggccgcctcatggggcaggggctccccactcctccctggagtcctctggccactgcccatccctgcaagatgaggtggcctcattggcttccctgcctctccccgagaggctagagagtgggtggcagcaccccagggtggggatcaggtgggggttctgagcaccctctcttctcccccacagatgattgacctggggctcgtcctgcatcagggtgcctacttccgtgacctctggaatattctcgacttcatagtggtcagtggggccctggtagcctttgccttcacgtaagtctcctcgcaagggttcctcttgcctcttttcccccaacccccagcctgggccacacatcggattacaggacatgttctcagggtctagggatggggtgtgtgggctccggggacgtgggagatatcagcatgccaccaggaagagcttcgatggctttttgcatgatgtccatggaggaagaaggagaagggaccccccctcctgccaaccttctacctcctcacacagcaacgggcctcagccacatcactggccccttgctgtgcagcttcctgtagactagcctcgccggaacatctcatccccctactactccacaagcgccgcccaaaccgctgtctctttggaaagtccctaaagagacaatcaggaaacgaatgtgcatgagaattctgaccccctccctatgcctgaaggccccgtagttgtagacctggtgactccctttgtgtgtctttcacttctcctggcagtcctaggattctctgccctctgaaaggccatgtgtcatcctgcagctccaagatggcgccccagttgtaggcagccatttcaggatggcacccaagctcttagtagtcatcccaagatggcatccaagttctgggtggccattccaagatggcccctgagttctgagctatcattccaagatggcctctgaatttggggtggtcattcttagatggtccctgagttccaaggtgaccttcaagttctgggtagccattccaggatggtccccaagctctgggtggctattccaagatggccccaagttctaggcagccattgcaagatggcccctgagttccagggtggcccccaagttctgggcaaccattccaaggtggcatccaagttctgggtggctattccaagatggcctctgatttctgggctaccatgctaagatggcctctggattcttggtggccattcttacatggtccctgagttccaaggtggccttcaagttctgggtagccattccaagacggtccccaagtcttggatggctactcgaaggtgacccccaagttctgggcagccatctcaaggtggcaccctagttctgggtaaccattccaaaatggcacccaagttctagggcaaccatttcaaaatggcccccaagttctgggtgactatttcaagatggtacccaacaggtgagtggccattagcccttagggccctgatagcagacttagcagtacattcctgaagttgtagacatttggagcgggatgaaaaatatctaatcagtctttaatcaagaaacaaatcttggggaccctggctgtgcccatcatggtgaatgattccctgacaggttttgaaaggatcttgacacattcactcccatcgtgagagaatcaggggcttcctcctgtgcctctgcctctaggctccctcctgagccaatctggaggggcccttgaatggtctccctcaccaaacaatgaggacttggtttgtcaggagggccaaaatagtggcccatttccagtagaagggctgttaagtaggccacacttagattcttctctgggaacacaatgaggtcaagttgtgttagaacaaaaaatctccagagtttttggatgcctcagagctggagatgtatcatgaaggttgggaggctgattatacttctttctctttctctttcactccttcctcctctttctcctctctttttgttcgtttactcttttctttttctcttctcctctccctccccacatccttccctctcctcaaagcttttcagtgtctatttgactactagagcaatgcacggtggcttacacctgcaatcccagcactttgggaggctgagacaggcagattgcttgagcccaggaggccaagaccagcctgggtaacatagggagaccccatctctaaaaaaaaaaaaaaacaattagccaggcatggtagtatgcctgcactagcagctacacgggaggctgaggtgggagaattgcttgagcccaggaggttcaaggctgcagtgagccgaaatcgcaccactgcaccccagtctggggaacacaggaagaacttgtctcaaaaaaataaaaagtttaaaaaattaaaaatcaatgaatttgctatttagaatattatgctttatatggttactgaataattttaatagtgatgagtacaaaaaaaacaggtttagcaagctgttctgtaggttaaaaagtaaataaataaataattaattaaacaaaatacaatgcacatcaaattaggggacaaagattgtgacgaataagacaaggagtccatgtctttaaaatatgaaaagcagttacaaatcaataagaaacactacttctcaatggataaatgggcaaaggacataaacagaaatctgatagaatgctggcaactagtaaaaatggaggtaaatcaacccttggaattcagagaaatgtaaaataaaaacgagatacaattcattccctatcaagttagcactgttcccgccgcacccccacacacacacaaaaaatgatttttttagctaataaacagcatatataagaatgtattataataggctgggcacagtggctcacgcctgtaaccctagcattttgggaggccaagggagggggatcacctgaggtcagcagttcgagaccagcctggccgacatgacaaaaccctgtctctactaaaaaatacaaaaattagccaggcatggtggcggatgcctgtaatcccagctactcaggtgggtaaggcaggagaattgcttggacccaggagatggagactgcagtgagccgagatcatgccactgcactccagcctgggtgagaaagcaagattttgtctcaaaaataaaaaaaggaatgtattataataaaatatacttttctccccctctatcacctatttaagcaggtccttcaaggtgtcaggtagacatcatgctatgagaaaatttaaatcctgaaaagccagaatgttttaccaccctcagcctggaatgaatccttctcctatggaaataacctacgggtttctccacccctctctgcctttcagccccttccctccctctcccctccttttctttctccctctttctcttcctcctttcccctctcttccctctctcttcttccctctctctgtctctttctgttcgtctttctccttttaccccctctcagtttctatctttttattttcctctttctctctctctctccctctctttctctctcactccctgcactgttgatgacctatgtccttgggtgatgtgggcctcccctggaccgtgtagcttggagaaagctgaccctctgtcatcggtctggcaacaggggacttcgcccccctaccctgcattctgatgaggaatggtattcagacaaaggcagatcccagggacacaggaggacatgctcaggcagggacccccgcccctttcctctggggcaaggtctgctcagcagcctccaagattcctagggctcaagaggtggcaggtagctcagggcactagggcaggcagtggggtgaatatgtcactcatatccacctgtccacacacaatgcttaccttggccacctgtgcccaggggaatgggttttatcctgtgaatcctcccagtgaccaccactgagtgtggcacagataaatggtaccaagcccaagctgttcaggtctccaatgtcactttcctctcagacctctgttgtagctgacatactgtaatgctgaggagggccgggcacagtggctcatgcctgtaatcctagctctttcggaggccaaggcagatggatcacctggggtcaggagttcaagaccagcctgggcaacatggtgaaaccccaggcaacatggtaaaaccctgtctctactaaaaatacaaatattagccaagcgtgatagcaggcgcctgtaatctcagctactcgggaggctgaggcagaagaattgcttgaacctgggaagtggaggttgcagtgagccaagattgcaccactgcactccagcctgggcaacagagcaagactctgtctcaaaaaaaaaaaaaaatgctgaggaggtgactgtcccacctccatcctccgagttgaccatcacaatttagggaggggaatgacctacaaaggacccagaagcaagcctttcaattgttgagcttttgccattatgggccatcgtttacaacatgctgtttctaggttctctggaggtaaaattagcctcctcttttaaacaaagctaatctgcaaaagcgaaccaaaaattcttttccaccagagatcaattagcagaatgagctgggtgcgatggctcacacctgtaatcccagcacttggggaggccgaggcaggtggatcacttgaggtcaggggtccaagaccagcatggccaacatggtgaaaccccatctctactaaaaatacaaaaactagctgggtgtggtggggagggcctgtagtcccagctactcgggagggtgaggcaggagaattgcttgaacccaggaggtgaaggttgcagtgagccaagattgtgccactgcactccagcctgggtgacggagcaagactccatctcaaaaaaaaaaaaaaaaaaaaaaaacagcagaatgattcttttggggagttgactttttttttaatttctgagttttctttttaaatatcaagttatacaagggcattcaaaattggcctacaactcacaggaatttggcagcctgtttgcagagtcaagcttttacattgttctcatgaaattggtacaggcataaagccacccttcactcttgaaaatccattttgaatgttgttgttttaattcttatgcaagaaaaggatctggatagggatttcaggccatcctgtcaaccctggcaggcttgtagatcatgcaggaactgggaggtgtgagattttgccagtaggatcctggcaagtgcctgggactctcccagggttttggaagagccgacggacatgagtccaacagggagcatctttatatcatggccgaagggatgagagaggagaccctcaaacctcacgcctaccacaccctccccaccccactgtcaagagtccatctggtactgctgttcctcccccagggcagggctgcaggcccagcacagctggccaggtgccttgatcaagccattcctgcacacctaagagccaaactgctagaaaaccagaataggagctactgcttttttccctaaaaagttttggaatcttctccccgttacaggtttctggcctcttttgcctgagaaggtctctcaccctatgaggactttgcttattgtctttccttgttatcggatagttggcacattggaaggagcatggatgctctgaggttctcagcctgagcgctgaactctccacccgccccccaccccccaccccagggtcctctgcttatttcctttctggtcttttaacttgctttgtctgtcctctgtgcatatcccctcatagacaaggctgagagccccacaagtattagattgaccttattgttttaagaaattgtccctccaggtctgtttgatttctctctagatgtgcaagtcctttagcctctctgtgcctcagtttttcccatctagatgaggaaactgcagcccagagggactgtggagggaagtaagtccgacaagatcactgaggttgggttcagctgtcagatgctacccatctcccagccctgaatacggaggctcacagtgagcagaatgatactcagcagcctggccagcctgggttctttgaggcctggcagggctgcgagatccaggggaagggaataggggaagggagcataaggttattcccttccttgttgaaaggaaccttgccattctggcctgttggggtcaaagcaaggattcttcccccagtgctgtgattgtggcctcgtctccgatatgggagaaaactatccctgtggtcccaccaagggatgtattgaagctcttctgaagatgtccacccctcctgcacctcacccaaatatctgtgtgtgtgtgtcctgctcaattcactgactgtgtcccttgtatccatgcgtctaccataaacaccccatttcatgagccatcacacgtggtatcacgctctgtgcccatgcatcagggcggccaactgacatttctcagcagctggcagatcatgatcctgccctcaccgccaagagtccatctggcgcggctgttcttcccccaaaggcaggaccgcaactggcagagcgccttgatcaagctgctcctgcatacccaggagccaaactgtcaggaagccaaagatggagccctcaggctgctatctcttgatcctcatcttcaaaacagcccccacccctgaaggcattatttttcttgtgtatgatgaaatggaaagaagattagagtgcgagatacccacacctgggtttgaatcttagtctgtcttcccagctgtgtgcctgcccttgggcaggtcactctttttctctaggcctcagcttcctcatctggaaaatggtcataatggtgctgtcttcccataggcaaatgcagtgatgtccagaagactcccatattaaacctaaagtcagcagattaggcaaaaatcactgtcattgaaaactccctcaatcatccgtaaagaagctgggtgtggtgtctctcacctgtagtcccagctacttgggaggctgaggtgggagaatcacttgagccagggagttcaaggctgcggtaagctatgattgtgctactgcactccagcctgggcgacagagcaagaccacgtctctaaaaatataaaataaagccgggtgcggtggcttacgcctgtaatcccagcactttggaaggctgaggcagcctggcaacagagtgagaatccatcaaaaaaaaaaaaaaaaaaaaaaaaagtagaatctatatgattctacgtatgcaataattcctagatacactgaatttgagaaccccaagtcagactacaggaaaaggagatgagggggtgtggaggagaatccacttggaatatttgtagacatttaaaccattctgtgttttaaaaaatatcacagccgggcgcggtggctcacacctgtaatcctagcactttgggaggccaaggtgggcggatcacgaggtcaagagatggagaccatcctggctaacacggtgaaaccccatctctactaaaaatacaaaaaaaattagctgggcgtggtggtgggcgcctgtagtcccagcactcgggaggctgaggaaggagaatggcgtgaacctgggaggcggagcttgcagtgagccgagatcttgccactgcactccagcctgggcgacagagcgagactccgtttcaaaaaaaaaaaaaaaaatcactaacttccagaggggtcgtggatggaaaattccatagagtccgcttggcgacagggtttccgccattctgatggcggtcaagtctttctaacctggatctccagtcattgttgaaggcgcctaatgagccccaagcctgattccaatgaatcacgagaggaccagctgctaggtgctgatagctttccccaggcccgcatttgctcagagggcttcagagttgcttctaattccatcccaagtcagaactctttgctgaccccctccttcataaagagcaaagccaaggccatagcttttgttaatcaaacatcagaattccacagacctgagttggttggttgtttgttttaagagacagagtcttgcccaggatgcagtggctcacacttgtaatcccagcgctctgggaggcctaggcaggaggatcacttgagcccaggagtttgagaccagcctgagcaacataatgagacccccgtctctacaaaaaatggaaaaatttgcctgtatttccagctacttgggaggctaaggtgggagaatcacctgagccctggaggttgaggctacagtgagccaagatcccgctactgcactgcagcctgggcaacagagggagaccctgcctcaaaaaaaaaggagagaaggagagagacagggtctccctatgttgtccaggctggtctcgaacttctggcctcaagcaatcttcccaactcgtcctcccaaggtgctgggattatagctgtgagccacggcacccagtctgggcctgttttgcagatgaggataacgagaggcagagtcaggattcaaacccaggtcccctcaacttcaaagctcacaaccttttagacattctaaaaccttgcagctccacaacgcctggagaagaggggtttctccggctcttggcagtgactttccgtggtgaattcacctttggtaactgacagctttgcagctgtcctgctacctggaaatttggctttcttagtgctttcttgggcagtgccaggtgcctgccaagggcgggggactgaatggaggtgggggcggcttccagatggaaggatggacatcggccagcgccatgagcctgaggctcccccaactgctgcccgggcgggactcgggggtgctcaggggtgcgtgtgtgtacgtgcgtgttctgtgttcttttttctgaggccacttacgatctgtctctccctccgatgccacatcaccaggagcagtacacggtaaagtctctctctatctttctctctctctctctttctctctctctctctctcatattctgtctctcgtgatctgtcccctggtgcagcctcgttagttctgggcctgtttctgtggccttgtgtccttgctgccgctgtcctgtcgcttcaaatgaccagaactcactccctgcgaaggaggcatcccaaagggtcttgccaatgcctccgcccatgccccaccagttcttgcagagaacagaaggggcagaggttcagtttcaataggcaagctgggtggagcagttatcagaagcaatgaaagtgggccagacacggtggctcacgcctctaatcccagcattttgggaggccgaggcgggtagatcacttgaggtcaggagtttcagaccagcctggtcaacatggtgaaaccccatctctactaaaaatgcaaaaaattatctgggcttggtggtgcacacctgtaatcccagctacataggaagctgaggcaggagaatcacttaaacctgggaggtggaggttgcagtgagctgagattgcaccactgcactccaccctgggtgacagagtgagactctgtctcaaaaaaatatataaaataaattgaacaataaaaaaataaaatggccatggaatcgttttcagatgaggagatgcagaatgcccatggagacatgctcccaattgtcacttgtttgggacatcaagattttagccagttccatgtgcaacctggatgtacagttccttgactttttttctatcaacatgtattctaaagttcaatttcaaaaggaaactttagccaggtgcagtggtgcatgcctgcagtcccagccatttgggaggctgagactgaaggatcacttgagcccaggagttggaggctgcggtgagctatgatcgtgccactgcactccaccctgagattccatctctttaatttaaataaaaaaaaaggaaactatattatccacttacaaccagcattgctaacctaagataaatctgcaactgcaaaagtaaatgtaggccagacatggtggctcacacctataatcccagcactttgggaggccgaggcaggtggatcacttgaggtcgggagttcgagaccagcctgaccaacatggagaaaccccgtctctactaaaaatacaaaattagccggacgtgatggcacatgcctgtaatcccagctactcgggaggctgaggcaaaagaatttcttgaacccgggaggcagagactgctgtgagctgagatcacgccattcactccagcctgggtaacaagagagaaatgccatctcaaaaaaaaaaaaaaaaagtaaatctaacagaaaccagacaatgttgttgccttcaagctgggctctttgttaaaaggaaaattactaagtgttagggaggtgttaaaggcctattagcatctacctgaggcttcctttctcgcaaaagcagagcgtctgaaagatacgtggaaaagaaacttaaagtataataaaaaagaaagaaagaaaaagaaatgattatgcccctctgagatccaattatttaatctgtgcccctgttctgcctaaaattatctcagtgactgtccaacgtgtgtctcacacttgggggcacagccttgagatgataatgatgatgttagttttaaaaagaaaaaaaaaggttcagagttctgaatcctggagtatatctctgcctagcaggctaaaatacaattatcgtctttgttccctgaaaaatgaaaaaaatggagtcctttaaaaagcaaatggtgtgaagaatgatgtttttgcactggatactgagacccatcgtgatgggggtctctggggcagctctgctcatgacctgggaggtcactgtagggagatgttttctaggtgacctccccacccaaatactccaaccggaggcattcacgtgtcctgagaccacacgccaggcgcaggctaggggctaggacaagaatcaagattaaaggggaaatggccaggtgcggtggctcatgcctgtaatcccagcactttgggagtcaaggccagtggattacttgaggtcgggagttcgagaccagcctggccaacacggtgaaaccctgtctctactgaaaatacaaaaattagccaggtgtggtgactcatgcctgtagtcccagctattcgggaggctgaggtgggagaatcacttgaacccaggaggcagaggttgcagtaagccaagatcatgccactgcactccagcctgggcaatagagcaagactccatctcaaaaaaaaaaaaaaagattaaagggaaaatgaacacagagaagagtagattacactgtaagcctttgaagagttttctgtctaaaaccagagaccgaagaaacaaacaaagattaactccgaaatagcacataggagctggcaggagccagaggtaggcagtcaggaaatgctgtcggagggagcaacaggtaatttgggctttgaggaccgggtagttctgtgactggagaagtggaggaagggcatttctagcagcgggaacagtatatgcataagcagacagaggcaaaagaatgtggctggggcttgagatatgtagccataaatgggaatgcaaaggtgaaggtaagttggactagattttcaagagcattgaatgccatgcccagaagtttgcacttgctcttctgagaattcacgtgctccagaagaattctgagcaagagaaagagtgacaaggtcattggctttagccactgtgtgcataaaacatggaagaaaaggcagggaatgaggagcaagttgggagacgggtgaggggggatggcacccaggaatggatggcgggatgttaaggaaggtgacccactggggatggggatggggatagagggcaggcagttgaccatgactctcaggtttctggtgtggacaactggatgggtcatgagtgccatgaaccacaagctattcatggtcccactcaataccctcctcttggggggcctgagtcatggttggccaagggtgtcatggcatctctggggtctgcattgctaagctcagttccaacagaccttggactgaacttctgtgcagtcctctctggcaaagatgggctcagagacccttggagcaatgcagcagagaccatggcagcagccacatcagcatctgaaaacagcggcacccggttattttccctccttcagactcagggaatatggtgggggaggggagatttggtataagggccactttaagtatcttccagaatcccattggaagggggagaaaatcccatttttttaagagcccactgataccacctttaaaaagaatacacagggggccaggcgcagtggctcacacctgtaatcccaacactttgggaggccaaggtgggtggatcacctgaggtcaggagttcaagaccagcctggccaacatggtgaagccccatctctactaaaaatacaaaagttagctgggcatggtggcacgcacctgtagtcccagctacttggagaggctgaggcaagagaatcacttgaacctgggaggtggaggttgcagtgagccaagatcataccattgcactccagcctgggcaacaagagtgaaactccatctcaaaaaaaaaaaagaatacataggggaccactaaactcctagaccaagggcttttttgaaaatagctgtgaccaggtgtagtggctcacacctgtaatcccagcactttgagagggtgaggagggcagattgcttgagctcaggagtttgaaaccagcctgggcaacatggtgaaacctcatctctacaaaaagacaaaacaattagccaggcgcagtggcgtgtgcctgtagtcccagctacttgggaggctgaggtgggaggatggctttagcccaggaggcggaggttgcagtgagccgagatcgtgccactgcactccagccttggtgacagagccagaccctgtctcaaaaaagaaaaaagaaaagctgtgcagaaatgggggtggggaatcagccaacccccttgtgctgggtctcagggacacccaatacagctgctcaggcccagccagatggcaaagggccctcaaccaaccctgggaccagaaccacaaaaagccacgtacttactggctcccgagcccaagcttaacaggtgaaatggaccactcttcaccaggaagggcagggctgtgccaagctcaccccagacttctaggcctgggagggtagggtcccatggagctgtgggctgccccctacccaacctgacctctgcttcctctcttcccttcttcccacctaaacattcctccacagtggcaatagcaaaggaaaagacatcaacacgattaaatccctccgagtcctccgggtgctacgacctcttaaaaccatcaagcggctgccaaagctcaaggtgagattgggagatggtggggtgcggtgggggggactgtcagggttatcatgtacagctgagcaggttgtacactgctcaaggacaacacattaaaggaggtgctgataacatcctagccatcgtgtatggatatttgtattattacaacttcccagcagatggcagtaaagtgagctgacctaaaataatctgtgtattatggcagtttttctttagatgaagtgtcttggggttaagatcctttttcctaattcgcatgaaggcatcatatggatttaaaagggtataaccgtgatctgggaagcaggaactagatttcttgttccataaaattttgacttttcatctacctattctaggctctagtatctcccattccaaaatagcatgaaccagcatttcccaaaagcctgtcattcaaaaacatatatatatattaagggaaataaaatccagtcattagagcacccactttcactctatgcttcacctgggggtccccagtattatctcttatgtaatatgtttctttaaatcaagtcacacccgtaatccctgcattttgaaagaccaaggcaggagtgttgcttgagcccaggagaatgagaccagcctgggcaacatagttagactctgtctctactaaaaattaaagacagaaaacagatactgttatggaaatctaaccaaatatggctgcctgcctaaggctttgtgcattgacaactgctctttcttggttaaagagggaaaatgtcaatggtaggtgttaacatggtagcaactaagtaaaaatttctccttcactcaaaaggattgagagagttggaaaggaagtaactttgttaccttgtttttctgtgttgggctcctgtatcacttaaaagcatctctggtatcccatctgggagttttagatccatagaatgccaggattgagtccaactcctccaacgcttatttctgaaagctggggggaccttaccctagtgacttgacttatgaccttgcctgtaaaatgggaatgatcatggcagtattttggtatgatgggccactggaggcagaaggttgggcaggtccccagcccctcatgctctctgtcaactccaccccacaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcggtgggtctccactttccagcacattcccattggaaccagcaggtgggcaggggggaagtggctagaggcattggccacttgggctcagagactggagaagtgatgagccttggaagtgactcagttgcaaccagcttggatcttgggtagaaagaaaaccggttttagaatttgagtcaccacccagagccacagaatgagtcataagcaaattgattgacctttcagccaccgcctttgtcatgtgagggatattaatacacatccacagttccttacttgaaatcgttacaggcagatgtgtttcaaagttgagaatattttgagattcccatgtgggacatgacaccctcagctgggtctaaggcagccctataatcaaacacaatatttctgccataaaatgtgtaactatttacatcaaatggggtaaataacaagtataaagagcttcatgtccaatcagatcaggtttcattaccaaataagttaggtaagaggccaggtgcagtggctcacacctgtaattccaacactttgggaggctgaggtgggaggatcacttgaggccaggagttggagaccaggttgggcaacataatgagagcccatcctacaaaataaattttaaaagttagcggggcatggtagcacacacctgtagtcccagctacccgggaggctgaggcgggaggattgtttaaacacaggagttcaaggctgcaatgcactatgatggtaccactgcactccagcctgcgtgacagagtgagaccctgcctctcaaaaatatatacatataggccgggcgcagtggctcatgcttataatctcagcactttaggaggccgaggcgggcggatcatgaggtcaggagatcgagaccatcctggctaacacggtgaaaccctgtctctactaaaaatacaaaaacctagctgggcatggtggcagacgcctgtagtcccagctacttgggaggctgagacaggagaatggcgtgaacccgggaggcggagcttgcagtgagcccagattgggccactgtactccagtctgggcaacagagccagactccatctcaaacaaacaaacaaacaaacaacaacaacaaaaatatatatatatatatatgtatatatatatatgtacacgcacacacacatatgtattatatgtgtgtgtgtatatatatgtatgtgtatatatagtgatattgttaccagtgtaaagtggcattttgcaacacatggtagcctgttgttatcttgatggctatttattgaaattaggaggatgccagatgtctggataggagtctggaactaacccttgtttcctgccttgaaaaggagtagcaacctcccttagcctgatgaacctctaaatgtcccctatgtctctctgcctcctcctaaactccctccaccccacccccagcaagcctgaggctctcaccctgaggactagaagttatcacgttggaagagggtgctggaccctgggtcagctctcccaccaggagtaaggttgtgccatcacccatggatttatctcaaagtagatgcacacgtcatcccctatgaagcacaggaacacatggtggcaggatggggagtcactgcttcccaagcagtctaggctggtggaccactcttcctttccctccccctgtctctgataaccaaagacaagtgcaagacagcccctctttcccatttactaacagtccccactctctgtggcagaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacagtaagtggcccgactggaaatctatccaggaggagccctggggagcaggaggataaagggcctgagagcttagcaataagaaaggtcttggaggccgggcatggtggctcacgcctgtaatcccaacactttaggaggccaaggcagatgtatcacttgaggccaggagtttgagatcagcctggccatcatggcaaaactccatttctactaaaaatccaaaaaaaaaaaaaaaaaaaaaaaaaaaaaaaaaaagctgccaggcatggtggctcacacctgtggtcccggctactcaggaggctgagacacgagaatcacttgaacccaggaggcagaggttgcagtgagccgagattgcaccactgcacttcatcctgagtgacagagcaagactatggcctccccgccttcaaaaaaaaaaaaaagtgaggctgaatcatggacttagtctttatttaaaattttgagccacttgtggtggctcatacctgttatcccagctactcaggaggctgaggtgggaggatcgcttgagcccaagagttcaaggctgcagtgagctgtgattatgccattgtactccagcctagacaacagaaggagacccctatccctgaaaaaaaaaaagaagaagaaattgatatttgttcatcatggactttttgcattaattttgattttttaaaatattggagcaaaagattatcttgattactgagattttcagtacccccttaatttgcacccaaaacaaatgcctccctccctcacctcgtccaagtaatggtctttctctcagaggtcttggaaatgccaggctggaagcttggtagattccagcatgtgccctcagcatcctcacctccctccctctctcagcaaatatgccaacctgaacatgccctactacccactctcagacacatccagtactcacacatgtgggaataatgctaacccacaaggcacctttgagcaaagtttttttaaacacctttctcaacagacttcatttccatctgtctgaaaatcatcgcaatagacttaaatgattttgttcaaacaaggcactgaaggaccacctgccaaaaaattgtcatcatgaatacacaaatctatcatgcctatcatgtgaaggtatcgcttagacacagagcctttgagcagtgtgcaacctgcactactgtacagagctgctgtgcacttacccactctcatatatatccccattgtacctcctgagcacccagcaccacctgtgctcaaatacccactctacatgcatacacccacctctactccctccattgccacaacctgtctttaaatcccaacttggccacttataagtgggtggtcttcagcacgtccctttaaattgctgaacctcaagttcctcatgtgcaaagtggagccagtaataacctccctgggagggttgctgagccggtggggatgaattgttgaatattgtttccagcacacagcaagcccttcatgcacagcagtagaaatgactgacattggccaggcgtggtggctcacacctgtaatctcaacagtttgggagaccgaggcaggtggatcacctgaggtcaggagttcaagaccagcctggccaacatggtgaaaccccgtctctactaaaaatacaaaaaaattagccaggcttggtggcgcatgtctgtaatcccagctacttgggaggctgaggcaggagaatcatttgaacccgggaggcggaggttgtagtgacccaagatcacgccgttgcactccagcctgggcaacgagagcgaaactccatctcaaaaaattaaaattaaaattaagaaataactgacattgttgtcagcctttcaaaaaacagcgactacttaaatttctttttcatttccctctgttcctgttctgccatctcacttccaccctctctccaccttcctcatcaccccttgggtccctgtctctctccttcctgccccttccctctccctgccccattccttgcagggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgaggtgccacttccaattccatctgtcctttaaaaactggggacacacacaaactttaaaacacacacaacacccaggaacccctttctaggggtacctgggggagggaacagaagcattgtcccaaccgaatccggtcttcagggcagcccttcatggagtttccagaggaaacacatcatatagtgtatgtatcagtcagtttagactaggttatgccgcagtaacaagcaaccccagatttcattgccaaatatccacaaagggacttattttttgctcacactgcatgtcaacatcagttgtggatcttgccatctttattctggttcccaggctggcagagcagcagagcagcctccctctgagatgctccagatgaaaaagagagtatgtcagactgaggttcagttcttcaggcttgtgctcaaaaattacacatgtcacttctgctcacatttcatcagccaaagcaagtcacacatccattctgacatcagtggagtgggcaaatacaatctcccctagcgaagggtggtgaatatttatgaatgaaaagccaagccaggtgtggtggctcacacctgtaatcccaacattttgggaagctgaggcaggaggatcacttgagctcaggagtttgagaccagcctggccaacatagcaagaccccatctctactacaaatcaaaaaaattagccaggcaggatggtgcacacctttagccccagtaacatgggaggctgaggtgggaggatgcttgagcttgggagttcgaggctgcagtgagctatcattatgccactgcactacagcctgggcaacagagcaagaccctctctcaaaaaaagaaaaggaaagaaaatccagtcccctgtctaccagagagtatagacatgactctttgcctctctggcatcatccaagctaaatagaggacctagaatatatcctctgctcccttgacccttaagacttaataaccactattcctccttctctctccctcaaagagaaggagaagacgcagcaaagtattcagtaagaaagaatgggctgggcgcagtggctcacgcctgtaatcttaacactttaggaggccaaggcaggaggattgcttgagcccggaagttcaagaccagcctgagcaacatagtgagaccccatctctatgattaaaaaaaaaaagttttaattagctgggtgtggtggtgcacgcctgtagtcccagctactcaggaggctgaagcgggaggatcacttgagtccaggaggtcaaggctgcagtgagctgtgattgcactgcactccagcctgggtgacaaagcaagcccgtgtcaaagaaaaaaaaaaaaaaaggaaggagggagggagggagggaaggaaggaaatgagagagagaaagaaaggagggagggagggaaggagatagggaagaaggaatgaagaagaaagaaagggagcgaaggaaagaaggaagaagagagaaaggaaaggagaaaggggaaagggtggaaggaatgaagggaaggaaggaaaaaggaaagtgaaggagggagggaggaaggaaggaaaggagggagggaaggagggagggaaggagggagggagggaaggagggagggagagaaggagggagggagggaaggaaggagggaggaaggaaggaaggagggagggagcgagggagggaggaaggggaagaaggattaggcttcaatttgatttggcacactcggtagctgtgtcacctcaggcaagtggtttaacctttctaagcctctattttggtgatctgcaaagtgaggccattgatagtacccacttcccatgtttgtattagccatgcaataatggggaaatgtcagtgcaagttttggcagttggtgacatctcaagcaactgtagctgttgggataagaaagcaatggtgagaaggaagagagagcccaggaatcctggctgggggcaagagaggcagagactcaagcagaagcacttgagaaccgcgacgagttagacagagggtgcccggtgtacagccaccttcctcctgcctctgccgctctcaccactggcctctctcccgcagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaaggtaagtgccccacaccagcccccagcactacttaacccccacctcgttcctgcctctaccctgataaaatgaaaccatctgcagtttcccagacagaccacactctggatcacctctgagattttgttcctgctgttccctctacctgacacactgttcccaccactcccccggccagcttcttcttcccagctgtacctgcagacctcttcctccagaaagccttccctgaccacccaagactgcttgaggtgcccatcttagcaggcatcctatctttatgtcgcctgccacaaaaatctgcgtcaggttgcatgacagtgtcccccacccatttatgatgacctcagccctgaattcctagaggccaacaaggatctggctcagacggaacaagaagctctctataaatgtttgattaatgaaatgagggggctgggcgcggtggctcatgcctgtaatcccagaactttgggaggccgaggcgggcggatcacctgaggtcacgagttcgagaccagcctgaccaacacggagaaaccgcatctctactaaaaatacaaaattagccaggcgtggtggtgcgcatctgtaatcccagctactcgggaggctgaggcaggagaattgcttgaacccgggaggcggaggttgccatgagccgagatagcgcaattgcactctagcctgggcaacaagagcaagactccatctcaaaaaaaaaaagaaaagaaaaagaaagaaatgagggagaaggggtaggtgaggaccctaaaatccccagggctaaggagcggcttccaaaaaaaaactctgaaaacctttcaccctgtgctttggactccaaagcgtggattcaagcccagctcttccatttaattcatttacctttgtacaagcaaccagtgactttctggggactcagtttccctgtcaataaaatgggaatgataataagagcacatttgccccctccagaggaggtgagaggattgaatgagaaagttcatgcaaggaccttagctccttctcggcacttcaaaaacgatcaatagtggccgggcaaggtggctcacacctgtaatcccagcactttgggaggtcgaggcaggcggatcacttgaggccaggtgttcgggaccaactggccaacatggtgaaatcccgtctctactaaaaatacaaaaattagctgggcgtggtggcgcatgcctataataccagctgcgtgagaggctgaggcatgagaatcgcttgaacccagggggcggaagttgcagtgagctgagatcacaccactgcactccagcctgggtaacagagtgagactccgtctcaaaaaaaataaggaagccggggacggtggctcacgcctgtaatcccagcactttgggaggccgaggagggcgatcacaaggttaggagatcaagaccatcctggctaacacggtgaaacgctgtctctactaaaaatacaaaaagttagctgggcatggtggtgggcacctgtagtcccagctacttgggaggctgaggcaggggaatggcatgaacccaggaggtggagcttgcagtgagccgagatcgcgccactgcactccagcccgggtgacagagtgagactcctcaaaaaaaaaaaaaaaaaaaaagtataattcagccaagcacaatggcgtatgcctatagtcccgactatcaggaggctaaggtaggattgtgagttcaagcccagcctgggcaaaataggaagaccccgtctaccaaaaaaaaaaaaaaaaggttgggggaggtttttgtttttttggatgtgaaaagaagagcctagtccggcggagagcggggctttcctgaactgtgcctcctaccagtgaggttgctcagaccttgcctggggctggagtgttgcctggagaacagccatgaagctgcctccccacttcccacttcccacccctgctcgctgacccctgctactcctgcttctttcccctagttctatggggcttctgttgcttatgaaaatgccctgcgggtgttcaacatcgtcttcacctccctcttctctctggaatgtgtgctgaaagtcatggcttttgggattctggtaagtaccaccttggggctacagctatgggcttgggagaagcccaagggggaacaatgggtcctggatgatggtctcccaacgtggccccaagaaccccaacctcaagggtggcttcagtatcctgccagtggccacagatcctacttaggcattcttgtgtttgccaaggagtcccagggagacccaacctgtgagtgttaccatatggctgcttatgtatccagttcctcaaaatgatgggagtcatcatggctgggagtctttagcatccattttagagataagaaaactgaaatcaggctgggcgaggtgtctcatggctgtaattccagcactttgggaggccaaggtgggcggatcacctgaggtcgggagttcgagaccagcctgaccaacatggagaaactctgtctctactaaaaatacaaaattagccgggtgtggtggcgcatgcctgtaatcccagctactcgggaggctgaggcaggagaatcgcttgaacctgggaggcagaggttgtggtgagccgagatcacatcactgcactccagcctgggcaacaagagtgaaactctgtctcaaaaaaaagaaagaaagaaagaaaactgaaatcaggctgagcacagtggctcatgcctgtaatcctagcacttcaggaggccaaggcaggaggatcgcttgaagctaggagttctcaaccagcctgggcagcaaagcaagcccctgtccctacaaaaaaaaaaaaaatttttttttaattagccaggcatggtaactcgtgcctgtagtgccagttactcaggaggctgaggtgggaagatattttgagcccaggaggtggaggttgcagtgagctatgatcatgccactgcaccccagcctgggcaacagcaagactccatctttaaaaaacaaacacagaggtcaggcacagtgactcacacctgtaatcccagcactttgggaggcagaggcaggcaaatcacttgagcctaggagttcgagaccaccctggccaacatggcaaaaccccatctctactaaaactacaaaaaattagcctggcgtgcttgtgggtgcccatgatcccagctactcaggaggctgaggcaggagaatcgcttgaacccacaaagtggaggttacagtgagctgagatcacaccactgcactccagcctgagcaacagagcaagtctcaaaaaaataataataataaaaataaatatgtctttatttttcaccagccactaactaaattttaacatttccttccatcttaaagggagataacaaacccttagtattagtattatcaacccttaatattatcaacatgacctgtgtcacttataaacatcagatattttcatactgcattataagagctgcagataccttaacatttaatttgcattcatcattgctttaaaatgttgcttgtgattaaacctacagctagaatttgttactcagtgtttttttgttgttgttctgttttgttttgtttgagacagtctcgctgttgcccaggctggagtgcagtggcgcaatctcggctcactgaaagctccaccccctgggttcacgccattctcctgcctcagcctcccgagtagctgggactacaggtgcctgccaccacacctggctaattgtttgtatttttagtagagatggggtttcaccatgttggccaggatggtcttgatttcctgacctcatgatccgcccgcctcggcctcccaaagtgctgggattacaggcgggagccaccgcacccggcctactcagtgtgttaatggagaagtatattcattgttagatcgccatttttaaaactttttttttttttttgagacacagtcttgctctgttgcccaagctggagtaccgtggcacaatcttggctcactgaaacctccacctcctgggttcaagcgattctcccatctcagccttctgagtagctgggactacagatgcacaccagcatgccaggctaatttttatatttttagtagagacggggtttcaccatgttggccaggctggtctcgaactcctggcatcaagcaatctgcctgcttcagcctcccaaaatgctgggattacaggcatgagacactgtgcctagccttaaaaaatattttgatagctattttattacaaaaggtaaccttgcagcccttgctattttgttatgcatttacaagcctttatgcataaaataaaatagccagcactattctcacatggccaaggttcatagcacacacacaaaagtatagttggctgagtgcggtggctcacacctgtaatcccaacactttgggagacagaggtgggtggatcatgaggtcaagagatccagaccacccttgccaacatggtgaaaccccatctctactaaaaagtacaaaaattagctgggtgtggtggcgcatgcctgtagtctcagctactcgggaggctgaggcaggagaatcatttgaacgtgggaggcggaggttgcagtgagccgagatcttgccactgcactccagcctgggtgacagagtgagactccatctcaataaataaataaattaaattaaattaaattaaaattattttttaaaaaattgggggctgagtgtgatggctcacacctgtaatcccggcagtttgggagcttgaggagggcagatcccttgaggtcaggagttcaagaccagcctggacaacatggtgaaaccccgtctctactaaaaatacaaaaattagccaggcatggtggcgtgtgcctgtaatcccagctactcgtgaggctgaggcccaagcatcgcttgaacctgtgaggcggaggttgcagtgagccaagatggcaccagtgcactccagcctgggtgacagagtgagactttgtctcaaaaaaaaaaaaaaattaaggtgaagaaggcttatactagtgggctgggacttgaagtgaagtgaattcttgaaggtccccagtgagtggccaaggtgggacttgaaccaggacatctgttctcttgaccaccagcttagtccatccctttgaagagagtgacctacagtctgggtctcagccagggtctcaggaaaccaggttcccaccttggctcacggaggtggttaggggcatcagctttagcaccagagttcagatcttgcctcgtcctatataagctttgtcacctccccatcattaaaaggagccatcctccccctccacctcagcagagccctggtaaacagcaaatggactaacgtgcatctagagggttgaggatgaagcctggcctggcatgggcactcaataaatgctaggggccaggcacggtggctgacacctgtaatcgcagcactttgggaggctgaggcaggtggatcgcttgagcccaggagtctgagaccaacctggacaacatagtgagattctgtctctacaaaaagtacaaaattagcctggtgtggtggcgtgcacctgcagtcccatctacttaggaggctgaggtgagaggatggattcagcccaggatgtcagggctgcagtgagtcgtgattgagccgctgcaccccaccctgggtgacagagcaagaccctgtatcaaaataaataaataaatgctaggaaagggatcctactaatggacctttttcctccaaaacagtggctttcatttggtggagatgctacttattagaagcacttgaggccaggtgtggtggctcatgcctgtagtcccagcactttgggacttctgccaaggcagaagaattgcttgaacccaggcgtttcagaccagcctgggcaacatagcaagacctcatctctagaaaacattgaaaaattagccagcatagtggcacatgactgttgtcctaactacttaggcgaaggcaggaggattacttgagctcaggagttcaaggctgcagtgagctgcgatcacatcactgccctccagcctgagcaacaacacaagacccggactctaaaaatcaaaaaagaagcacttagggaaatttcttaaaattaaatgataccctgagcaaacccctagatgttctgattcatttggtttggtgaggtgggagggaatcactgaatctgtaatttattattatttttttttttttgagatggattctcactctgttgcccaggctggagtgcagtggtgcaatcttggctcactgcaacctctgcttcccgggttcaagcaattgtcctgcctcagcctcccgactagttgggattacaggcgcccaccatcacgcccggctaatttttgtatttttagcagagacggggattcaccacgtcagccaggttggtctccaactcctgacctcaggtgatccgcccgcctcggcctcccaaagtgctgggattataggcatgagccaccgtacctagcctgcagttattttattctgagttgatcttctgctggtgaagtgagtcttccactggggcctggagctgcatctccctcaccctgccaatcctgcaagagccagcactgagcttcccctctgctttctcttttttttttttttttttttttttgagatgggatcttactctgttgcccagcctgttcttgaactcgtggcctcaagcagttctccctccttggcctcccaaagtgctggaattataggcatgagccaccacgcctggtctcccctttcagttttaaatgaagccacaagttccctgtataacatttgggagatagaggggagctctctagcctaggggttgaggtctgtgaccaaacgcctataaagttgtctttgtttggactcccccagaagcagagcctgagacaaggattgagtgcaaggaatttatctgggatgcagggcagtaagggagagaggaagtgacacagggacagaaaggcaaccaggaaagagtgtattattaagccagttcctgctgtgaacaaatggggctcagtttcagtggatacctccaggaggcaacagagagcacataccacagagtcatcccacctcacagggagggaattggagtatttatcctccagtgcccatcagacataatcacaggccactcccaggggagctattaattccctaacacttgtgcagccacagagagaccctgggcaaagtagtgtacctcaggtgtgtagttgagctatgggcagggccccagcaacacctgccaaaatgccaaaagtgccagtgggacctgaattcctttttatttatttatttatttatttatttatttatttatttttatttatttatttttgacggagtctcgctctgtggcccaggctggagtgcagtggtgcaatctctgctcactgcaagctctgcctcccaggttcacgccattctcctgcctcagcctccggagtagctgggactacaggcgcccaccaccacgcctgcctgatttttgtgtgcgtgtatttttagtagagatggggattcaccatgttatccaggatggtcttgatctcctgacctcgtgatccgcccacatcggcctcccaaagtgctgggattgcaggcgtgagccaccgcgcccggccccctgaattccttttttaggcagttgtgaaacaacaacatcccatctgttgggcacctactgtatattccatgctcagcgacgcacattcattgtctgattgctgtgttaccactgccttccagagaagggcgcagaggccccaggcacttcgcctaggagggaagcacagctctaaggtcaggctccttctctgtaaggtagaggggctacttcagggtcacactgaccgccccaacccctgacctggcctctgcttctgcgaagatgctgagaaggccctgtgttttgtgttttgggtcccactgaccccagaggggagggccatctctttgacccagactcttggatccaaactggggtgccacccatcaccatgtcagtacccggttgaggggagtcagagatagcaggagaccttgtgggacttgaggctgtgactgttctccaaacaatgtggagtatttccatattttaacaaaagagaggccaggcgtggtggctcacgcctgtaatcccagcactttgggaggccgaggcggatggatcacaacgtcaggagatcaagatcatcctggctaacatggtgaaaccccgtctctactaaaaaatacaaaaaattagccaggcgtggtggtgggcgcctgtagtcccagctactcaggagactgaagcaggagaatggtgtgaacccgggaggcagagcttgtagtgagccgagaacgtgccactgcactccagcctgggcgacagagtgagactctgtctcaaaaaaaaaaaacaaacagagaggttatgcttgtgtttccccttgagccagcacccagcccaggaatgcagcagtcaggatagatcaagtgaagctgcagtaacaaacagcccccacatctcagtgacttaaattgatgggaagggttttttacattcagcagggaagctgtttgcctcatagttacccagggacccaggctcacagagtagctgccattcaaaatgttactggtcgccaagcccagggttgagaggctagagagtccaacactgaccagaaagtgaccacactgcttccacacacagcacatcactgcacctagacacacatggccccatctaaacacaaggggaccaggaagtgcgtgtgcctgaaaggccccaaagccccgtccagtgcctgttctgcaccctgttactgtccgcctccagatcaggaaatggaggcccagagaggttaagccacttgcccatagccacacagctgtggtagcagagctgggatttgaacccagagtctcctttctttgcgagtatgctgccaacctagtggggacctgaacacagactgtgggctctctgaggcctgggttcaaatcctggctttacatctctgtgctgctagcctcaggcagatgagtggcttggttacctcctagaaaatgggtatacctgggagtggtggctcacgcctataatcccaacactttggaaggccaaagtgagcagatcacttgaggtcagaagttcgagaccagcctgaccaacatggtgaaaccccgtctctactaaaaatacaaaaattagctgggtgtggtggcatgcacctgtggtcctacctacttgggaggctgaggcaggagaatcgcttgaacccaggaggcagaggttacagtgagccgagatcgtgccactgcactccagcctggatgactgagcgagactccatctcaaaaaaaaaaaaaaaaaagagaaagaaagaaaaagaaaatgggtgataacccttccctccaggatcttcatgaggagctcagtgatgtcatttataaagcccctggggtctcgggagccctcaaaaatgctggagagacaggccacagctctgaagagcagccccagccctgtggagctgaagcagggtctggaggccccctctggggccaggccaatcatgggaaggcccccaggagttcccagggagggagactcagcacagatgatgtcgaacagcctttaccgcagcccttcgaacaaccataactgtcccgggcactccgctgatgggcaactgtgcctctaacatgcacccggccagcctagggggccgggaaccaagccctctgttggcatctctgtcttgtgggtccccattctagaattatttccgcgatgcctggaacatcttcgactttgtgactgttctgggcagcatcaccgatatcctcgtgactgagtttggggtaagtctccctccagcttctctctgggtgactctgggctggacgaggcaggcggcagggggcgggggagcggtcccagaggcagtgtgtcccggcagccatagctgcttgagccagcacttggccatgaccagagagggagaactggggccccggggacaagggcagcccctcaggagggcattgtggggagatgggggtaaccaaagcttggctgtagggccagcactgaggggtgggctttcctgcatcctggcctaggaattaataatgcagatgagtacactgagggaactgagacactcaaaagctctgaaagctgagccggctcccaaacaccaccctatgtcaggagcccagaaggaatgggtttcaagtcaattctgtttgaaccaaccctctcctagttagtgggcaggagagagccacagccctcaggccagtgtggggacaccactcccagggccatagaggggtccccagggtgtcttccctcctctagccccgggcctgggagactctcaacatgggagtctctggacctctctgtggtggccccacaggccacattgcccttctccttttctggaagactcagggccccagaggtcctgtcctagaccctctccttggccatctgccaatgagcccaggcttggggtccctcaggagattggggggagggtagaagatccttgcagggggaagcaatggtcaaaaaagggtgtcaaagccaagggtcaagggtgataccaatgtcatcttactaacaataaaaataacaatagctcacgagaatcgcagccttgctgtgtgccagggaactgtgccaagtggtttacgtggattggctcagggtagaggtcttggtctcagctcgtaagagaattccctcggagggttcaactgaaggcacccaaatgcagagctcactggtggaggggaagggaagggtacccacaagggtggcaaggtgtccagcgaccacccaccgtggggagctgtcacctgcccaggtgctgaagtggggagggaacctgagccggaggccaggagaagccaccaagtgggagctgtcctgtcaatgtggagagacagagaccagggcccaagcaggcagagagcaataggggagaaacaccccaacctttctctcccctcatcccttatctcctgccagagcctcccatggcccaaagtaaaccggaagcaagctgaatatgatgctcagagcaggcagggaagtcaggagaatagatctgggtgtggtcgggcctgaggaagagggtgttgcctcatttcacagatgggaaaactgacctcagctgggcacggtggctcatgcctgtaatcccagcactttgggaggccgaagccggcggatcacctgaggccaggagttcaagaccagcctggccaacatggtgaaaccccatctctactgacaatacaaaaaaattagccaggtgtggtggtgcatgcctgtaatcccagctactcgggaggctgaggcaggaaaattgcttgaacccggaaggcggaggttgcagtgagcgacggtcacaccattgcactccagcctgggtgacaagcgcgaaaactccatctcaaaaaaagaaagaaagaaagaaagaaaactgatcttcaatgcctggggaagtgagagacactcccaaggtcacaaagccaggcctgggtgactcctgagagtacactgacagctcctggggtgtcccagtcagatccccctacagaaaaggatctgtttgcctgctcttccgtcctagaaggccaggaggggctggggaactacacaaaagagggggccattctttgatatgtcctacggcacccgcacccaagtgatacacacttatttgccttcagctccagtgagccagaattttccccttcccctcaccctatccctgaaaccttcctctagagggttcttgcccacatgggggctctctccactggggtgcccccacctggtcattctcccctgtcctgagtttctagagagggctggagctccagctggcaatcaaaatatcttgccatccggctacatacaagacagccttgaaccaatgtccctttgggtcaagaggttagaaggatggtccagctccccagaagggcaggtggggtggaggaagttagctgaaaccttcaatcaccagtaagagagctgtagggacagactccaacagcctgttctcctggctggcaggaagatggggcatggggtgttcatgggacatcaggacccttgcagtagccaaacagcccccagccctccctaccagctgtttgatcttggacaacttgcgctatctcttctcatgtagagtggggctaaccattgcaaccaacctcagacacttgcaagactcacagtgatgcatgcactcaaaagacattcattgagcacctactgtgtgcctggtgtgattataagtgctggagacagaacgagaaggaggggtgccaaacaaaacagaccaagaatacagagtgtctgctcccatagagctgacattctaaggagagagacgggaactttttacaagtaaaagcatcaacaggccgggcgtggtggctcacgcctgtaatctcagcactttgggagaccaaggcaggtggatcacttgaggtcaggagttcgagaccagcctggccaacatggtgaaactctgtccctactaaaaatacaaaaattagccgggcacggtggcaggtgcctgtaatcccagctactcaggaggctgaggcaagagaatcacttgattctcaggaggcgagaggttgtagtaagccaagattgtgccactgccctccagcctgggcgacagagtgaaactctgtctcaaaaagaaaaggaagaaaaagaaagaaagaaacgtgaagtgcttggcacagaacctgccaggaaaccaggagtttgaaaatggtggttgttaactattactgctgttgttattgttattgtgaatgggtgtgtagttttgttagccagccctgagttacaatcaatttgagggaaagatagggggtgggtgtttgggtccttctgggacaattaactcccaacctggagtagggagaggcatgtcctggcaggcaaggaggtctcagttgcccctttctgcctcccaggtaagcccactagttctgaggccagggcttggccaggctgagacaggaaatgccagatgcttgggcgggcaggtccctggggtttagggggcagagggcatgcggcagtactaaccagtgctgtctcagctgctgcccccaagtggctggggtgatgtgggtttgccctgtgtgcaatggataatgactgtgtttcttgtcttgtctcttttcatgcctgctcttaaaactgtatattggcgcaacgccgtctgaaaaactcatccaatcaaaatgcactatgaaattcatttgttcatccatgacatggtctgtgtgttcatacaccaatgacttatctcccaacccaccgccaccaccacccccactccccgcccgggaaccgaaacccattggttttttggcactggttacaaatcaacctaaaaaatgctgaacacgcctccccaactgcccccgcccgcccgctccccctcatcttcaacatctgcatctagaatccggttggtcttacttctttctgaagtctaaatgccttacattaactgtgaacgcatctcctcgcgtcggcattgcatgccacaccctgcctctccaacgtgggatgcctgacgctctcctcaaccctccgctctcctctgtctgtctgtcctcccgcccccagcccctgtgcctcccacttcctgtagactctgtctctctgtttttatcgggttctgaatgggggttttctgtttggggtggtttgcgtcttttgcagagaaagggatgggttttcccagcgcagcacctctctcttgccccatcccgcacacacatcccctacactcagagacaatagaggcaaatccactcccagccacctctcaccactcctgtcccccattcagctccatggaccccaggccccaggaaagctgccaactgtctcctcgcccctccagctctctccatcctgctgtccccaatcctccatctcaagcccacaagatctttggccttgaccagcagagacttgactctccaagtctgataaaggagacctgaaggccaggcagtgtgccggcaaagactctcaggcagaggaactcagaagtgccagacttggatctggtagcttcatgtggggctggcccactgaggccctctcctggagccttgaactgtacgtgcacacgcagtcacacagtcactgcacacagacactgcacacacagtcactgtgcacacactcagtcactgcgcacacactgtgcacacagtcactgcacacagacgctgcacgcagtcactgcagtcactgcacacagtcactatgcacacacagtcactgcacacagacactgcacacacagtcactatccacacacacagtcactgcgcagacactgcacacacactgcacacacacagtcactgcgcacacacagtcactgcacgcagaaactggacacacagtcactatgcacacactgcacacaccactatgcacacacactgtgcacagtcactatgtacacacactggcactgcatgtagtcactatggacacacactgcacagtcactgtgcacacatacactgcacacactgtcactatgcaaacacagtcactgcacacagtcactatgcacacacactgcacacacagtcactgcacacagagccactatgcatgcacacacagtctgcattcacacattgaacacacagtcgctatacacacacagtcactgcacacacagtctatgcacccacacactgaacacacagtcactgcatgtacagacactgcacatagtcatgacctcttctctttttctcactcattctccaattctctctctctctcgctcttttttttttttttttttagacagagtctcgctctgtcacccaggctggcgtgcagtggcacaatgtcagctaactgcaacctctgcctccccgtttcaagcaattatgatgcctcagcctcctgagtacctgggattacaagcatgtaccaccacgccaggccacttcttgtatttttagtagagacagggtttcaccatgttggccaggctggtctcgaactcctgacctcaagtgatgcacccgcctcagcctcccaaagtgttgggattacaggtgtgagccactacacctggcctctaatcctcattcactgttcctgtctctgtgtctctcacatacagtcatgcatgcatgcacgcatgcacacacacacacactggccctctctgctacatctacccaccctgtacccccactccagtacatactgcacacatctctctccctcccccacttctcagccccttgcacaccccttgttctgttaaatctcaactgcctctgcccctctcctacccaccaatgaggcccttagagggacgccccaatggcatctttgccctggaatcatcccttccctgctggcaatacacatgcattcacccaccaaacatttaatgagcccctatttggtgccacagatggaattatgggcagaagcagacaccattactgtcccctcttaccacatacagtcaggtgggggaggcaggcatcggtcaaataaccccttgactccacttaaaattatacctgcactgcgagctgaaggatgagcagcattaacaaggcagagagagatgcacagagcattccaggcccaggacagcacatgcaaaggccctgtggtgggacggaacctgtgaggggtcaggatctgcaagcgagggaatgtggctgatgcaaagacagccgagaaaggctggcctggagacagccgaagaaggcagaaggggacaggacccggggctggggagggcggggctatattgtggaatatgggctttctcctaagcaccaggaagggcctgggaggataggaagcaggggaggcgcgactggtcatgtgactagacaagctcgctctggttgcagggcagggaacagcttgacaggaggctgggctggaggtgggcaccaggaatcgcagcaagagatgacagtggaggagagagaacagtgggagggttgtcctctgcaggacccagggaaagatcaggtctgaactgagatgaggtgcctgggagcagtcgggtctggcttaaaactgggagataggctgagcacggtgactcaagcctctaatcccagcactttgggaggctgaggcaggaagatcacctgaggtcaggagttcgagaccagcctgaccaacatggtgaaaccccatctctcctaaaaaatacaaaaattagccaggcgtggtggcaggtgcctgtaatcccagatcctcaggaggccgagacaggagaatcacttaaacctgggaggtggaggttgcagtgagccgaggtcgtgccattgcactccagcctgggcaacagagtgagactctcttaaaaaaaaaaaaaaatactgggtgatagaggtgagcgagtgcaaggaaaggaccaggttgggggaagagaataggtgtgggcatagcaagtttgaggtgcctttaggacatcccgaaataagtcagataggcaggtgttgtgggggctgcagcttggagctgaggtctacaagtagtaggacttttctggagcccttaggtgggtggtctccatatccttctgagcacttgaggaacatctgagcacagcactggaaaagaaaagaccacaaggacgctgtcctcatgtcttccaggggctgtgtcccacccccttcacattctagccaggaagttcaggggaggtgttgaagagaggaagctgcacctcccaagccatggattgaaatgtggaaggcaggaagagggaacttgtcagaagttctgggggcagtggaaagaattggtactgatgcaggaagagatggagggtggatgagggcagactagtacccttcccccactgccccaaacccttcccgtctccacccctacctgcctcatgtgtctcctcccccacttggctccaagaagggaagcatgttttctgcacgcatctccctgccagatccctggcttttttgcatggttgcaagcttcccctgctctcctccaaacccccctcctgaggctgcttccagggtccgcctgccttcgcatgcctggccgagtccacatgttatgatccgccccatgaaagggatggcttgtactctggggttgaacgggagggggctggggatacctgagccatcggccccatccccaggtggagctgggtggccaggcagggatgggggtcagggcagcagggcacagagagtgactctgttagccaagctgggtttggggcttgttcgaggcactggagacattctcacagcacttgagcccagtgtggtcagggtaggatcccccagcccccttccccatcctagaggcctaaggacgcactgatgtgtcccagagagcatcctagacattgccatcaaacccagaggcctcagaaattccttgaactccagtccttgcctctcagctcccaggccaaagccagcacaagacacagatctggcagccagaaagccctctggaagccaccaagtaggatgcccatgtcacccaaactaggacacttttgaaacaggagggaggctgtgactgtatggtcaccctgtgccatttggggggtgaaggttagaccaagttaaatcttgctacgtggcctgtagcaaatcctacaaatcccatagaacaagtctgattaagccccttcccttagtgtggagagaccctctactcctcctgccttcaccctgctgggtactggccagcgaaggagggtttccatgtctgcctgaggctggggtctcaaactcaaatgcctctgggggccaggcagacaccagtcaaccaggaaagcaagtgccatttctaaaacgtgaggaccctggaaaactggagatcatgtggcctgcttccagggagcaatcgcagcaggcctggggttgccagaaagccagattggtgggcaaaatctcttgatttttaaacaatggcaataatttttaattaaaaacaaggacaaatgaaaaaacactgctcgggcccaacaaaacagttttattagctagatttggcccactcgtgacttcgagagtcccaccccccccaccaaggtcccttgaagccccacaatggccacttaactctagctggtctcctccctgactctccaactctctggccccctggttcttctagcttgggtgggaggaggcagaggcagtgactagacagggggtttttgagcagaggcagtggccacccagggaggtcctgggggcagggatggccccacctcccggcccccagcacccgccccttggtgggcccgggctgatttctgagctcacccacccatgggagctgagtgcttcctgcttcctgcaggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaagggggtaagaaaagatgctcttccgcttctcccaattggctcgagccgctgctcctcttggccgtggggtgaggtcagggcgggcaggagcgggtgggcagctcggcagggcagggcagggcagggtgcccggtgagtcccgtgacagatgcatttctggcccggagcgtaacatgccctcggaacccgcacatgtccaccaggcctgactgtgctggcgacctccacccccacccccgccctggtgtttgtgcatcgtacacgtatgatagattccgcaacttgaccggcttgtgtcctttcgtctcagtgcatttggttgttgggagaaacaaaaaccatctcgatttttttcctgattggatgattcggatatattttctttttcttgttcttttgttatttcttccccatccccgttcctttttcctcctttctttttcttttcttttccccattgtgggtggggctggcagggagggcttatgcttttgagttgatgccttttcctccctcccaccctctctctcccaacattattcctttttcgagtttttcctctgcatcattgcattaatagtgctttctctctccctccttatttggggtctggcttgcttttttcctgttggttggcttcatgtaggggcctctgtgagtggtgacagctctgagccttttggggtgggtggatggtcacccctcttcctccatctccccagaataacttcatcaacctgagctttctccgcctcttccgagctgcccggctcatcaaacttctccgtcagggttacaccatccgcattcttctctggacctttgtgcagtccttcaaggtgagtcctcgtccctgctgctggcccagggctgagaagacaggtgaccctcatgctctggctgaatgtagaagtcagattggaagtgcctctgtgatgtagtcgtgcagagaatctgttatctccaaggctgttgtcaaacttcctgtccctggtgtgtcttcagagctgtaagggcctcatcctagagcccccagagatgcccaccagccctggaaggactctggcacgtggcatatggccacccaacccagtggggcagagcactgggacaagggaggaagacagtgcggctgagggacccccagcactcttcttcattgccttttttcccaccaggccctgccttatgtctgtctgctgatcgccatgctcttcttcatctatgccatcattgggatgcaggtgagtgtcgtgtccctaaggttcccagagcctcccaaggagggcagccacccttagaaaggggtgggtcagaggagcctggttcacagaagcagccatggaggttgagctgggtttcccagaagccactggaggaatggcagcccctggtcgtcaccctccaattccacaggtgtttggtaacattggcatcgacgtggaggacgaggacagtgatgaagatgagttccaaatcactgagcacaataacttccggaccttcttccaggccctcatgcttctcttccggtgagaaggggacctgctctgataattctgtttccgtggggtggggtgcctgccttcatccttctgttcccatagaggatgtaccctcctcttccaatgcaagacgtgccctcctccttctcttctggcaggggcgcgccctcacccttcttttccggtagggggcgtgcccttctcttccggtaggggacgtgccggccttctcttccgatagggggcgtgccctcctcctccttttctggtgtgggggtggccagatgtgctcttatccttcttttcccgtgaggctggaaatgggtgtcgtggggggcccaggaatcctagcagggcagaagcagagggccctgggacatagtcatcaaggtcattttccaggcattatctctgaatcttcctgaccaccctgtgaggaagggattcttggcagccctatccgacaaataagaaaacaggcttacagaccgtgaggcttgattctttggttcatcatcttggctgcacacaaaagttccttcactcgttcagtgtaggttttttgggggggctttttttttttttttttttttttttggagatggagtctcgctctgttccccaggctggagtacagtggcgcgatctcggctcactgcaagctccgcctcccgggttcacgccattctcctgcctcagcctcccgagtagctgggactacaggcgcccgccaccacgcccagataatttttttgtatttttagtagagtcggggtttcaccatgttagccaggatggtctcgatctcctgacctcgtgatccgcccgcctcggcctcccaaagtgctgggattacaggcgtgagccaccgtgcccagcccttttttttttttttttttagatggagtctctctctgttgcccaggctggagtgcagtggcgccatctcggctcactgcaagctcctcttgtggaggtgtattgagcacctacagcatgccaggcagggctgaaaaacgaggatgcaccaggaaatagagaaaagagacattttaagcactttggaagctaacatccccatggggaagacgaataatcaggaaacaaattatagaggatgctggaaaaagataaaattcaagaataaaggggaatagggccaggtgcagtgactcgtgcctgtaatcctagcattttgggaggccgaggtgggaggatcgctttagcccaggagtttgagaccagcctgggcaacatagtgagaccccgtctctacaaaaaaattgtttttaattaactgggcatagtgccacacacctgtagtcccagctacttgggaggctgaggcaggaggattgctcgagcccaggagttccaggctacagtaagctatgattgtgccactgcactccagcctcggcaacagagcgagactctgtctctaaaaagaaaaatatatttttttaatttttaaaaaaagttacagaggtagatagtggtgatagttgcataataatgtgagcttacttaatgctactgaattgtacacttcaaaatggttaaattgataaacttcatgctgtgtgtattttgccacagtaaaaaataataatgtttttaatctaacaacaaaaaaagaatagagggccggcaggttatgcctctctgaaagtgtgacatttgagagaaattggcaagggagggagtcagtgggtatatggggaagggcaggccaagccgaggggactgcctgtgtaaaggccctgaggcaggagtatggctggcatgtttgaggactgtgaggagcccagcatacctagaacagagtgatctagggagaatatagtatgagatgactgtcaccttcatggaggggagcttttttttttttttaatctgagacagagtttcggtcttgttgcccaggctggagtgcagtggtgcgatctcggctcggcgcaacttctgcctcccaggttcaagcagttctcctgcctcagcctcccgagtagctgagattataggtgcccgtcaccacgcccagctaatttttgtatttttagtagagacggggttttgccatgttggtcaggccgttctcaaactcctgacctcaggtgatccacccgcctcagccacccaaagtgctgggattacaggcatgagccactgcacccggcctgaagggagcttttttttttttttgcttttttttgagacagaatctccctctttgtcacccaggctggagtgcagtggcgcgatctcagctcactgcaacctccgcctcctgggttcaagcgattttcctgcctcagcctcccaagtagctgagactacaggtgagcgccaccacaccgagcaaatttttggtatttttagtagagatagggtttcaccatgttagccaggatggtctcaatctcctgacctcgtgatccacccacctcagcctcccaaagtgctgggattacaggtgtgagccaccgcgcccagccaagaggggagcttttaaagcataacagtgaccagcctgagcaatgcagtgaaaccccatctctacaaaaaaaaatagtttaaaaattagccaggagtggtggcgtgtgcctgtagtccccagctactcaggaggccgaggcgggaggatcacctgagcctgggaagttgaggctgcagtgagcagtgattgtgccactacactccaacctgggtaacagagcaagaccctgtcaaaaaaaaaaaagagagagagagagaaaagaaaggaaaagaaagagagagagaaggaaaagaaaagaaaaaaacatatcagtgtcctcaaatcccaccctagaccaactgaatccaagtctgctggggtggggcacgggcattggtattttttcaaagctctctgtggacttcagtgcacagccaagaatgtgaattcccttctctcagctcccagtaaaaggaggtggtccacctggggcttgcctggccagctccagagcccaagtgctcaacgtgtgtgctccacctcctggggaggcgttggtacccagtcagggctgggtgtccgagtctctgatttctccctgtcctcaggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctggtgagtctgtggacactgtgagggccgtctgggctccctaagcctggcttcctttcaggggagtgggtttctgtggaatgtggctgtgtcgaaggcttgttccctccaaggcttctctgaaccagcctgggatcaggtgaccctgagcgtctcaaactcagcactgttgacatttgggggtggctgattctttggggtggggccatcatgtgcactgcagtgtatggcagcatccctgtcctccccccaccagatgctggcagcacacgccacccgttcctcctgttgtgacaaccaaaaatgtctccggacattgccaggtgcccccagggggtgggggtggggttgggagtgggggccagaattcccccatttgagactcaatgaaatatttcagctgggcgtagtggccgatgcctgtaatcccaacacttcgggaggctgaggtgggagggtcacttgagcccaggaatacaagaccagcctggacagcatggtgtgaaacccatctctttaaaaaaaaaaaaaaaaaattgaattagctgcacacgtggtgctgtgcacctgcagtcccagctactcaggaggctgaggtgggaggatcacttgagccttggaggtcgaggctgcagtgagccatgatcacaccactgcaccccagccagggcgacagaatgagatcctgtctcaaaaacaaacaaaaacaaaaacaaaaaaaaaaaacattgcgagggaagaaatacctcactttggccttgttgggggcagatgtgggaggatttggggtcacagtggttctcttggtgttggtccctgtttcagaagcctcccctccctctcactgactctgtttctttccatcattcttggtctttgtctctctctctcttttttttttttctttgaaatggagtctcactctgttgcccaggctaaagtgcagtggcgagacctcagctcactgcagcctccacctcccaggttcaaccgattcttcagcttcaacctcccaagtagctgggattacaggtgcacatgccaccacacccagctaatttttgtatttttagtagagacagtgtttcaccatgttgaccaggctggtctcaaactcctgacctcaagtgatctgtccacctcggcctcccaaagtgctgggattacaggcgtgatccaccgtgcccggccagtctttgtctctttgtatctctctctctccatctctctctgtttctctcttcctcttccccatctctccacttgatctctctctcactggacctccttgtgtgagtgagcatcacctctccattccccagtctctttctgtctctgtctcatttcctttccccatcttctctctatccctctctccatctgggcctctgtgtacatgtctttgggtctgtctgtccgtctgtctgtctgtatccttctcactcactcattcattccctcggtctctgcccccattctctcttggtccccggggtccccacagatgctgaatctctttgtcgccgtcatcatggacaactttgagtacctcacccgagactcctccatcctgggcccccaccacctggatgagtacgtgcgtgtctgggccgagtatgaccccgcagcttggtaagaagtcaccccgaatcctccagccacaatactcacctctccctggaactggaacacgggctaggtcaggccccagactctggagcactgaactcctggggtcctagcaggggtctcacaggttcagtcaggagagaagatataagaatcatcacccttgcataccccagattaaacacgtagggtgccaaccctgcccaaaccctggactttctgggaaatgagggagggcgtcaaccatgagatgtcctgaagagccctctcctcctacgagtctctcctgtctctcactgtgaagtctccagatggtgaggatgcattagccaggctccagggagaaaaccaacagcatcccagcctcagttctcttgagagtgtggggaggagggctggcctacccttggcagacaggattggcagcaacatcagagtagcagaactcagctcccactgggacccgtgaacctgggagtgagaggacatacaggccaggggaggacgcagagcctcaggggcccatgcatctttgtggccacaaagggagtgggcgctcccatctgggtagacaccagaggggtccctctccactgacgggcaatggtttcagagggtgggttccaccttgtgcacgtgtattgagtgcccacccaacaccaagccttgaaggacactcagaggctttatctgaatacctggaacccaccagccactaactgaggatttagttcaggctggtcttggggcctgaagaagcattactggggggccctcagcagcctaagccccatcttcctctggcctcagcaccagagaggaggccgtcacgaggaaggtgggcaggaggtggtcttggctattcccatagcctcaaacaagtactccatgagaccgagaggctggggagagccgtgggtctggggctgggctttggctggttcctaactcttcctcttttgattttaggtcacagcaattggatgctgtccccaaggcctctattccacaagcccccccccacccctgtagcccatgtagactgtggaggaggcagatgcagagagagccccaggggaggtgccctgcagtcccgaactcgactgacatcctacacccctgggtctccccagtgtctgggaatgtactggggaccttcacttgtccccagtctctcccactccttcaagccagggacaccccagcctcgggcatcatgacctcgctgtgtgcccagggagcccgtgtgaacccattgcctgcactaaccccctttcttctcctttcagcggtcggattcattataaggatatgtacagtttattacgagtaatatctccccctctcggcttaggcaagaaatgtcctcatagggttgcttgcaaggtttgacttccactaaaacctgctagcatccatggaatgagtgtggcttggggttcttcaatatatatatttcatatatatatatatatatctctctctctctaaaaaaacagagccatctctctttcttgcattaaactagaaaactctcttagccaacagaatgcagtcatgtagactcgataaagcatggaacatatttcctccttcccttcagccttcagccatctttgcttgctcttagctgaagctgcccatcctggggtctccacggcaccccaaatcagatacatcccctgggggattgtaactttgcatttctcccccaaccatcacctccactctctccccctccacccctcacctcccaaagcccctagccctcctcccctccctggcactggcccctgctccccacctaggccccctcagagaccagcctcagccaaaccagagaacgtgacccaactgtagaaataacagtgatggccgggcgcagtggctcatgcctgtaatcccagcactttgggaggccaaagcaggaggatcgcttgagcccaggagtttgagaccagcctgggcaacatagcaagaacccccttctctataaaaaattagccaggcattgtggcgcatgcctgtagtcccagctacttgggaggctgaggcagaaggattgcttgagcccaggaggtggaggctgcagtgagctatgatcacaccactgcactccaacccaggcgacagagagagaccctgtctctttaaaaaaaaaaaaaaaaaaaaaaaaaaggcaatgaacaaaagcatggctctacgtcttccaaagtgagaattctccctcccctccgcatccctccagaactgtagctcagagcccacgctgaatctgacttttctcttttctctctctctccctgctcccgagcagtgaagtaatctttttttactgaccttttcttccattttttttcctcctcttttccattgatttgaaatatctattttatcattctctgcatctttctctctctattttttcggctcgtgtggatttcttttttctttcttctgtttctccccacctctcttcctttggttctctgttcccattcccgttttgtttttttgtttttgtttttgtttttttcattttcggtgctgccaggggccgcatgccttacctggacatgtatcagatgctgagacacatgtctccgcccctgggtctggggaagaagtgtccggccagagtggcttacaaggtagactacccttgccgaccaccgacgtccaggcactgggtttttttttcttcttcttctttttttttagtgctgaccagaaacacccggccgactctctttttccaacgtttctcttcttttttgtttttgattcttttttttcttttctcgagtcaactgatcatgaccatcccttgattctaagcagcacactgtgtccgtcctttctgatgagtgtcttcgtgttttgagactccattatggccgacatgccggggggagggggaggggagcgcccaggtccccttgcacctggtctcccaggtaccaaattggaaacaaacacgcttcttcagggagtcaaaacccatgcttcccacttctgcccacccagagcggcccccatgcccaggctggggcaggcgccttgcagagaggggctttagcccccgaaagcaggcgaggtcccgggtccccgcccctgccacgcacacctgaagctgatctctgacctagggccttggggattcgagaccttccaaggagcaccaagaacctctcttcccctcccttccttcccctggagtttcgtccccagcccccgtccctaatccccccaagacaccccaacatgcctctccattgttccagagtgggcaggcggccgcagctggacccctggacggtggcacactgatgcaggccatgcacgctgccttggcggggcctggggcgggcaggcaccatggccgacggggggtggtgcatgctggctgagagagcgagcgtcctgccgccaagcggctggcccgggccacccctccagatccctgtcctggaatctcccttggtgcccaaggacagatgctctgttccctccattcatccacaagaagttcagggatgacctttaaagattctccccacccaaaaagtattaccccatcatcctattctcccatccaccttgatcttccctgcgtccctatccatcaatgctatttgtacctgccccgtgttgccacctcattcctttccttcctctgtgcacccctcctcacctaacctatatgtctcccctccttctcaatcaaagccggggacaaggttgtcccaccagcatctcagacaatgagcctctcctggcacctgtcgctctgtgcccctccctgccgcccccccccccccccggttttcctcaagtcgcttctctcagtctctgcttagatgaatgtgtgcgcatgtgcaagagagggagggcgagcccttcctctcctggtctttgtgcaggaccaccatgggtccataagacaactttgtgcaaatttgaaaaaggcaccctttccacagaacatgcctgttggaaaattgttgcaatctaccaatgtggtgagaacaagacactttttttctatcacctgggaagctgttatatttaatatacaaatcgggggctgggcgtggtggctcatgcctgtaatcctagtgctttgggaggctgagacgggaggatcacttgagcccagttcgagactagcctgggcaacatagcgagaccccatctctacaaaaagaaaaaatattttaattaataaataagtacataaatctatcatttccaagatgggagccctttgtgcggtgtacaacctgcacaactgtgcacagtggcccagtctatgtgtgtttctctatttcccacctccttccccaccctacccccagtgtcccctccagtgtcctgctctggatttaccatacccctccccatcttcaactctgtgtttcctgcccacttgtgtctgaatccccacccaagttgccctcaccccccttctctgtgccacttcagcctgggctggtgcacaccagcccagcatcctctcccatgccaccaagcatggtggacagagcccctgcctgggacatggggaatcttttcttccctgggctggaagggagtgcccctcaccccttccccctgccattgcacagagagccaagatctggacatgcccctgagatacacttcccacggagctatgaatgagtctcgagattccgtctgcatgcgcccctgtctgtgctgttctgtgtcacagcctcgctgcatgcctgcgaggggcctgccccgtcagtggggggctgcctgcctgctgcttctcagaggaatgatgtggtctgtgcccatctgctctgtcctggtctgggccaagccagggattgggtgtggggagccagtggcaccccccaccagcggctgtggtcctggccccctcagccttggctgttgcatgcactgctcaaatccagcttgtgctctttttctttggggtcagactgaaacggggccatccagaagaactctggggcagggcgggggtggggcaagggttgaggcaaaccctggaaatgccagctctcaggtcaagcaggtgggggaaaaaaggagagggcaggggaccagaagtacaagagagccttttgtgccctccctgcgggccaccaagagaaactgagtactgggacaggtaacctaagtaagagacacctcagccgccacagctttcagagttcttcctgggactccctgggtaggggcgggcgcggctcacgggagacccaggagggatgcctgggaatgactgcgcttgccttgggttttctgtagcggcttctgcggatggacctgcccgtcgcagatgacaacaccgtccacttcaattccaccctcatggctctgatccgcacagccctggacatcaagattgccaagggtaaggaagggacaggggcgggcacagacaggcgtgacagggtggaactggggatctccctccctaccccaaactagaggatctgctgtcaccacccggatcttcattcactcttccattcattcgttccacagggttttttggggtttggggttttggtgttttttttttttttttgagacagagtcttgctctgttgcccaggcagcagtgcggtgacatgatcgcaagtcactgcagccttgacctcccaggctcaagtgatccttccacctcagcctccccagtagctgggactacaggcacacaccaccatactcggctaattttttttttttttggtgtgacaatttccctctgtcacccaggctgaagtgcagtggtgtgatcttggctcattgctacctccgcctcccgggttcaagcgattctcctgcctcagcctcccaagtagctgggattataggtacccaccagcacacccggctaattttttatattttgggtagagatggggtttcaccatgttggccaggctggtctcgaactcctgacctctggtctcaaactcctgacctcaagtgatccacctgcctcgacctctcaaagtgctggattacaggcgtgagccaccatgcccaacctaattttttatattttttatagagatggggtttcatcaggttgcccaggctggtctcaaactcctgggctcaagcagtcctcccaccttggtctcccaaaatgctggtattacaggcatgagccaccacacccggcccatttggcagatatttagtgcactccttcaatgtgccagagacccgtccaagcaggggaggacccagcagcttacactttagatggatggggaggccgccactgaggaggtaaggcagtgtctcatggatccctggggggaaggtgctccaggcagaaggactggcaaaggccctgacagaggggtgaacacaggacacccggggcattgagctgactcaccttctgagtgagggcacgccacgcaggttcagagcagaggaggaacctgacccaactcacatttgaacaggttccctccggccactgaggggatgggagaccgaaaggaggccagtgtgggggctgctgatatcatctgggtggagacagggcggcagcttagatctaggggtaggctcgacgtggtggctcacgcctgtaatctcagcactttgggaggccaaggtgggtggattacttgaggtcaggatgaccagcctggccaatgtggtgaaacccccgtctctactaaaaatacaaaatttagccagacgtggtggtgggtactgtagtcccagctactagggaggatgaggcagaagaatcgcttgaacctgggaggcggaggttgcagtgagccgagatcacgccactgcactacagcctgggtgacagagcaagactctgtctcaaaaattaaattaaattaaattaactggacatggtggcatatgcctgtggtcccagctactcaggaggcagagatgagagtattgcttgaagccaggagtttgaggctgcagtgagtcatgatcgcaccactgcactccagcctgggcgacagaacgagatcctagctcaaaacaacagaaagaaaaagaaaaaaacattttttttaaacctgagaaggggctgggcgcagtggcttacgcctgtaatcccagcactttgggaggccaaggtgggtggatcacgaggtcaggagttcaagaccagcctggccaacatggtgaaaccccatctctaccaaaaatacaaaaagtagccgggtgtcatggtgggcgcctgtaaccccagctactccggaggctgaggcaggagaatcacttgaacctgggagacagaggttgcagtgagccaagatcgcgccactgaactccagcctggatgacagagcaagacgctgtctcaaaaaaaaaaaaagctgaggccgggcacgctggctcacgcctgtaatagcagcactttgggaggccgaggcgggcagatcatgaggtcaagaaatcgagaccatcctgggtaacacggtgaaacctcttctctactaaaaatacaaaaaattagctgggtgtggtggcacgcacctgtagtccctgctactcagaaggctgaggcaggagaattgcttgaacccgagaggcagaggttgcagcgagccgagcttgtgccactgcactccagcctgggtgacagagtgagacttcatctgaaaaaaaaaaaaaaaaaagccgagaaggctggacatggtggctcacacctgtaatctcagcattttgttgaggccaggcacagtggttcacgcctgtaatctgagcacgctgggaggccgaggtgggtggatcatttgaggtcaggagttcgagatcagcctggccaacgtggcaaaaccctgtctctactaaaaatacaaaaattagccgggtgtcgtggcgtgtgcctgtaatcccagcactttgggaggctgaagcgggtggatcacttgaggtcaggagttcaagaccagcctggtcaacatggcaaaaccctgtctctactaaaaatacaaaaattagccaggtgtggtggcgggtacctgtaatcccagttactagggaggctgaggcagaagaatcacttgaacccgggaggcagagattgcagtgagccgagatcacatcactgcactttagcctgggcgacagagcaagactccatctcaaaaataaaaataaaaataaaaaataccgagaaattcccccaaagacctagctcagggctcactctccatcattagggggaaagaagaagaggaggccagggaggcgggcagagaccagggcagtgtgggctcctggaggcagcttctatgtttaaaagggcggcttcaggaggaaggggaccaaccgtgtcaggcactgcccagagaccaaggatgacaaggatcacaagtgactggtcatcatggtcactttgaccagtgcagctttggcggaggggtcaggggtcccctgtctggagtgcatttcggaggcccgaaaggggatgtgatgtgatttggcagctgattaaggacagcagggcagagagacaggcgcacaattgccagaagaaacggggacctgaggctcacgcctgtaatcccagcactttgggaggctgaggaaggtggatcacttgaggccaggaatttgagaccagcctggcccaacatggcgaaaccccatctccactaaaaatacaaaaattagccaggcatggtggtgcacacctataatcccaacaacttgggaagctgagcacaagaattacttgaacctgggaggcagaggttgcagtgagccgagatcaaaccattgcactccagcctgggggacacagcaagactctgtctcaaaaaaaaaaaaaaaaagaaagaaaaagaaagaaagaaagaaagagagagagagagagagagagagagagagagagagagagaaagaaagaaagaaagagaaagaaagaaagaaagaaagaaagaaagaaagaaagaaagaaagaaagaaagaaagaaagaaagaaagaaagaaagaaagaaaagaaaagaaaaaacaaatgggaccagagaaaaggagtgggtgggagaggagcaggtggatagtcccacacatgggaaggtgctgagcccagctgaaaccactagtaagtcaggaggagggaagactgagcctcgagacatatgtgccttccagggtcttgagggaaagaagggaggaagagccaaggccacgtggcaagactcaaggaggaagtggcagggaaggtgggggactggaggggtggaggacagatattgttaatgccaggaacaaagtgaaggtaaagagagcacaaggaagttgggagcagtggctcacacctgtaatcccagcactttgggaagccaaggcaggaggatcacttgaggccaggagttcaagatcagcctggccaacacagagagaccccatctctacagaaaattttaaaattagccaggtgtggtgatgtgcacctgtagtcccaactacttgggaggctggagtgggaggatcactggagactgggatgtcaaggctgcagtgagctatatgatgaccacagacatagcagcttaagacacacctatttgtcagctcacagtcctgtaggtcagaagtccaaaaagctggactgggctgtctgctgagggtctcacgaggctgaaatcaaggtgtcagccaagctgggctcctctctggaggatctgggggagaatctacttccaggttcattcaggtgttggcagaattgaagtccttgtggctgtaggactgaggtcttgttttatcactggctttttagctttttgctcctggaagtgcatgtaatcctccatgtgctctcattctctctgacttccccatctgccacccagcagagacaatactgtgcttttcaagggctcacctgattggggcaggcctaccctgatcatctctgtattttgaggtcagctgacttgatatttttttttttcttgagacagaatttcactcttgttgccaaggctggagtataatagtgtgatctcagttcactgcaatctccgcctcccaggttcaagcaattctcctgcctcagcctcctgagtagctgagattacaggtgcccaccaccacgcccagctaaatttttttgtatttttagtagagatggggtttcacaaggttggccaggctggttttgaactcctgacctcaggtgatccacccgcctcagcctcccaaagtgctgggattacaggagtgagccaccatgcccagcattttctttctttcttttttttttttttgaaacggagtcttgttctgtcacccaggctggagtgcagtggcgcaatctcggctcactgcaacctccatctcccgggttcaagtgattctgcctcagcctcccaagtaggtgggactacagatgcgtgccaccacgcccggataattttttgtatttttagtagaaacggggtttcaccatgatagcaggatggtctcgatctcccaacctcgtgatctgcccacctcggcctcccaaagtgctgggattacaggcgtgagccaccgcaccgggcctccggtattttaattatatctgcaaagtcccttcatagcctgggcaatggtccctagattagtgtttgaataaacagaatcttggcagaagggcagcttttgaattctgcctaccacagttccttcgtttgtacaacgggtctaacaacacccccactctttgtatgtaatgccatcgtaactcagcttctgtggcactctgagaatctgtgttcaggggtcccaaaaccacccacaggttcagtgattccctggaagaactcagaactgagaaaagtttttatactcacagtttattacagtgaaagaatatagattaaaatctgcaaagggccgggcacggtggctcacgcctgtaatcccagcactttgggagggcgaggtaggcagatcacttgaggtcacgagttcacgaccagcctgaccaacatggtgaaaccctgtctctactaaaaatacaaaaattagccaggcgtggtggctggcgccagtaatcccagctacttggaaggctaaggtaggagaatcacttgagcccaggaggcagaggttgcagtgagccgagatcccgccacttcactccaggctggacagagtgagactctattagaaaaaaaaaaaaaaaaaaaatctgcaaagggcctggcatggtggctcacgcctgtaatcctggcactttgggagggcaaggcgggcagatcacttgaggtcacaagtttgagaccagcctggccaacatggcgaaaccccgtctctaccaaaaatacaaaaattaggcatggtgccagacccctgtaatcccaactactcaggaggctgaggcaggagaatcgcttgaccctgggaggcagaggttgcagtgagctgagactgtgccattgcactccagcctgtgtgacaagatcaaaactctgtccaaaaagaaaattagccaggtgtggtggcatacacctgtagtcccagctactccagaggctgaggcacaagaatcctttcaacccaggagatggagctacattaagccaagatcacgccactgcactccagcctgggcaacagagcaagactctgtctcaaacaaacaaacaaattccaaaaacataaaatgcgcaaaggaagggcatctggggaagggtccaggagacaccaggtgcgagcttccagttgtctgcctccagtggagttgcacagacaacgcttaattctccctgcagtgtgtgacaacacgcaccgtgtactgccaaccagggaagctcacctgagccttggtgccccagggtttttattgagggtttgtcatataggcagggctgacgtagttactcagtctccagtccctccagaggtcaaactgataccacgtggcccaagaccccaacgataaatcgcattgttagaatgaactgtatggaaaattatccaggcgtggcggcgggcggctgtaatcccagctactggggaagctgaggcaggagaatcacttgaaactaggaggccgaggttgcagtgagccaagatcgcaccattgcactccagcctgggcaatagagcaaaaacaccatctcaaaataaataaataaatagaatgaactgtattggccgggtacagtgactcatgcctataatcccagcactttgggaggctgaggctggaggatcgtttgaggccaggagttcgagaccagcctaggcaacatagtgagaccctatctcttttttttaaaaaaaaaaaaaaaaaaaaaagaatgaactatacagtgtggcccaaggccccctgctaaataaagacactcttcaggcaggacatttcaaaggcttagagatcacctcccaggagcaagtcaatgggccagtcctttcatcggaatgtgcagggtttggacaacactagcctactgagctagtccttactgcttagcaccccagcttctatgacacctactggattcccttcctgagggtttcaaagactcctggagatgtctctgaatttggctgtcacagttgttacttgtaccccagatgccactcagttccctgaagacaatgatcccccagatttctcagccaggagcccctccacctcttgtcctcagtgggtgccaggcctcatcctggagttccacagctgagccaggctctcggggttaaggaaggtcaagagggtgtggggacaacaatggaagagtgataacagtggcagccctttgagcagatgcgggtctcaggagaacataacgcgctttcttttcatagttcagctcactttctaagcacactgagcttcctttccagcaggctaaggggctgcaaagggggtacagattaacctcattcttcagattctcaaaaatggtgtcaccattcattgctggagactgggagaaagggggcaagtccatctcattctctctgtctctgtctctctctctcttccctgtccatctgtttctctctcccacccacccctctgttctctctgcccagaagaatctctattttggttttggttttgtttgttttgtattgttttgagacggagtctcgttctgtcgcccaggctggagtgcagtggcgcagtctcaactcaccactgcagcctccacctcccaggttcaagcgattctcatgcctcagcctcccgagtagttgggattacaggcgcacgccaccacgcccagctaatttttgcatttttactagagactggtttcaccatgttgaccaggctggaccctatcctctttcaagccccccaccccaggcattgagggcagagccaactacctgcctgaaccaattagcatattaaacgtaaacccagttagcatatccaaatagcagcccacagtgacattctgactgtcagaatgtggattgcttgagcccaggagctcaaggcttcggtgaacaaagattgtgccacagcctgggcaacagagtaagtccctgtcgatcgatagatagatgatagatagatagatagatagataaatttttaaaaaaaataataggccaggcacagtggctcatgcctgtaatcccagcactttgggaggccgaggcaggcagatcacctgaggtcaggagttcgagaccagcctggccaacatggtgaaaccctgtctctacaaaaatataaaaatagccaggcagatgtctgtaatcccagctactcaggaggctgaggtaggagaaatcgcttgaactctgaaggtggaggttgcagtgagccgagatcatgccattgcactccagcctgagtgacagagcgagactccatctcaaaaataataacaataataaaaataataataaatgctctggccccaaagtggcacattacatggtgcacaccccattagcaaggactcatcacatggccctgccaaccacaggaggaacccccccatgtactcaggtaggagggccaggaaacaccgtcagagagctttaatgactcaccccatgactggggtgagggacgagggactggctgcaggtcaagggcatgtccgtggcagtggagacttgggaaaggggaaaagacctcctctgagccacgcacagtggctttcatctgtaattccagcactttgggaggctgaggtgggaggatcttgagcccaggaggtcgagactgcagtgagctatgtttgtgccacggcactctagcctgggcgacagagcaaaaccctgtctcaaaaatcaaaataaaaccaaaaccaaaacttcctctgttggggatgctccagggcgtcccagccttgaacagatgggtcactgcagtaataatcctatggcagacactgtcccaaggctgcacgcacgttactttgatcatcaaacaaccaggtgatagccaggcatggtggtgcgtgcctgtagtcccagctactcaggaagctgaagcgagagaatctcttgaacctgggaggcggaggtaacagtgagtcgagatcacatgactgcacttcagcctgggaacagagagagactctgtcaaaaaaaaaaaaaaacaggccagacgcggtggctcacgcatgtaatccccagcactttgggaggctgaggagggtggatcacctgaggtcaggagtttgagaccagcctggccaacatggtgaaaccccgtctctactaaaaatacaaaattagttgggcgtggtggtgcacacctgtaatcccagctactcgggaggctgaggcaggagaatcgcttgaacccaggaggcagaggttgcagtgagctgagattgcaccattgcactccagcctgggcaacaagagtgaaactccgtctcaaaaaaaaaaaaaaaaaaaacaaccagccaggcgcggtggcttacgcctgtaatcccagcactttgggaggccgaggcgtgtggatcacctgaggttaggagttcgagaccagcttgaccaacatggtgaaactccgtctctactaaaaatacaaaaaattagccaggcatggtggtgcatgtctgtaatcccagctactcgggaagctgagacaggagaattgcttgaacccaggagtcggaggttgcagtgagccaagctcgtgccactgcactccagcctgggcaacagagcaagactctgtctaaaaaaaaaaaaaaaacacacacacacacacaacaaccaggtgaggcaagtactcttgctatcgtctccatttcacagatggagaaactgagttactaagtggtagaataacctaagtcatgcagccgataactgggagacaagattgggacccaggtcgcccagctgttctccatgccgggctgtctcctgcacagctgctccatggtcctggccccaccgaaaaccagagcccacaaggtcattccagcagcactgcccagggcctcctctgggccaggccgttggggaactggagaccccatggggaccagaaagattggggtctcgttctcgggagcctatggctttgcagctgacccagagtccagctgacacccaggcaggcagtcagggtctgtctacacccccattgcaggaggagccgacaaacagcagatggacgctgagctgcggaaggagatgatggcgatttggcccaatctgtcccagaagacgctagacctgctggtcacacctcacaagtgtaagagctgagcccagccctgggatccaatccaccaggacagatggagggggagggaaaggggaggcctggggagagtgttggcctgggctggtatacacagggacccaggacaagggccccaaagaggcctgcccttggtgagctcaccgtgtgtgtgcccccagccacggacctcaccgtggggaagatctacgcagccatgatgatcatggagtactaccggcagagcaaggccaagaagctgcaggccatgcgcgaggagcaggtgcgctgttcgccgctctggggacatctgggctggggacagtggcttgcatgtcaccacgggaaccaactggaatatgagggtggctgagccccagggcaggtccctgaaaagtaggggctgtgcacagcagctcacacctgcaatctcagtgctttgagaggccagggcagagggatcgtttaagaccaggatgagaccaccctgggcaacacagtgagactccatttctacaaaataaaacattagccaggcatggtggtgcacacctgtagtcccagctatttaggaggccaagatgggaggatcacttgaggccaggagtgggagaccagtctgggcaacatagaaagacccatatctctacaaaaaaaaaataaaattagctgcatgtggcgccatgcacctgtggtcccagctacttgggaggctgaggcaggagaatcacttgaacctgggaggtggaggttgcagcaagccaagatcaagccactgcactccagcccgggtgataagagcaggactctatctcaaaaaaaaaaaaaaaaaaaaaaaaaaaaagttcttgccaaggacacatcatgtggattcattcttcattcagctgctccaccaacacttattgagtattactgtgtgcagggcgctgttctcagtcctcggggatgcacccatggggaaaataggccagaatccctgccctcagggagcagacattccaagtggggaaatgccaatggtagcaaatgactgaatcgtgcaacatccagcaaagagaaagaaagtgtcgtgggggaaagtggagaagaatccagaagataggagtatccaggggaggaggggatgcggtgggaaatgggtagttggggagcctccctgagaaagtgacatgtgagcaaaggcttgaaggaaaaggggagagggagtgagctaagcaatacctggaagggtgttccaggcagaggaaacagccagtgcaaaggctctgaggctggaccgtgcctgggttgtttgggtaacagcaaagaggccagtgtggtggaaaagagcagggaggagacaagggcaaggaggtgacagggcagatccttcagggccatgggagctgcaggaaggactctggctttttccccaagcaagtgggagccatggagggttctaagcaaaggagggataggacctgactcaagtgctcatgggcgccctctggtggctcttgtggaacagtggggttgaaggtaggagcgggagacctgggagaaggtgcctgcagtgagagatgaggacgcgggaccaggctggggctatgacttgggtggaggagtgagaagtggtccagttctgcgtggaattggaagggtctagatggatgagacctgagagagtgtgtgtgtgtgtgtgtgtgtatactggggatgtcgcaatgccttctgggtaccaccgtcccaccaccccacccttgtccacacactgctctctgccccattccccaggaccggacacccctcatgttccagcgcatggagcccccgtccccaacgcaggaagggggacctggccagaacgccctcccctccacccagctggacccaggaggagccctgtgagtgtcacccctgccagggaggtggagtgtgggggtgccgtggtccccacgttctggaagctgcccaagcgcccactgctaccccggcctctgtcccccatgcaggatggctcacgaaagcggcctcaaggagagcccgtcctgggtgacccagcgtgcccaggagatgttccagaagacgggcacatggagtccggaacaaggcccccctaccgacatgcccaacagccagcctaactctcaggtgcctctgtcccccaactccccaatggctcccagggcccgggtggttcaggtggaagggatctgggccccccccacacacacacctgcagctccctccctctgcagacaccagggatctggaggtcaggccccagagctcatctggctttgccatctgctccgcagtccgtggagatgcgagagatgggcagagatggctactccgacagcgagcactacctccccatggaaggccagggccgggctgcctccatgccccgcctccctgcagagaaccaggtgagggctttcaccactgccctggggctggacccctcactctgcactgggtagggccaggcccccccacaagcagcccagtgcatcccctcctgccggactcaggcctgggtagggactccttcagtctctgaagcagtctgcaggccccacccaccacctggtcacacctggagcacctgcagaccctcctccctcacagaggacagagaggaaagtgctccccctggggcagagggcagtggccactgcaaaatggtctctggctgccctggttggaggctgcagacaggggaggttgtggaagatttgtgggtgcagcagggttcaacagggccagctgagacctgccacgaagatcacccctacacaaacacacacacacatgctcaacatacatgcacacacatgtgcagctgtgcgcctactcagatgcttgcatacacacacgtgtgtgcacgtgggcatatacacactgcacatgtactcacacatgcacacatgtacgtgcacacgtgtctgcatatgggaacttggcaggtcctaggatacagtagcagagtctggggtgggtctgggggcagctgggctcgtattttctgtctggtctctgtgggagtcattggggggcacaggggtgtgtgcttgatgtgtgtctgtgtgtggccgcttcacccagctgccaggcccacctgcaggtgatcccgttgccttggactcatgggacagagggcccagaggcatagctggctgcccacccggcctgaacagcgggggcccatgcacgcagcccgcctctggaggagaacagggcatggctgtgagagcctggcccgggtgcgtggcatgtgtggctgtggcgagctttccgtgtgccgtgtgtggcgtctgcacggggcaggaggctgtgctgtgcctggctggaccagggtcacctgagggcctggcctctggctgctgggaacgtgggttggggagcacccagcgtgcatgctgctgctccctcaggaccgagctgctgggccccaggagagggttgggacaagcccagctgacggccaccacatggaagctttgagcatcggccggagccaggggttggggtgtgcatcgcatgaggcagagcccagggccaggggctcgaggctgcgccgtcctgtctttcggtcccatgcctctgccatttgtctgtctgcatctcctgtctgtctcctctgtacccatgggaatagaggacgcccagccccgggggcctgggacacccacccgccaggactttaacttttcttttcctccctgccttctccctccgatttctcttgatgccagtgccactcccctccttggcttcttctccatgcaccacctcctcactctccctcttgccttttatatttattttcttctttctgttttttctgtgtgcaccatcccatggggctgtgacagaggagaaggggccggccacgtgggaataacctcagtgtatgtaccgcgcctgcccagcgcccagcagggctccggccccctcttcctccccaccccccctccagggagtcccgtcatctctcaccgtccccggaccccaccctttctttggcaatcgcaccctctcccctccatggagcccaatccttgtgtgtggtgtcctgtgtgtgcccctcacccataagccctggtgggcggggccatccccatcctcacccctacccccttttcttcagggccccccacgccggaggacactggctctccaagagcctggcccactctgcacctctttctggggggctgcttctcctgacaccaccaccaacccctggtcctgcagctcctacctggagcagggccaccagcgctcagctgggctggaccctgggaggcgggcgtctgccccatctccctccttccctcctctgcctgctgcagagaaacctgtgtgtcagggcttgacccagggatgaagcaccagggaaaagagtgggcccccagagcctccagtgcctgggtatcccccacccccacccagagctccctagcttgggcctcaccagaaggactcagacttgtgggggcagcgagcacagccccgttagccgggaggacccaaagctgccatgccgggcacctggtcctgagcccataggtcagccagccacagtcggaggcttctcaccctcccaggagagcaagctggggcagggatgagtgcggcagtccagggctcccaggtttgcaccctggatgtggagagggcttccctctggccagcctgagcctgcccaactgtggctgggcccccaggactggagagtgaggatcagatctttctggtcagaacccaggatgggctcaaaaggagcagtcctgtctctgagggacagaggaatcctcaggctccaccctcagaggcctggccacacccagagccctgattgatcagggggagccaaggccccatggcatcccctggcccctgccccaggatggtcacaccgcagtcaccgaaggccaccaccaggctgccacaatggggcaggaaggaccgggaccacttggtgctagctgctgaccccagcccaccggcctgtcccctcccccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggtgggcagccctgtggtgctcagggacaagcagaacagaggagaggagaggggaggagaaggcagggcggaggagacactaaggaagaagaaagggagaggcctccatggagaggggacagagggggccaggcagcggctgcaggaacctgggtactaccccctccccccaacccactgacctgcctcggttcaggggatctctagggcccccacaccttccaggtggcctcctgtgtgtgcatctgccccacctctccctcacgaccacctgtgtgtctgtctgaccctcacccggcccaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcaggtgggtgcggctgcaagtgaccccaggctgggctcggccgggaggcggggaggagagaaggggataccccatccaacagccactctaggcaaaggtccccggatcccggctgtgaccacctcccatcctgcccccaagccaccggggtgcccggcggccggagcggacacggatccccaccacaccagctgcctatgctgtccccccagcccccttgcccacccgccgccccctccccgccgcccgcagctgcttgctcctcggttgtggatcatatttgagttctgggccgtgccgcccgacctttcactttcctttaacccggcttctgtttttgtttcaattatgatttctgtcctctggacgcctgtgagtaatttttgaaacttctgctatttttaaccccgaaacttacaaaactccatttctcatttctcttttcactttgttgtgttggttttcgactcctcccctccctgtctcactccccctcctcccctccctcctccctgtggctgttgcttttttccattcaatgtcctgtgtcccccctctcctcctcctcctcctcctccccctccccctcctccctctcctcccggcccctctcccttcgctcccctctcttcctcccaatcccgtgtctcctttgattttgttgtatctttttttttgatttcctttgtttcaattttcgtgtagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggatgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaagggcttttggataggagtggtctttgtcccttggctaggtgctgcctgggtgggtctctcttggggaatcatacaaagaggcacttctttgttagctcctagaagcactgtttgaaagcgacaaggaggccgggcatcatgcacgcctgtaatcccagcactttgggaggctaaggcagatggatcacttgaggtcaggagttcgagaccagcccgaccaacatggcaaaacctcatctctactaaaaatacaaaaaaaattagccatgcgtggttgcacaaactgtaatcccagctactccggaggctgaggcatgagaatcacctgagcctgagaggcggaggttagcagtgagccaagatcccaccactgcactccagcctgagtgacggaatgagactcttgtctcaaaataaaaaaaaaaaaggcagggcgcggtggctcacgcctataatcccagcactttaggaggccgaggtgggtggatcacatgaggtcaggagttcacaaccagcctggccaacatagtgaaacgccgtctttactacaaatacaaaaattagccacgcgtggtggtgggtgcctgtaatcccagctactcgggaagctgaggcaggagaattgcttgaacccaggaggcggaggttgcagtgaaccaagatcgtgccactgcactccaacctgggtgacagagcaagactccatcttagataattaataataataatttggtctcgtggacaccaacccccgcccccacgaagtgtttcagccatccccagagtccaatacccctttgagagcttctgttctcacaacagtacctgacccatagcaagctactattgactatcaccattactactgtagcattaaggcaaacattttgaacaggtcttgttccagacaacaggccctgcttgagcttaccttgggtaagaaatctgcagactccagatagcaagacaggtgtaagtccttctaaaataatggtaagccaaatgtggtggcacacacctgtagtcccagctgttcaggaggctgaggcaggaggatcacttgagcccacgaggtcaagaccagctatgatcacacctgtgaataaccattgcattccagcctgggtgacgtagaaagatcccatctctaaaa

SEQ ID NO: 15372 - DNA, 304533 bp, Human; identical to SEQ ID NO: 15371
  misc_feature (1)...(304533): n = A,T,C or G

SEQ ID NO: 15373 - DNA, 11994 bp, Human
tgcagcctgggtgacagtgtaagactccgtctcaaaacaaacaaacaaaaaatcctacaagcagaattacaagatcgaagggtatatgtatattatgaaagcctgatgtatactatcaacttgtattccaaaaaagatatacactcagtagtatatgtgggtgtctagtctttggtttgttttgattttaaaatgctcagatggtataatgagaaatcaactaccttctgattaaatgtgtggttttagtccctttttttgtttgtttttgttttgtcttgtttttgagacagagtctccctctgtcacccaggctggaggagtgcagtggcacaatctcggctcactgcaacctctgcctcccagattcaagcgattctcgtgcctcatcctcccaagcagctgggactacaggcgtgccaccaagcttggctaatttttttttttttttgtatttttagtaggggggcgggtcttgccatgttggccaggctggtcttgaactcctggcctcaagtgatccacccacctcagcctcctaaagtgctgggattacaggcatgagccaccacgcccagccaggtttcatttttaatatgaaaaatctttatttatttttgagacagtctcactctgtcacccaggctgaagtgcagtggcatgatctcggctcactgcaaccttcgcctcccgggctcaagcaattctcctgcctcagcctcccgcgtaactgggattataggaacacgccaccacgcccagctaatttttgtatttttagtagaaacggggtttccccatgttgcccaggctagtctcgaactactgacctcaagtgatcctcccgccttggcctctcaaagtgttgggattacaggcgtgagccaccgcacccagcctgaacaatctttaggttaggagtattccagccgggcgccgggctcaagccggtaatccaacactttgggaggccaaggctggaggatcggttgagcccaggagttcgagaccagcctctctacaaaaaaaatagaaaataaactagctggacgcagcgcagacccctcacggcgccccgaggtgggaggatcacctgagtccagcgagatcgagactgcagtgagccgtgttcgcgccattgcactccagcctgagcaacagaataagaccctgtatcaaaaacaaacaaaaagtcttctggtgcaaggcctcactgtaaggtccctgggttcaatgctccgcgttctgggatgtgaatgtggaaaagtaagtgccaaggtgggtgtctacctgagctccataaggactcagtacttaggatgggagcatggctctgggttccattcctgacccctctgtggcctcagactctgcccgggagaggatgaaaagcacaagtcggatgcactctatagtgatcgctgtgatactcattaagagtcttactccctcgactccgacaaactcaaggccaagctatggagtccatctcatgctgacaccgtcagttctgagcaactgtaaaatggggacagggtggcccgggggcctactgacctgaggtgggggccgcgacagcccggccgctgcggggtcagcctgcggtctccgcctgactccagctctcctgcgccccgcaggccctgggcgctacccacgtcagtgagtgctcacaagtctgtgaggtaggcggcgccacagagagaaactgaggcgcgggagcccaagccacttgtccagcgcctcagccgagcgcgaaccgcgctcggggatggcatccacacggcccggccccaggctctccctgtcagcgcccgaaggcccttcgcacctccagggggcgccggcctgcgcgcacgcgcaatggtcgcagccgcgttctctttaagaggactccttttgcctccgccgaccccttcgcttccgctccgcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccggtgaggcccccgcgcccctgccctctcctcctcggtgcctgaggcccccgccttccctgctgtcccctcccccagggctcccctccccccggcctcccctccccccgcctccgcgcagacccctcacggcgccccctcacgggtggaggatgaggcagcctctcctcgcaggcccgggccgtccttcgcgccgtcgtcacttcctttatttttattattccaatattttacttagaaacccaaaagctgagcctttggagggcccaagcccgcctgcaccggcctcggggggtccaaatgagccttgtccgcctcctgcctggggcagcaccgtagggggaagcggccgcggggcagcgcgggggtcgccgttcgcccttcccgctcgcctctcccccggcccgtgctcgccgtggctggagagcaagctgcagggtcgcggatgccgctggaggtcgtggagggatctctggtggaatagctcgccgttcgcgcgccccgccccgcaggccagggcccgggctttgtaaagggatcacggattcgggaaaacttctaaaacagccggagtggggctctgatttcacttccctcctttgatgagggaggcttggcgagatgctaaaggttccagggatttggaaactctagattcctaaccccgctctaaggagtgcttgtgattttgcaaacagcgtcggccctcaggccggaaaaagcccaggaactttcaaaactgtggttggtggtggttagcagctgcggcgctgacctggtcactccactccggccaaataagagcccgcaccctgttttcctagcatcatttgctcccggggaacgcggaatgttcgtagggtgtccgacctacctggggtggacgtattgatagggcaaggggagcatctgaggaagggcaggcaggaagcaccgcgaggcgttgatggctgaagagtcgactctgacagctcatccctagtatctcctcatttgcctcaaaaccggaactgggcatttttacccctaagccggagaaggctatgcctcgcttatttagtaaccgtgccattgtggtttttcaacagttgctatgggtcaagtgccatggtgtgtatttagctttttttctttccttcttatttttttagattgataaattaggggtttcaccatgttgctcaggctggtctggaactcctgagctcaggtgattctcccgtctcagcggatcaaattgttaggattacaggcgtgagcaacccgcccagcctgtatttagtatttttaacaatttatgaggtgtaggtactattttttttttttttttgagacaggtcttcactcttgttgcccaggctggagtgctgtggtgcgatcccggcccaccgcaacctccgccacctgagttcaagcgattctcccgcttcagcttcccagtagctgggattacaggcgcccgccatcatgcctggctgatttttctatgttcagcagatacggggtttctccatgttggccaggtttgtcttgaactcctaacctcaagtgatccacccacctcagcctcccaaaatgctgaggttacaggcctgagccaccacgccaggccgggatcaatggatttgaactccctcttctgtttttcgaatgcaaacttactatatgatacgctacattgtcatcttccctcattcctttcataatagaaaaactatcttttggtgtcactagatgtgaagattcaagcaaagcatttcatgtagtatcttatttaaccattacaataaccctgtgagataggcatactgttcacattagagatgtaaaaacttgattaaacacttacccagagatgactactagtaatttgcagaatagtgatttgaatgcaggctaattttatttatttattgtatttattgagatggagtctggctctgtcgtgcaggctggagtgtagcggcacagtctcagctcactgcaaccttcgcctcctgggttcaagagattctcgtgcctcagcctcctgagtagctgggattacagctgcgcgatgccatgcccagctaatttttatctttttagtagagacgaggggtttcaccaggttgcccagactggtctcaagctgctaacctcaagtgatccacctcccaaagtgctgggattacaggcatgtgccacagcgcctggcctgaatgctggccagtttttattcagagttgttctgacctcctagcagttctgcctctcccagtctgcattttacgtagtcaaggttgcactggatatggtcattgttgcttttagttctaaaatcttacaagtgattatgtgcctgtgacactgaacaatgccttcattagcacattcagctcctcttgtccacccaagctccaaggtcacactttctaccatccaatactggagaatcaacgtggcattcctgactctcctagagtcctaggaaagacttaaagtaattttattgaatatttatctcttttggcaaaattgtatccaaagaatgttttttgacaaaaatagttctccaaaccatgctgaaaaggtacacttagagttccaaggccaggcgcagtggcttatgcctgtaatcctagcactttgggagactgaggggaaggatcgcctgagcccaggagttcaagaccaggctggccagcagagggagacctgtctctacaaaaaatccaaaaattagctgggtgcagtggtacacgcctgtggccctagctattcaggaggctgaggtgggaggattgcttgcgcccaagagttagaagctgctgtgagttatgctccagccactgcactcagccttggtgacagagcaagaccccgtttcaaaaaaaaaaaaagttccacattcatcacaaaacactcatttgcatttttcttttgtcctttgagccttatttatttatttttttaaaagaccgggtctcactatattacccaggctggcctgacctgggctcaaacatcatgcccagctactttatttaccctcaaatactctcctatctaactggctactttttttttcctgttttttgggacagggtctctgtcacccaggctggagtacagtagtgtgatcttggctctgcactcccatctcagcctctcaagtagctgggactacaggcgtgcaacaccatgcctggctaaccgcctactttttatttccatagactttatggcactaggctttgtagaaaaatattaaggggttagtgtgtggtgtgcttttcgagaaaatgctcacgaagattagaaaaacactgatggtttattggcaaaatcaataatctgtcagcagttgattcttttttttctctgaattagccctcttatgagtaatctgtttgctcattcattataatttcatacctctaaaactgcgtgtgacagctgtaaaggttaattccagtatcatgaaacgtctccaaaccaaagcagaagtgcttcaggatcctgatttgtgtgtttttttcttcactctaggtttcccttttatgcttactactcatgcccctcacttggaaagtcacttggcctcctgaacagcactaactccaaacgttttttttgttgttgttgttttttttagagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggtatgttcctttcaaacagaatgagatgatacatgtaaaatacttaacacagagtctgtcttccaagaaatgatagctgttattcttcagtgcatgggacacgggggctttcttttcaatagcctgtgtgaagccttgccctggattgccaatgaggaaagtatcctgcaaatgaaattgcgctgggagtgcagccttggaagaacataaccatatttcttgtaaaggagttttctagtggtgagaaggaaagatgatgggaaaacttgagctacaattctaaagatgcttcttttggaatatacttggcatcagacatggtagaaaggcattcaaggagccagatttgaacaacttacccagccttggatcctgaagaagatcagattttgtggtggttttagaattaaatattttttaaaaccccgtaacttaagagtcttagagattttattggaaagtatagactatttctgtctagtgtttataagtgatgaaatgctaaactgggaggtttatctatcttcaaaatattaacacactggaaagacctggggccttctgcatattgcatgggagttttagggccctggtggaatgaaataaatcgaggagcctggcacctttttaagatgtgaatgtcacacaatcacagcatactcccatgtgcttaagagtgatactctcagtatctgcctatcttgtgtccctttgtaattttttaaccccagaactctattccctccttcaggatgtcatacattatctttttttctctccatgctgctctgaaatcctgcttagaaaactattaggaaatggctgcagtcctgagctgtgagcggtaaacacagcctttgagagcaggagcacatttccctttcatgacatcaggtagggttgtatgactcccgactagttttagcatctgagtcttaccttcccccccactgtattgaagaatgttggtgatcttttaagaggtactctgtatagtttgtcattcatacctacaagaaaacaaactttagattttttgttgttgtgttgttaccttcagctactctttggttatttcatgtctggtttcaaaattcccatgtcctgtgaaaccctgtcaagcaataaataattggtactgttaaatttcataatggaaaaaattggaactcaaagtattaggagtttggcattgattttaaaggacaaagaaagaggctatgaattctcaaagatactaaacctgtaatgggatggacttcttgctctgttgaaaaggcctggtctctggaagatgaacttaaaaccagcttctcaaggtggttcatttaccacacatacttcagtgctcttttctgatttcatgtcccttatcaaggtttatgatttggggaccctcaggatttaagtgatcatggagaaaggaccataggtattgctggctcttaacagggcagttaacatagctgaaggatgtgggctttcttatgttctccatgcctaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgaggtgggtccttgccttctgttgaggagcttgtactcaaatcactccacttgaacctgacctagcagaggtagcaagaggccatgccatttggtaacctcacagtaccataagagatctatcttaggtggacaaagccatggaatttgctatgcctaagtccttcagggtcatagctgaaagaagtatgcattcatggtacgtttgttttttaatatgctttattctgcatattagtatcacattacacagtttggtcatggtatttgtaacctggagagaatactagtgcagtcggtcttcataccaccccattcacaaccagcttaaatggcagtatccctctgtgaactcaactacccctcctgtgggtccaggctgagctctacaggtcagcctcttcatctcagcccttctaggtcctgctgtcagggctgagctgtcacttcacttttttcccagagtagtgcagcatcctctctgaaacctgagctatcatgacattttcttttttaattttataatttttatatttctctaatttttgattttagagacagtctcattatattgccgaggctgaccttgaactcctgggcccaagcagtcctcccacctcagcctctccagtagttgggactgcaggcatgcaccactgtgccaggctaaaccgtaacattttcttgtggttgattatgtcacccttcagactcagtagttcttgatgtctttccttgtaggaaagcagctgctgttttggatctcagtttgattgaggtggtgactatccctttggtaccattgagaccagaaaccagaccagttggacattgtttttttctggttatcctgtcctgccttactatgagatttacggatgtttggggacacaggtctctgggctcatttctttttctgaggattcatataattgcctagtttttggcttagaggttggtccttccctggtttaatgatgcttttgttcagactgtcctctaggacttgaatttgaagcagaaacagaacagcacctgatcctcagttatactgcaaagcagggcctcagaaagggtaactccaattactgactttcacctaaggtgaaaaagcatccggcttctttccccttggcatctttggatcttctgagaatggtggctgaaggcagagggcctggggacaagccagcctggacatgactcctctgctgcttattaattccttacctgaactactcttgggacctcgattccttcatgggcaaaatggtcacataatagcaccatcacaagacttgccaggaatctagagcaagaggataacgtctaaagcatctagctcaggtcctcacatctggaaggtattaaatacaggctagctccttccatagatgcccatccaaagatgcatacatgaggtggcaggggattaaactatatgacccctgagatcctttccagttcttagctttgaggggggtcaatggcagtaattcagatatattgtttatcatagttaattgagtatcaacatgtcaaattggcatttattgtgttaccttgggcaaatgatataacttaagtcttaattttcttcattcttgaaatgggatagtaagagtacctacctcataatgttatgaaggtttaatgagatagcctcatgccaggcacagagtacacagtaagtgctcaatacttaactattattgttagatgttggtttgcttattcttctggctctgatttttttcccctttactctttttgtttttgtttgcatttcagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattgacatgtgtggttgtccttgattaagttcacagatttcaccaaataggcacactaatttaaaaaatcactgagttgtagtcataacttgtacccagttaggagcaggggtagataactttatttatatggggatagacagttgctctgatgttggtttgagaacgtaaactccaagagcgggttctgggttctcttttaattcaaggccaagcttgtaaattaggctgccttaaagaaaaaagcattgcagataaaggaagggaatgggaaaaataaacacacggtggcttttgcctgtgatcctagccctttgggaggccaaggcatgccagaggatcccttgaggccaggagttcacgaccagataggcaacatagcaaaacccccacctctacttaaaaaaaaattaactggacgtggtgatgcacatatgtagtcccagttacttaggaggctgaggtgggaggatcacttgagcccaggagttggaggctgcagtgatctgtcaccactgcactccagcctgggtgacagagggagacccctgtctcagaaaactaaaaaaatgagcagcagcataaatattattgggaaattcttagccaaaaccaactttggcagtttggttagaggaaaaactctctgattctatcactttttttttttttttgagacttgctctgtcgcccaggctggagtgcagtggtgcgatctcggcttactgcaagctccgtctcccgggttcacgccattctcctgcctcagcctcccgagtagctgggactacaggcacctgtcatcacacccagctaattttttgtatttttagtagagatgaggtttcaccgcattagccaggatggtcttgatctcctgaccttgtgatccgcccgtctcagcctcccaaagtgctgggattacaggagtgagccactgcgcccagcccacttttatccctaaataagtttcatttatccttggtatctgagttttatcctggactcatctcaatttaataatcattttgggggcggagagggctcctttgtcccaggcccagggctaattttaggataagttctcttttcagaaagagaaacactaggtatgactagtatccctttggcatataatcactttgtgggatggcagatagttctaggttaggagttcccaagctctagtctactttcaacactcttcagaccttagtaggaagttagccctcttctgggaagaaagtgggagcccaggaacaaattcaggtatgttcggtaaagatagggctgctcaaatcaatgcaaatggcaactaaaaatgacagccaaggttgtcacatagtgatcaagatgctccgtctaccagttacgtagatagaaaagttcactttcatgcagttggtatggtcctttggggggagttaaaggcagataaataatgtcttccatactgaacaggcctgttaagtgaattccttggaagctgacttttgcttttctttcacctcagttagcatcaggaactcactgccttgttggggccagatctttcccaattctgtcttcagaagaatctgttattaagaaatgcttgagcatccattttttcaggggactgaaaaaagcaggaacattagtattcacagtaaaaaaatactgtcattatgcttccacatgttcacagagtaccccctttccagaatgagctactcagctgtgtgggaatggctcttgttcatccagctttggcaaagagatattacctgtttgaaaataacaaaagagaatttttgtttgtttgtttgtttttgttttgagacagagtctcgctgttgcccaggctggagtgcagtggcgcaatctcagctcactgcaggctccgccccctggggttcacgccattctcctgcctcggcctccagagtagctgggactacaggcgcccgccacctctcccggctaattttttgtatttttaatagagacggggtttcaccgtgtt

SEQ ID NO: 15374 - DNA, 59252 bp, Human; identical to SEQ ID NO: 12150

SEQ ID NO: 15375 - DNA, 13683 bp, Human
gggccgaggttggcggatcacctgaggtcgggagttcgagaccagcctggccaacatggtgaaactctgtctctactaaaaatacaaaaactttaaaaaaaagtcaaatctagatccatgattaatgacgtgctcatttcacattgcatgtttgtatcaaaacatctcatgtgggtaaagcatagacaggcacagagaaaagaaaaaaagacaaaaaataagagaaaagatggccgggcgcagtggctcacgcctataatcccagcactttgggaggtcaaggcgtgcggatcacctgaggttaggagttcaagacgagcctggccaacatggcgaaacccccgtctctactaaaaatacaaaaataatcccagctactcgggaggctgaggcaggagaatcggttgaacccgggagagggaggttgcagtgagccgagatcgtgccactgcactccagactggagttttttcaaaaaaaaaaaacaacaactccgtcttaaaaaaaaaaaagaaaaaagaaaaaaaatcttatgtacactataaatatatacacctactaagtgcccacagaaattgaaaacaaagaaaaaaatccatgattaaaagcttttatattaacgggggaacctctgaccagaaagagccgacagggggcgttcctggatgatctggggctgtcaattgcgagacgcggaggattgtgggacttgtggtttttctcgcatcatttaagctttctggactacatgtcccaaaatgcaaatgcaatcagacggtcccactgtggggtgtgaagtgtccgtagagctgtgagaggtaagtgtgttctgtgtgtgctgcggatttctagaagttgtggatttcttgtgagggattctatttctcctctttgccctcggtgggacctggaagagagtagttgttccactgatgcacgttttcagcgggggtttcccctgaccctttggtctcgggaaaccggactgtgtgtttgttcagctgttcacgttttgctgtggaatgtcaaggagaaagcggggtcctgatctcagatctggaaagccaaacataaaataatgtttacatacggggtgcatgtcactagaggatttatgcattgcattgtgtcaaataatatgtcaaagttttttctttttctttttttttttttttttgatacggagtcttgcttcttcgcccaggctggagtgcaacggcgcgatctcggctcactgcaacctccgcctcccgggttcaagcaattctcctgcctcagcctccctagtagctgggattacgggcacgtgccacaatgcccggctaattttttttgtatttttagtagagtcggggtttcaccatgttggccaggcatgtctcgaactcctgatctcaagtgatctgcctgcgtcggcctcccaaagtgctgggatttcagacgtgagccaccgcacccggccctctattgttacagctagaaaagctgacgggcaggggtcttgtctctctgatgtgtccaagtagcagagcttgcagtggagggtaaactaaaataagggggaaatgaaaaaataaaaggaatgcgtgtgtgtgcttaattacatgaacaaaatcaaacaaaacctgactcattagggccagactcagaggctcacacctgtaattccagcacgttgggaggccgaggcgggcagatcactagagctcaggagttcgagactagcctggccaacatggtgaaaccctgcctctactaaaaatacaataattagccgggcatggtggccatgtagtcccagctattctggaggctgaggcaggagaatcacttgaacccgggaggcggcggttacagtgagccaagatcatgccactgtactctagcctgggcaacagagggagactctgtctcaaaaaacaaaacgaaaacaaacaaacaaaaaatgagaaaaaaaaaaaaccaccccagtttctcacatgaggcttctttttctctagaatgaagatgagctttgcgttgactttcaggtcagcaaaaggccgttggatcgcaaaccccagccagccgtgctcgaaagcctccattgggttatttgtgccagcaagtcctcctctggaccctgagaaggtcaaagagttacagcgcttcatcaccctttccaagagactccttgtgatgactggggcaggaatctccaccgaatcggggataccagactacaggtcagaaaaagtggggctttatgcccgcactgaccgcaggcccatccagcatggtgattttgtccggagtgccccaatccgccagcggtactgggcgagaaacttcgtaggctggcctcaattctcctcccaccagcctaaccctgcacactgggctttgagcacctgggagaaactcggaaagctgtactggttggtgacccaaaatgtggatgctttgcacaccaaggcggggagtcggcgcctgacagagctccacggatgcatggacaggtgcaggagctgtacacggtttgaacgcaaacccgtgtgttgttttgggagagtagggaccttggctgtcttgatcaccacagtcttagaccttgagaaaaggatttcagagcaagttgtttattttgcagttgattccagtaaattcattgacggagcaaggatgtaaaacaggaaagagaggaaagccaagaaagtgtgtgttaatgagtgggttactgccttgggcactggggttcagtcctgtgagggaccctccaactgtctaggacatgcctgaggattgtctcaatgaaacttgaggactggggccgggcgcagtggctcacgcctgtaatcccagcattttgggaggctgaggtgggcagatcacatgagctcaggagttcgagaccagcctggccaacatggtgaaaccccatttctactaaaaatacaaaaattagccggtcgtggtggcacatgcctgtaatcccagctgcttgggaggctgaggcaggaaaatctcttgggaggcagaggttgctgcagtgagccgagattgcaccactacactccagcctgggcaacagtgcaaaaaaaaagaaaaaaagaaaaaaaaaagttgaggatggtgcacagtggctcatacctgtaatcctagcactttggaaggctgaggcaggaagattgcttgaggctaacagttcaggaccaacctggcaaacacagtgagactctgtctctatataagtaaagtaaattttatatatatatatatatatacatatatatatattttttttttttttttttttttttaaagaaagttgaggccgggtgtggtggctcacgcctgtaatcccagcactttgggaggccaaggcaggcagattacctgaggtcaggagttcaagaccaatctggtcaacatggtgaaaccccgtctctactaaaaatacaaaaatctgttggaagtggtggcacgcacctgtaattccagctactcaggaggctgaggcaggagaatcgcttgaacctgggaggtagaggttgcagtgagctgagatcatgagctgagatcatgccaccacaccccagcctgggcaacagagcaaaactccgtctcaaaaagaaaaaaaaaaaagaaagttgagcaagctagggtgattttcttttattttcttttgtgtttgtgtgtgcacgtgtgtgtgtgtgtgtgtgtgtgtgtatgacaggctttcactctgtcacacagactgggatgtggtggtgtgattatagctcacttcagcctcaatctcttgggctcaagtgatcctttcaccccagcctcctaagtagctgggactacaggcaaacgccaccgtgcccagctaatttttaatttaatttttattttttgtagagacgaagtcttactatgttgcccaggctggtctcgaactcctgggctcatgtgatcctcctgccttggcatctcaaagtgctgggatgactagtgtgagccactgtgcttggccttgaagctagggtatttattcaccatctctcatccctcatgggtccaggatcactctaggggaattaattccctaacattttgactctgctcctcccaaggaggcttccgtgggcagagaacatctgaggcaagagagacacaggaaactgcttgtaagaaaattgtgtaggctgggcgcggcggctcacgcctgtaatcccaacactttgggaggctgaggcaggcggatcacgaggtcagttgatcgagaccatcctggctaacatggtgaaaccccgtctctactaaaaatacaaaaaattagctgggcgcggtggcggacgcctgtagtcccagctactcgggaggctgaggcaggagaatggcgtgaacctgggaggtggagcttgtggtgagccgagatcgcgccactgcactccagcctgggtgacagagcgagactccgtctcaaaaaaaaaaaaaaaagaaagaaagaaaattgtgtccaccagggtgctgtggttcatatctgtcatcccagcaactcaggaggctgaagcaggaggattacttgaggccaggagatcaagacctgcctgggtaacacagccagactccgtctctacaaaaaatttttttaagaaaggaaattggctgggcacggtggctcgcgcctgtaatcccagcactttgggaggctgagttgggcggatcacctgaggtcaggagttcgagaccagcctgaccaacatggagaaaccctgtctctactaaaaatacaaaattagctgggcgtggtggtgcatgcctgtaatcctagcgactcgggaggcttagacaggagaatagcttgaacccaagaggcggaggttgcggtgagccgagattgtgccattgtactccagcctgcagcctgggcaacaagaacaaaactccgtcaaaaaaaaaaaacaaacaaaaaaacagagaaaggaaactgggacgggtgcggtggctcatgcttgtaatcccagcactttgggaggcagaggcaggcagatcacttgaggtcaggagttcgagaccatcctggcccacacggtgaaaccccatctctactaaaaatacaaaaaattacctgggcatagtggcgcacgcctgtagtctcagctatttgggaggctgaggcacgagagtcgcctgaacctgggaggcagaggttgcagtgagccaagattgtgccactgcactccagcctggacaacagagtgagactctatctcaataaaaaaacaaaaagaaaggaaactgttcgaacgtggcctttagcatgttctgaggaaaatatgagctgaacaccaatagcatgtgctataaactgctgggtttccaatgcctaggatggctagatacatagaccataacgtagccgggcagtagtcagaactcaatcaataatgagggaacagatacatgggagggtatcatgcttatgggtctggcaataattgtagctaattggagacttatttctttaagccctagagaggctcctctgagggctgaagtcagtctgccaatgctgaaatatttactgggtgcctagaatgtatggtgtacatacgttacactatgtagtacattataacactaactactgtgcttcttagtggtcagaaccaaagtataggctgggctcagtggctcacacctataatcccagcattttgagaggctgagggggcggatcacttgagctcaggagtttgagaccagcctggccaatatgtcgaaacccagtctctactaaaaataaaagattggccaggcgtggtggcgggcgcctatagtcccagctactcgggaggctgaggcaggagaattgcatgaacatgggtggcagaggttgcagtgagccaagatcgtgccattgcactccagcctgggcgacagagggagattgtctcaaacaacaaacaaaaaccaaagtataaaacatggcccactttatatgcaagaactttgtaatatttgggaagacacaaaaataacataattggccgggcacggtggctcacgcctgtaatccgagcactttgggaggccgaggcaggggatcacctgaggtcaggagttcaagaccagcctgaccaacacagtgaaaccctgtctctactaaaaatacaaaattagccaggcatggtggtgcatgcctataatcccagctactcaggaggctgagacaggagaatcatttgaacccgggaggcagaggttgtaatgagctgaaatcgcaccattgcactccagcctgggcaacaagaacgaaactccttctcaaaaaacaaccaagcaaacaaacaaagaaaagcacataattaatgataaatgacaacgcatgattgtgaaattgtgtggttcttgatttatatgctgtgcatgttcaaataaacagatttagtaaagattggaataatcagttgagaaagctttttaaaaaaaaaatttttttttttaaatagagacaggatcttgctgtgttgcctagtctggtctcgaactcctaagctcaagccctcctcctgccttgatcttccaaagtgttgggattacaggtgtgagccaccatgcctggcccaagaaagctttttttttttttttttttttgaaacacagtcttgttcttgttgcccaggctggagtgcagtggcacggtctcggctcactgcaacctccgcctcctgggttcaagtgattctcctgcctcagcctcccaagtagttgggattacaggtgcctgccaccacccccagctaattttttgtatttgtagtagaggtagggtttcatcatgttggccaggctggtctcgaactcactcctgacctcgtgatccgcctgcctcggcctcccaaagcgctgggattacaggcgtgagccacagcgcctgccccaagaaagcttttatgggtacagggggcttgagattggctcaggtttgtctaggcaagagcgggaaacagggctttccaaatgaagggaagttgtagatcccagaggagtctggcctggcctctgtagaggtttggacctgggacttgcagaaaccagattgtctgggaaagttaggcccaaatcatggttacatttgaaaatcaggcagtgcagttgggtctgctgtgagacaccaaaggggtttattagtggtttctgagcaagcaagcaacatgataaaaatagcatttgaggaaggctaaacaggattaaaaagagcaggtcagggaggtcagcctgaaagacctagactaaggtggtatccagggaatttgagttaatgatgcttatggattcattaaaacaattttttccgccgggcgtggtggctcatgcctgtcatctcagcactttgggatgccgaagcgggtggataacctgaggtcgggagtcaagaccagcctgaccaacatggagaaaccctgtcactactaaaagtacaagaacaacaaaaaattagccgggcatggtggcacatgcctgtaatcccagctactcgggaggctgaggcaggagaatcgcttgaacctgggaggcggaggttgcggtgagccaagactgttgtgccattgccctccagcctgggcgacaagagtgaaactctgtctcaaaaaaaactcacaatttttttcatgaagaaaatctgttcttttaataatgaaaatttcaaacttcacaaaagtaaagagaattgtataatgaattctcatataccatcacccagattccaaggttttatcaagattttgtcatgtctactttatccattctgtctcttcttaagcattttaaaacaatccaggacttcttgacatttcacaggggcctttttttcttttcttttttttttttttttgagacagagtctcactctgtcgcctaggctggagagcagtggtgagatcttggctcactgcaacctccacctcccgggttcaaccgattctcctgcctcagcctcctgagtagctgggattacaggcatgcaccaccatgcccggctaatttttgtatttttggtagagactgggtttcaccgtgttgggccaggctggtctcaaactcctgacctcaggtgatctgcctgccttggcctcccaaagtgctgggattacaggcatgagccactgtgcccgctttctttttttttttttttttttgagatgaagtcttgctctgtcacctaggctggagtacaatggcatgatcttggctcactgtaacctctacatcctgggttcaagcaattctcctgtctcaacctcctgagtagctggaattacaggtgtgcaccaccacacccggctaatttttttgtatttttgtagagacagggtatcaccatgttggccaggcgggtctcaaactcctgacctcaactgatccacccatcttggcctcccaaattgctgggattacaggtgtgagtcaccgtgcccggcctggcctttttttcttttttagacagggtctggttctgacacccaggctagagtgcaatggtgccatcataactccctgtaacctagaactcctgggtaattagaactccagctaattaaaaaattttttttggctaggcgtggtggctcacgtctgtagtctcagcactttgggaggccgaggtgggcagatcacaaaaattagctgggcgtggtggcaggcgcctgtaatcccagctgctcgggaggctgaggcaggagaatcgcttaagcccaggaggcggaggttgcagtgagccgagatcgcgccattgcactccagcctgggcgacagagcaagaccccgtctcaaaaaacaaagacaagccaaaaaaattttttttgtagagagagcgtcttgctgtctacccagactggtctggaactcctgagctcaagcgattctcttgctttacgctcccaaagtgctgggattacaaggtgtgagccaccatgcctggccacaggggttcttttaagagaagaaaatcaacataatctgatggctgactagaactaaaaggagaaaaatgaggctggttgtggtggctcacacctgtagtcccagcactttggaagactaaggcaggaggattgcttgagcctaggagttcgaggctgcagtgagctatgatcatgccactgcactccaggtaagagccaccacgcctggccaagaccctgtctcttttttttttttgagacggagtctcgctcgttgcccaggctggagtgcagtggtgctatctcggctcactgcaagctccgcctcccgggttcacgccattctcctgcctcagcctcccgagtagctgggactacaggcgcccgccaccacggccggctaattttttgtatttttagtagagatggggtttcaccgtgttagccaggatggtctcgatctcctgacctcgtgatccgcccgcctcggcctcccaaagtgttgggattacaggcgtgagccaccacgcccagcctgaccctgtctcttaaaaaaaaaaaaaaaaaaaaaaaaaataggccgggcgcagtggctcatgcctgtaatcccagcattttgggaggccaaggcgggcagaccacctgaggtcaagagttcgagaccagcctcaacatggagaaaccccgtctctactaaaaatacaaaattagccgggcgtggtggtgcatgcctgtaatcccagctactcgggaggctgaggcaggagaattgcttgaacctgggaggcagaggttgcggtgagccaagatcgcgccattgcactccagcctgggcaacaagagtgaaactccgtctcaaaaaaataaaaaataaaataaaaaaataaaaacagacacaaagtgctctccctcactggctcaagctctggtgattggagaggtgagaaggggggccaggtgcagtggctcacacctgtaatcccagcactttgggaggccaaggcaggcggatcacctgaggtcgggagtttgagaccagccttaccaacatggagaaaccccgtctctactaaaaatacaaaaaaaattagtcgggtgtggtagagcctgcctgtaatcccggctactcaggaggctgaggcaggagaatcgcttgagaccaggaggtggaggttgcggtgagccaagatcatgccattgcactccaacctgggcaatgagagtgaaacttgctctcaaaaaaaaaaaaaaaaaaaaaaaaaagaggtgagaagagaaccaggagacactgtgtcctggaaaccaagaaggagaagcattttagaaggaatggtaatagacagtggcaaattcagcagatgagcaagggaaagtatagagggaaaaacgcaggtttgggcattaaggaaatcagcaggcaaggcatttgcagtcatgttaaggataaaagtgagctatagcagaaggttaggaaggagtgtataggaaggaaattgatgggctgggcgcagtggctcacacctgtaatcccagcactttgggaggccaaggagggaggatcacttgaggccaggagtttgagaccagcctgggcgacacagtgaaacaccgtctctaccaaaactacaaaaattagctgggcgagatggcgcgtgtttgtagtgcagtccctgccactcaggaggatgaggtgggaggataacctgagcccaggaggttgaggctgcagtgagctgagatcgtgccactgcattccagcctgggcaacagccagaccctgtctccaaaaataaaaaaaataaaatagaaagtatggctaaaatggggtggggattgtgtgttagggaaagaaagcagcgatggaagggctgaaaatggttggagatgaaacgtctctgacagctttgtgcctcccaagggcatactgttcagtcggcgtcttccttggttccagggtcctgtgcttggattgtggggaacagactccccggggggtgctgcaagagcgtttccaagtcctgaaccccacctggagtgctgaggcccatggcctggctcctgatggtgacgtctttctctcagaggagcaagtccggagctttcaggtcccaacctgcgttcaatgtggaggccatctgaaaccagatgtcgttttcttcggggacacagtgaaccctgacaaggttgattttgtgcacaagcgtgtaaaagaagccgactccctcttggtggtgggatcatccttgcaggtatctgacttggcaagagtggtaaccaccccttgtgcgggattgggagtcctggagagacaccctgtttggtttaactttttctagatctagagaacctagacattcttatgtgtgtcttttctccgtgcaggtatactctggttacaggtttatcctcactgcctgggagaagaagctcccgattgcaatactgaacattgggcccacacggtcggatgacttggcgtgtctgaaactgaattctcgttgtggagagttgctgcctttgatagacccatgctgaccacagcctgatattccagaacctggaacagggactttcacttgaatcttgctgctaaatgtaaatgccttctcaaatgacagattccagttcccattcaacagagtagggtgcactgacaaagtatagaaggttctaggtatcttaatgtgtggatattcttaattaaaactcattttttttaaataaaaaattgttcagctttatatgaaatgcttcatgaatttgtgtgtcattcttgcacaggggtcatactaacctctgtatcattccaattttagtatatgtgctgctgaagagagcactaaaactaatttttttttttttttgagacaggatctggctctgtcacccaggccgaagtgcaatggcctgacctcagctcactgcaacttctgcctgccaggttcaagccatcctcccacctctgcctcccaagtagctaggactacaggcgtgcaccaccatacccaactaattgtttttattttttgtagagacagggtctcactttgtcacccaggctggtctcgaagtcctgagctcaagctctccacccgcctcagcctcccaaagtgctgactttataggcacgagctaccacacccggccaaaacttttttttttgagacagtctcgctctgttgcccaggctggagtgcagtggtgtgatcttggctcactgcatcctctgcctcctggattcaagtgattctcctgcctcagcctcccaagtagctgagattacaggcacgtaccactacacctggctaattttttatagttttggtagagacgaggtttcaccatattggccaagctggtctcaaactcctgacctcaagtgatctgcctgccttggcctcccaaagtgctgggattacaggcgtgaaccaccgtgcccgggtgttttgttttgttttgttttgtctttgagatggagtctcgctctgtagcccaggctagagtgcagtggcatgatcttggctcactgcaacctctgcctcccagattcaagcaattctcctggctcagcctcccgagtagctgggactacaggtgcccaccaccatgcccggctaatttttgtattttcagttcaccatgttggccaggctggtcttgaactcctggcctcaagtgatccacctgccttagcctccaaaagtgctgggattacaggcatgagccaccaagcccggccagtggtcatctttccatgtcctaagtgctatggtattgtgactgataggctgatgttcacaagcattccctggaccctgctcttcgtttatctttgcattcacttgtttcatttctttacagatccctaaggagcatccgttttttctcaaactaatcaaagctcgctgagtgcagcctgtagggggcaacaaatcaacacctctctgccagcccatttctcaacccggcagctttcccagccaaagagttaaggtctaggctgaggagatttgccccagaacaaagactttttcaaagaagcagctgcattcatttcctttttatctcacctggcaggagaaatggcctgggacatatgtaggccagagtggtctctggagcgccaacccaaggatctcactaattttgtggggtaagggtagaaggaaatgactaaatttataatccaaatggttaagtgtctttaactgaaccattttgatataatttttgaaaaaataagcaatggccatgaattaattttttataaccaagagataaaggaatctttcaaaaatagcacagcagctgggcgtggtggctcaagcctgtaatctcagcactttgggaggccaaagcgggcggatcacgaggtcatgagatcgagaccatcctggctaacacggtgaaaccccgtttctattaaaaatacaaaaaaatgggccaggcacagtggctcacttctgtaatcccagcactttgggaggccaagacaggcagatcacgaggtcaggagatcgagaccatcctggctaacacgatgaaaccccttccctactaaaaatacaaaaaaattagctgggcgtggtggcgggtgcctgtagtcccagctactggggagactgaggcaggagaatggcgtgaacctgggaggcggagcttgcagtgagccgagatcttgccactgcactccagcttgggcgacagagcgagactcaaaaaacaaacaaacaaacaaaattag

SEQ ID NO: 15376 - DNA, 8405 bp, Human; identical to SEQ ID NO: 11882

SEQ ID NO: 15377 - DNA, 23533 bp, Human
aaagcttttaagggatggaggccaggattccaaagctagcattggaacgaaagtcttcccgacaccagcccaggttgtgaagatgagctaggaggacctactgcctcgctggctggttagggctgggcgtgcctccctggtggaaggaaggtacataccttccttctccccctctatttcctaaaactgctgagtcagaggatggccctaaccttcccgaccaagggggactttctatcgggagcacatgagcagctcttctccctagccagtaccttcagattccaagctcatgttatttcgatatcaccacactgattctcagctcccggaaaaacaactcaaggcttgagtcagacactccatgtgttgttcaatgatcccgcctgcaacaatgtttattataaccaaaaaatataaacagcatgaatgtctattaatagcggagtggttaaataatagtacatccgatggttatcggatggagtaccataccacgcagatgttaaatgataaaagtgtactgttaaatagaaaaagcaaggtatgtacatatatgtttgtacaggcaaaggaaattcactggggggcacttattcattcaacaaatatgtgttaagcattttaaggttacctgtgaaactaacaggggttacctgtgaggagtgcttcagaaggaaaaatagtaacttgtacttttcagtaaacttctgcacataattttaaggacgaacattgttttttttttttgagacggagtttcgctcttgttgcccagaatggagtgcaatggcgagatctcagctcactgcaacctccgcctcccgggttcaagcgattctcccgcctcagcctcccggcattgctttttataaagtcaaaagaaaaggaagtttgataaaacaagtagaactatccgataaatactcgcctggaaagggacaggattataagaaacaggtaataaggagcttaaaaccctctgcagttctgcagtgaggatggtcgtgggggcatacaactttccgtttcaggtcagtttaggtagggcaggtgggaactcactctaaaacgagaaaccggggctgatgacaaaatgcacacgtttagcttctggcggcccaggtcttcctagccgcagattctgagacgtgtatctgcaggtggtgtgaaattgaagccgggggagcggttgctttcggtctccgaggtgcgccttgcacactgggtcattcagctcccaggctcggctcggagctggaccactccctcccctccaccaaagaggcaatgtgggctccaagaggtcacagcgctgggatgggatttcgaccccgcgctgccctcaaaggccacctcctcgcagctctgctcccgccggcagctcccgttctgtccaactcggaagccgcccgccgccctcggcgtccactccacaggcccggggccggggccagctccgcgggggaggggtcggtgcggaaggggcggggtaccgggccttccccgcgcgactctgccttctacggccccggcccctgcctctggaaacccggagctcgtgcgagccccgccccacggtcgcggcgtgcctgtcatttcctctccgcagggcgtgcgggtctcgaagatgagggagcaacaacgtccacgaccgggcttctccggcaccttgggcttctttccgctgggactcgacagcggctcggctccgcaagctctcagcgcccagggtggcggcgacgacgctccccgaggagacgcgaggaagacgggcccgcgcttgctgggactccgtcagggcgcgtgcgcggcccgggcgcggccggctcaggctgcggctgcgcaaggcggtgccagacgctgcgcctgcgcagtggtggggcggggcgggaaggagggaggcggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgagggccgcagcggccggaggcggcgcgggccctgccgggcgcggcccgcgggggcctcggggcggcaggcgggcggggaggtgccggcccgtgcggggcgggcgggcggggcagcccggcggtctgggccccaggggtgcgccgaggggctccggaccgcgccgaggggaggttggggcgcggggcggaggggccaagcgcgccgggtccagtcatcgcgcctgttcctgcctcacgtgtgaccttggtcaagtcgcgcgatctctggagttggagagacgtgggttcgagtctcaggactaccacctgcctcgcgctgaccttgggcaagttgcttcgccgtcctgagcctcagttccctcatctgagaagtggggatgtgccttgctgggtggtgtgaggattcgatgggataaagtaggaaaagtgcgtagcgccctacccggtaaagtaagctcgaagtaaatgttcactattgtcattatcatcagtatcctttataagcgtcagtttcttcccatctaaaatgaggacgttctcagaacctgcctcatgggattgccgtgaggtttaaatgaggtaagtcggataaagggctttgcacagggtctggcatattcctgctgaattattatatccctgcgtggttcagtttcctcatctgtaagatggaatgatagttggatctgccttatggggttgatgtgagtattaagtgagattctgcagtgttgctcacagctcctggcacatagtgagttgtcactgtttgctgttacactactatatacagaggggtcctggggatgggacagccaaaattataaaagtgctttggccacacacacacactgcttgagggctcctagctctgatcactgctctagctccagtgcctagaacagtgcctggcacccagtacatgcttaagacatatttgcagaaggaattaatgaatattaagtgtccttcgaaaaggtagactggtttctgggaaaaggtggagggttttagagctgtttggagtgtggcaggtgagcaggtttatggagtgaccaagaggtcaggaaggcaggccccagaaggtttatgggagcgaaactgaggtgctggggttatatgatgttcatgaaagagtcttgggagcatgctcagtttgtagaccagacctgagctgagtgtggggagggatgtcttatgattggaggcagaggccaggctggtggtagagcccatggactgttaaggaaaggggatcaaatcaagtgagcggtatgacttgggatgtaggagtgttgggtagcgatgtcagagctaggtcagggaagtgggtggttttggcctcccttttaaagctggatggagatgtggttggtggtttggatcaggtgaaggatggctgaggtttccgtggttgctggaggaggggagaggtaagggggaaagctgggggctaaccagggagatggaagagtaactgaggttggggaaggaggtagaaaggtggagtactgactggttatggtttgaatgaagggaaaccaggcaggctctggagtgttctcttggagatggcctttggtattcttcagggtcttgaggcttcttcctttacatgatttccttgcagccctggcctgggttctgagggactggcactggggccatttctctctttttggagtgacagcccgccgtggtcaggagcctttatccctctgcaagacatctggacctctgcgttgatatccaacagtgaaaagcctaaactcagcaggaagatgcagcttgttggctcttctcctctgtaaagcccaggggatgggtttggcccgctttctcacagtacattttgtgtgatgaattgatttttctctccgaagtcaggtgtgggagaagactcattgggtcgagatttatgtggtctagctcctaggtcagccatgtaggcgtaggttgtgcagaggagatggatgctgtgctctttgatttctcccgacattgagatcctcaaagctgggagatggtagccatggaagtccagactaagctttggcagctgagcccagagactgacattacacactcccctgaactgggctccttgtgtgaatgcctccttaagatatgttgaacgatttcacagacgcttattctcacccgccccctgtgtgatttgtcaaataaggaaactaaggcttaaggccgggcgcggtggctcacgcctgtaatcccatcactttgggaggccaaggcgggcagatcacctgaagacaggagtttgagaccaacttgggcaacatgatgaaacctcgtctctactaaaaatacaaaagtagccgggcatggtggaatgtgcctgtaatcccagctacttgggagactgaggcaggagaatcgcttgaacctggtaggcggaagttgcagtgaaccaagatcgcactattgcactccagcctgggcgacaagaatgaaactccgtcttaaaaaaaaggaaactgaggctcagaggaggtgacttacttgccccaaatcacatagctcagcaggggcaaagccgggagccactgcatctcagtgctaatacgtgtgcgagcagctcatgtcagggctggcaaacaataggccctccatgaatgctggtttctttcttcataaatctagagttctgcccactctgcacattgtggatgcttctgcaatggattccctcaatctctgcatcccttcgttatgccggaggttctatattttctttttttccttttttttttttttgagacggagtctcgctctgtcgcccaggctggagtgcagtggcgcgatctcggctcactgccggctccacctccccggttcacgccattctcctgcctcagcctcccgagtaggtgggactacaggtgcccaccaccatgcccggctaatcttttgtatttttagtagagacagggtttcaccattttagccagtatggtctctatctcctgacctcgtgatccgcccgcctcggcctcccaaagtgctgggattacaggcgtgagccaccgcgcccggccagttctgtattttctatactttcccttatactctctgacactggctttgatttgtaacagcatgtcgtctgcatccctcaggccagccatcctcatttggagatggagttagcccttcacttgacagatgagtaaattgaggctcagagagggggcgtgacttgtgtgaggttatacagtgaggtggtggctgaggcaggtttaaaattgagaacatggctgggggcagtagtttgtcctagtgctttgggaggatgaggcgggaggaacacttgaactcgagaccatagtgagagcaacatagtgatagcgagaccccatctcttaaaaaaaaaaaaaaaaaaaggccgggcacagtggctcacacctgtaatcccagcactttgggaggccgaggtgggcagatcacctgaggtcaggaattcgagaccagcctggccaacatggtgaaaccctgtccctacttaaaacacaaaaaattagttgggtgtggtggtacgcacctgtaatcccagctactcgggaggctgaggcaggagaatcatttgaacccaggaggcggatgttgcagtgagccgagatcgtgccactgtactccagcctgggggacaagagcgagacttcatctcaaaaaaaaaaaaaaaatcagttgggcgtggtggtgcacatctatagtcccagctatgtgggaggctgagacaggaagattgttttaacccaggagttcaaagttacagggagttaggatcacacaactgcactccagcctgggtgacagaatgagacactgtctcaaaaaaaaaaaaaaggtccaggcacggtagctcacacctgtaatcccagcactttgggaggccgaggtggaggatcacttgagcccaagagtttgagaccagcctgggcaacatagggaggccctgtctcaacaaaaagaagaaaattagcagggcatggtggtgcacgcctgtggtctcagctacttgggaggctgaggtgggaggatctcttgagtctgggaggttgagactgcaatgagctatgatcacgctgctgcactttagcctgagcaacagagcaagatcctgtttcaaaaaaaaaaaaaaatatcgagaacagttcactgaaaggtcagggctcttcaagaggttgaactgaagcagagaggagtgagggggccatagcccaggcaggagcaggaggaagggaagacatgtgtgtggcttgcgtggtgaggaccagatacagcagccaggggtaaaaggccgggagcagtagctcactcctataatcccagcactttgggaggccgaggcaggcggatcacttgaggtcaggagctcgagaccagcttggccaatgtggtgaaaccctgtccctacaaacaatacaaaaaattagctgggcgtgatggcgggcgcctgtaatcccagctactccggaggctgaggcaagagaatcgcttgaatctgggaggtggaggttgcagccaagatcgcgccaccgtactccagcctgggcgacagagtgagactccatttaaaaaaaaaaaaaaaagaatgacaggctggactggttggggtcatgctgatgtgcccttgggcagcctcgggggtggctgtggtgaaggttggtgggtgccctctgctcctgccctgacactgatggtgtggggtaatggctgcagcttgtgtttccgaggaagcctcttccagggatatttaggaggtagtgtttcttggggtgggtttctgttcctctcaaagggagagcagtgtcagaggttggtgtcaggtccaaagcagcagataatgtggtgatggttgtggtctttctgcagcctagtggctttttttttttgagatggagtctcgctctgtcgcccaggctggagtgcagtgacacgatctcagttcgctgcaacctccgcctcctgggttcaggcgattctcctgcctcagcctcccgagtagctgggattacaggcacgcaccaccacgcccggctaatttttgtatttttactagaggtggggtgttcatcatgttggccaggatggtctcgatctcttgacctcgtgatctgcccacctcggcctcccaaagtgctgggattacgggtgtgagccactgcgcctggccagcctagtggcttttaactgctctgccgagacgcctggggacagtatggggacctggagaggccaagctggaggggatactgctgtgtcattgcagagagagctgttttacacatgggatttgggtaaagcttggatgaagaaaaggattctgctgccctgcagaagtttggaaacccctgcttaggcgcctgctgtgctgcagtgggagcgctggatagcagagctgtcagtgtggcgggcgttcgtttaggcagaaattcattaagcagtgtttggttggcacctactaagtgctgggcctggcttacagcactgtgaatgcacagggcgggtgaggcgagggctctgtcctagaggaactcccagactcaagcttttagctgagtaagctggacccagaaggctccaggaggaagcagaggaggcggcgaggccagtggggtgctggtgttgggcacagcgccgtgaaggacccaacccgggactcgggctctccttgagctcagcaggaagcctcacggcggagcaaggaggaagtggccctgagcatgagccctgcaggcccaggctgagcagcgtctgcctgcccaggagagcctcaccctggcctgtctttaggaaagtaggacccaggcttactcagtgaaacaagttcttctgggcatcgtggggcagctcactcaccaggagaagctcccagaagagatctttagaggattgcccagagaggatgctggggttaggcttagggaaatacaactgcgacagtggttttccgctttggttacttggtagagtgcaggtggaggcagtgcccttcttgagaatctattaaaattgtggagccaaatgcagtggctcaggcctgttagcccagcaccttgggaggcagaagcgggcagattgcttgaggccaggagtttgagaccagcctgggcaatatagtgagaggccatctctacaaaaaatttttaaagagtttgctgggtgtggtggcgaacacctgtagtacttggggatttcaaggttagagtgagttatgatcgcaccactgccctccagcctgagagacagagtaaggccctatctctccaaaaaaaaaaaaaatgctgtgggcttctcccatgaacagacacctaggctcaaatctgcactttgtttcagggggtttcatagctttcgtggcattttcattaaaaatctaacaggagtgagatgttggagcccccacaggtcattttttccaaacttcctgaaccagacgcaagactcccagcaatgtgtattgggaggagtgttagcactctggaggagtccggcctggatgcagatctcagctttactgctgctcacagaggcacttaggccggccactctgggcctgaggttcctcatctcaagagatgtggccagaattataatcaaagaggcatccaagggctcaccacacacacagcccgatgcatgtgaattctttgtggtcaattaacttggctggcctcaggggtgttggagattggggacaggataggaggacatggaacaggtgtacttggcaggctgaaagcactgtgagttgaagtcaaggggagaggtccaggcgcagtggctcatgcctgtaatcccagcgctttgggaggcccaggcgggagggttgcttgaggccagaagtttgagaccaacttgggcaacatagcaagacctcgtctctacaaaagattaaaaaaaaaaaaaaaaaaagcctgggcaacgtagccagactctgtccctactaaaaataaaaaaattagctgggcatgatggtatgcacatgtggtcccagctactcgggaggctgaggtcagaggatcacttgagcctaggagttggaggctgtggtgagacatgattgcaccattgtactccagcctgagtgactgaatgaaaccccatttttttttttttgagacagagtttcgctcttgttgcccaggctggagtgcagtggcatgatctcagctcactgcaacctccgcctcccgggttcaagtgcttctcctgcctcagtctcccgagtagctgggattacaggcatgtgccaccacgcccagctaattttgtatttttagtagagacggggtttctccatattggtcaggctggtcttgaactcccgacctcaggtgatccgcctgcctcggcctcccaaagtgctgggattacaggcatgagccaccgcgcctggcctgaaaccccatttctttacaaaaaaagtgggggaggccagatgtgtacctgtttgtgctctaagcagccaggagctgctgtggctggtgcatggtctgagcacatgtgggctgctgccctgatgggtataaggcagaccctccactccaccagcccacccggcggggacatcagccagaaagatggtagccattgagttctagctatgtgggccttggtttcctcacctgcaaaatagccctgatgatctcaagggtcctttcccgctctacagctcttcattttgggcggctccctaactgatgtgctacaacgtgctgtgcacttttctagggaccatgttgtagacgcacttgggggccgtttcgtgtggttgaccttcattctgctttgtcgtctggcatctccctttgggccagccctcagcctagggcctgggcaccagtccctttctcatctctcccccaggggatttgggagcagcttgtcttacacaaggacgaaggaaaaggtcagggatcgagtggaagagatgttcttggtgtgtggccgctcagggaggtggaaagagcattgagaagtgagctgggtcccaccgagcttcttaagagttgggactgaggcatcctctcccggaagaagggctggggctgcggggaggggacccacctgcccccctcatcgcagtgctttctctcttgcaggtgtgggcaagagcagtttactgttgcgttttgcagacaacactttctcaggtgagtcctcccctgcagtgctgctggggtgtcgtttttgtttgtttgttgacatcccctccctggcaccaaacagagttgcctctgcctgatgttgggaactgtctcattctggttgccagaggagggaagaagatggagtggggcttaggaccttgtggcgcttctgtcagaagcctctgtggtctgtctaatgcacctgctcacgaaaaccctttggctggcccatcattttcccacccatggtccaaacaggaaggttcccataacagcgtctatggtgccacccgggacacagtccctgctcctgccccctatgcctccctggcagcctgtggtcagcgtgtgtctttctgatttctttctgcgctccacatgcaggcctttgtggttcatctgagtgcggtgggctttctgtgcttgaaggcaccacatggtgcactgacgctgctgttacatcgtgcctgacttctggttgtgttttcagcgatgcttagctacttgggatataggcgatatttattctttttttttttttttttttttttttgagatggagtcttgctctgtcacccaggctggagtgcagtggcgcgatttcggctcactgcaacctctgcctcctgggttcaagcaattctcctgtctcaacctcccaagtagttgggactataggcacctgccaccacgcccgactaatttttatatttttaatagagatggggtttcaccatgttggtcaggctggtctcgaacgtctgacctcaggtgatccacccaccttggccttccaaagtgctgggattacaggcgtgagccactgcgcccagctgatacttattcttgtgcacgtgtttctgtagaagtggggttactggcttacagggtgtatgcactgagaattttcataggtactgccaacctgcttttcaaagaagctggagtcatttaatccagtcccactgaagggtggaaagtgccccttgtcaaccctggtcagtgctggatcttagtagctgtcttcattcttgctgagctgataggcaaaaagggctaacttgtttacatttgtatttccctaatcactggtaagatggaacacatttttgtttgttaaatacatcaggttcagccgggtgcggtggctcacacctgtaatcccagcactttgggaggccgaggcgggtggatcatgaggtcaggagttcgagaccagcctgaccaacatggtgaaaccccgtctctactaaaaatacaaaaattagctgggcgtggtggtgcatacctataatcctagcgactggggaggctgaggcaggagagttgcttgaatccgggagagggaggttgcagtgagctgagatggcaccactgcactccagcctgaacgacagagcgagactccatctcaaaaaacaacaaaaaaaatcaggttcattacagatgctttgggtggggttgacatctctgattatcttgtggagaattccctctgacatggctgggctgcctttagaaagtgattccgttggccaggcgcggtggctcacgcctgtaatcctagcactttgggaggccgaggcgcgtggatcatgaggtcaggagattgagaccatcctggccaatatggtgaaactctgtctctactaaaaataaaaaaatgagttgggtgtggcggcatgtgcctgtaatcccggctactcaggaggctgaggcaggagaatcgcttgaaccagggagttggttgcagtgagccgagatcttgtcacagcactccagcctggcgacagagtgagactccgtctcaaaaaaaaaaaaaaaaaagaaaaagaaagtgattccatagctgatgtctcttggtggagaagtgggttttgccccctttgtttccttgacactgtccctgcaatctcactagtggtgtggtgttagaaagagatggctgctctgtgtgaccttagccagttcatttgtaaaatagaagcctcagttcatgtgtaaagtagaaatcataatggtcctttccccatggggttgttataggatgacctgagatagtgcaggttgcagtgcctgggactaagtaattgctcaataaataccagctatttgttgcgactggctgttaaccttctgtttaagaatgatagctgattaacagcctctaattatgctaaaaaatgttcctcttcctccttaatggcctcctccctccccatcccaatctgtgttcagtgcttggagggcttgttgttgcaatctcttcccacctttccatttctacgaccagcatctcagtttactgttggttctacctggaagcattacggcaacccctacccaccctgaaccgctcatgtgtgtgtctggtagggtcttttctctgtttaaaaacctcagtggcccctctcacctgcacagagtttacagtaagatttcttcacttggacactgttgaccctttgggccctgtgattttttttttttttttttttttttgagacggagtctcgctctgtcgcccaggctggagtgcggtggtgtgatcttggctcactgcaagctccgcctcccgggttcacgccattctcctgcctcccaagtagctgggaccacaggtgcccgccaccacgcctggctaattttttgtatttttagtagagacggggttttaccatgtgagccaggatggtcttgatctcctgacctcgtgatctgcccacctcggcctcccagagtgctgggattacaggcgtgagccagcgcgccgggtctgggccctgtgatttttgttgtggggctatcctgcgtgtcgaaggatgttgagcagcatccctggcctccacccactaaatgccagcaacacttccctccccctgctgtgacaaccaaaaatgcctccagacattgctgagtgtcctttggagggacagtcatcccggctgagaaccactgcgctcgtagtctgttttcagttcgcctttctggcttcctcctaccccctggtcattcttttgttctttggcttgcttggttcgttagccaccagctgtttctggggagcctaactgtgctaggcagtgggctgcactccttggcgttcccctggctggaagaccccgggtgctggccgcttttctgaatgtgttctggttgcgtatcatcctcagctatttgcttttgagtgggatgtcgttcccctacctaatctcaacctttgaagtcttacctgttctttcaagctaggcccagatgtgacgtcctccctgaagcctgccttgttccccaccccaccttggaatttgacctttcctacgcccttgccacatttcacataattgtgtgtgtgtgtggtgtctcctgcactgttatagcataagccccaaatggagtgagaagctgtgctcttcctagtgtcaggctttggaaagctggactgggcaattacaccggctagaaattctcctcaaatccatctttcaggccgggcacggtggcttgtgcctgtaatcccagcactttgggaggctgaggcaggcggatcacttgaggtcaggagtttgagaccagcctgggcaacatggtgaaaccccgtctgtactaaaaacacaaaaattagccgggcgtggtggcgcatgcctgtagtcccagctactcaggaggctgaggtgggaggattatcagaccctgggggaaggtcaagggtgcaatcccacttcactccagcctgggcgacagaatgagacgctgtcccccccccaccaaaaaaaatccatttttcccacagatgctgcaagagagctatttaaaatgcagcagctcatgccactgattaaaaccctttggtgcctccccagcacacacgagagaaagtccacgttcttggaagtggcacacaggtccaagatctggcctcgccactttctgcctgccttgggcggcaggcttgacctcatgtgaccgcccccactcacggctgtttttgctactgtctcccctgcctggagcagtggctttcagactgcagctcatgacctatttgtgtgtttggaagtgaattttgagggccctaaattttttttgacttgaatagaaaagaaaaacccagagtgcccgtaggtctaccattctcagacatagctggtgtgtccccatctagccactctaaaggagcctgtcccactcccgccagtcccatcccgtgttatttcctatgtgtcacttttcactctcggaaattgtcctctttgtttgtttgcttgcatcctgtctccctccttcacttgtgtgtggaggggccttgtgaacaaggatgttcagggctgtgtccctgggacctagaatgtaccaggcacatgtaatgagtcgggagggtgggggagcctgggggtgtgttgtgtgcagcgtggggctcagggcctgggaagataccgcgctgggcctcgttaactgccctgtgtgtgcaggcagctacatcaccacgatcggagtggatttcaagatccggaccgtggagatcaacggggagaaggtgaagctgcagatctgggacacagcggggcaggagcgcttccgcaccatcacctccacgtgagtccacacgcccactcccacccaacccgcgccactgacctgtggacacagttgagcgaccggtgcctggtcatggtggaaatgtcactggtgggtccctgaggctgtcgggaagtgagcctgttgttggctgtagtaggtggcgtttggctgcacccttcctggtcctgaagatgtgaggggggtgctgtgggggagtcgctgagcaccctggctggagtctggccggacagtggccatgttctatctccttggagagtcagccgaccctccggcccactgtgccgtcaccttacagagagagcagaatagcatttgcctcgctagggggttgcgaagtgccttgcccacccaggacttagtcgctgacaattcctcttggtaggtgtcagttatggcagctggagttggcctgtgcaggctcccgtcacctgcactgatgccttggaagtgacgctgtctagagacgaacacggtgcatgtcagcaggcccttccctacccttaaagctgttcctgggaaatccggccgcccaccggttgcccacctttgtggctgagctgcaggccggggggaagctgggctcctgcgcagatgggcagtgtccttcggagcggctcctggttattgggttgttagtggagcaggttttaggaaagagcagggtctgaaggggccgatttggagctgttgggctgtgtgtccttaggcaagttgccgaagctctctgcgctcgtttcctggagggcctgcctctgggattggcttccatgtggagggtgccaggtgctctgctgcaggcgtcaacgtgcgtgccggggtgtggtgtctggcagctctgtgtgcttggtgctgctgtcatcccatttgacagagggcgccctggaggggtccctcccagcggccaagcctgtgctccacacagtggcctgtgcagagtgaggggcggctgtctggctccacgggcacctccttggctctctcgagcagctcctctggaagtgacctcaggaaggcgaatgaggaagtcccagccagcggcccccttccttcccacagcatgaaagcccggcactccccaggctggctgcccctgcccccgggcccctcggcatctcccgagggtgggaagtgtggggtgcagcgcccccatggatggctgggagtatgggggagagcagggctgctggagagggacaggtgtgctgggcgagcagctcctggggctggagccaaggcggagggcttgtcactgggttcaccctatgctgagcacatttgtgctgtggcccgtgatgcccggaatccctgggagctcccagtcccggggtcgcccgggtgtggtgctgtgtggtgaccgttgatgagccctgtgagcgagggctctgtggcctgcatgtcttggcagctgccagtgagaatctgcggaggacactggggcagggctggcatcagtgctttgggcagcctggggctgcaggcccaggcgaggcaagccctcatgccgttggctggtctgggcgctgacctcatgaatccttgctctgggttggtcctgtcgctaggatttcagctgctttattttggttaatcccggtagagagacctgtgactatctccattttatggacaggaaaacaggcccagggaggatgaagcctcctaactcagtggggcagaggttgggggcactcagggttggccctgagtctgccgaggccctgcatcgactgggcaggtggcgcccctgccttcctgccccgtcctgtgccttaaaaccaggcggaggttcagggtggcagaggttcagaggcccgtggccatgaggaatgaactcctgggcagggcagtggggcctggggggtccgaggctctttcagcaggaggagccacagcccctccctgccatcatgcagtcagctgctttctgggctgggcagagcgggaagaaggtgaactggttcctccattccgtggggaggcggggaggagtcactcagcttcctgggagcaacatgggtttttccccaggggcttgggaaggggcggcctgtgggcagcggctgggcccctgctgccgtcccacgtgtctggggaagcagacaggtggctccatcttagagtcccgctctggccctcatgaggcaggaggcccagcagggccgccctgaggggccactggaagtctcgacgccctttgatggtcactggcaaagaaggaaggagttttggggaggtgaggagttttcaggaatagggcagtcaggatgcagtagcgtgacttttttccgatgcagggcgttcagagagaaactgaaactgcatcctgttagcctggcgagaaaaagccttgtggtcaccccttctcgggttcttgctctcagaagctgaggtttgccggccctgagaggtgcgggtgggatggaggtgaggggagaagtgacaaggaaggcaaggccctggcgttgggcctgggagtcagccctgggcgccaggacttccagctggccgctgcactcagcctcacgtccttgctggtcacatggccatcctgaggtctgctggatcaggtggctgcagacattaataaggtaatggataccaagcccccagctctgtgcctggcctagagcagagtccctgtgagtgaaggtgattcctggtggccatgggaaacgtcggtgctccggttcctcctagccagagctctgagcccctgacttcatccccagacaaattctctgctctcagataaagcccctttcctgggccccggatgaggcagaggcgcccagggagccgcgggggctgtgcgccggggccatggctgcaggcgtttcttggcatctctgatcatcttcagcaaaggagagtctgcagagccatccgctccttgggcttcctctgctggcaggggacagtcgcctgttcctgtggctccggcgcgccctcgctctggaaggcgtctgacacaccatgccatgtgctgacccggcgctctcagcagcagctgccaaggccagagctagttcttgggcccagtgccaagagagcttgatcgtcacagctaccccgaagccaaggagcgacgctgccctggaagcaaagctgtgggcagaatgaagccctgggaagagatcccagcggtcgtgttgaggatggagcaaggatggggcaggggcggtggcaggggcaggttgggctttgtcccagggctgggcaggagctctggctctgcagcatcagggaagatgctcagggctgcccctaagctgcctgttggtttccttccaccacctctgtctgggaccacagattgtccttgaaggcacattgatgatgctgaagaacgcatactgactgtttactgctcccccgccttggggtaatgcttagctcctttcttcctcatgaccaccccagttaaggactagccacctgtgtgctataactgttgaagctgcaaggtgtggcagggtgaatgcaggcaccttcccaagggccagcctttcagagatggagccagggttggtctttgtccttagatcgggcctcagatgtgaagcattggccagagagctgatgggcaggtggacaggaatggagctgcagccacaagtcagcctggctgccccattcttgctcagcctgcgctgacttgggctgttcctgaactggggcttgggctgtccccatgaacctcatgggggtggaggtaattagggctggggcaggtggcagccagaaagccgggaggaagcggcctgtccactcatggtttgtctgtgtgctgtcctgaggagccctggggtggaggtccctgcggctttggggagaggggacagagggacagctctggctgattgcacagtgtggggcggggctgccgcctggcctccggctcttcgacagctctcggggaagcggaggctgtggtccccctcctcctccggggattgatgtcgtcctgtgccactgggatgaatggggacatggggtctggagaggagagttgggcctccccttccttctggccttcctggctggccctgggctctgcatgtttggggtgatggctttgctgggcgccctctccccagccatccctggatgcttgtgtggcttccatgcttttcctgccacctgcacagatgagccaagagtagcaggaagggaggtgcctacctgccccaggggaggggcacagactttgccagggcgtcatgatggtgtggcttcttggaaaggttctctaaaacaggtttgaggagcaaatatttttttgaatgttcaaagacagtgataacatgatgtcaaatacaaaaactgcctgatttcccaaaataaagcaagaacttcaaagatgtttcaagcctgcagcagactctgaacagcaggaggtgactcctcagacctgctctgctgcccaggggctggccctcccgccctgttggtgccccgggcgggcagggggagtcagtgctgccgcagtagcctctcctgctggcctgttgtggctcgggggcatctgccgaggctgagtgagagcccaggctccagggccaccctcaccttttccgggtcagtgtcctgacgtgggcaggtgggtcccggcaagggggtgactcctgtcggggttgacatgctgccgcacactctggccctgcaggtattatcgggggacccacggggtcattgtggtttacgacgtcaccagtgccgagtcctttgtcaacgtcaagcggtggcttcacgaaatcaaccagaactgtgatgatgtgtgccgaatattaggtgaggctgcactcagggccgggtcggggttgggtgggagagaggcagccggctgcgcccctcagggctgcgctgactctgccttcgtttgaagtgggtaataagaatgacgaccctgagcggaaggtggtggagacggaagatgcctacaaattcgccgggcagatgggcatccagttgttcgagaccagcgccaaggagaatgtcaacgtggaagaggtgaggccctgggccactgtggctctgccacacacccgtggccgccttctccatgctgctggcctgcttgaggcatctaaatgaccaacagaaaatgtcatagtaactgccatttattgagtgcctactatgtgccaggccctttaacgatcttagttcatagttcaacagtcctctgaggtaggtacaattatacccacatttcaaatagggaaactgaggctccaagtgttgaagtaactcaaggaccaccacctggctagtaagagactgagtaaacctctgtcccacaccaaagccaagcacagtttccactccagtcctctgcctcattggccgccttgtgctgtgtggagcccagaggcctgtggaagtcgaggatcccactgcttcagggcacaggggccacacagcagcgggcacaggctcctttgtaagtcaggctggtgtcctgatgctggcccatccacctgggcctgtgggcaaggctggtatgaccttgggcggtgacttcacctctctgggccccacatgccatgaagtggcgtggagcaggcagaccccgggtcacctatgtccgtgaacagcaggggcactttcatctgtcatgtcataagattccagctgggccgggcgcgccggctcacgcctgtaatctcagtgctttgggaggccgaggcgggcggatcacgaggtcaggagatcgagaccatcctggctaacatggtggaaccctgtctctactaaaaatacaaaaaaattagccgggcgtggtggtgggcgcctgtagtcccagctactcgggaggctgaggcaggagaatggtgtgaaccagggaggcagagtttgcagtgagctgagatcacgccactgcactccagcctgggcgacagagcgagactccatctcacaaaaaaaaaaaaaaaaaaaagattccagctgaaggaaaggggttggtctctctaaaagaaggactggaaaacccctgtgagattgacttccccaagtccacacagctcatgggcctctgatggtgttccttttttcagacttatttatttgttgagtcagggtctaactctgtcatccaggctggagtgcagtggtgtgttcacagcccactgtagtctcgatctcctgggctcaagtaatcctcccaccttagcttctcaagtagctgggactacaggtgtgcaccaccactcccggctaatttttgtgttttttgtagaggtggggttttagcaatgttgttcctttttgacctttaaataaaataattcaccacctccttctagaataggctttgaagacatacataccaaaaatgcacaggtagaaagagctgggccccggaaggcggggaggcagccgtgcaggccagcaggggcctcctggccaggtctgaggcgggcccttcctctttcctctccacagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagtttaacaccaggatgtgtttccttagatttcctttcctaggcgatttccagggagagccctgattggacaatcacatcacagatcacactgcagtttccatgttagcactgtggatgggtttttaatcaataaaaactgggggtttcttctcaccgactctccacttgcccaaactgccaaaagctggtgattctgggacaggccttcactttggagccacgggatggggtgggggagccccatgggcctgggaaggagggtgctgtggagggggctgcagggctgaccagcaggcagcctcatctggtcgggggcgggggcggcaggagcagaagcggggtctccgtccttgggactgtcctggttggccacgggccctgaggatgcacggtgcctggggctcctgtgccggtgggcggggggcatgctggcctctgagcgatcaggcgaggccagcgagggtgtgcttgcaaattcaagcaataagaggggggttcctgggggcttccagcccaggctagaagcccccatggcttctggcagctggacatcagccccaggtattggggtgattttggtcatgacagtgtgcctgtcccactgttacacgcatgaatgggggttatggggtgggggtggggactcagggctggaccgacgtcctagtggacctgatgtgaaattcctgtcaa

SEQ ID NO: 15378 - DNA, 83516 bp, Human
aggccagatttgttgctttaaaacaaagcatatatggtggcttactatgatgtcaagcactgttcaaagcacattacaaagctgggcaggatggtgctcgcctatatttccagctactggggaagctaaagtgaggcgatcgcttgagcctaggagttcaaggctgcagtgagctatgatgttgccactgcactccaacttggtgacagagtgagacccactctctaaaacaaagacaaaaacacattttacaactgctaagccatctgcatgtgttcattaaaactttttctggggactttttctggctcatccctgtagtcccgatgctaggggaggttgaggcaaaatgatcgctagacagctggtatttgaggccagcctatgcaacatatcaaaaacccgtgtctatatgtagaaaaaatattaactaggcgtgatgacacaagcctgtagttccatctgcttgggaggctgaggcaggaggatggcttgagcctgggaatttgaagttccagtgagctatgattgtaccgctgcattccagcctgggtgacagagtgagacccctgtctctaaaaaacaaacaaatgacaacagcaacaacaacagaacactttttctgaagctagcaccatgcagttatgtactttataaattgctagtctaattccaagggaatagttcagcagctgatatttgagaaggacctgtagaaaggattcaaagaccacggacaccgtccactgtttttctgttttcctataagatagaagaaggatggcattattaatttatgccctgtttacctatcccaagtcccagatcactggatctttaaagattatgattctcgcttggcttttggtacaaaaggagacaaggagggagcttaaaaggtgagcacggtgtgattcaggactgaagcttctgccacttcctggggggtaactgcaaaagtgagccgttctgactagccgtttgtgcatttgccactgccaagggggcacaggtagattcaagctttggggctcttctgacaactggcaaggataaggtattagcaagggcaaaggaatagtaataaaataatccaataacaaagacatgaagatttataataatttttaggccggtgcagtgtttcaggactgtaatcctagggcgctttgggaggcccaggcgggaggatcgcttgaggccaggatttcgaggttaaggtgaactgcgctccagcctgggcaatagagtaacaccctgtctctaaaatgaaaagaaaacagtttaaaccttttaagtgcataccaaatcttttattttggagaaggaaaactggtctcgagttccgtgtgagctccctggggcccgccgggagggggttggcacggccggacctgcagcactagttctggccagggcgctgtgggatctgcaggggaccacaggatgctgtggcgcggtgcgctcagattggcggagaaacggccacacgcctacggagctactgagaaggcgagcggaggcgcagcccgcccgcccgccgcgggaaccccaggttggggcgctgggcgcgcgaagactcagccgccccgcccaccaagggcgcgtcggtccccggccgcagcctctgggctggcagccgccgccgcgccgcgctcccattggtgcccggcggtgacgcggccgagcgggccggggctgcctggtccgggggcgggcgtggggcgcggggcgcggagcgcgaggggcgggggccgggcgcactgctgatgaaacctggcgccggaacccgccagccctcggcgcccattcagtccgcgcaggcaggtgtgagcagcgggtcaactacctggcaggcgcgcacgcggccgcgggctcccgctaaccgcagcctccactcctctccccgcgcgccgcgcccccgccccgccccgccccgcccggtctcgccggccgagcgtccgttggtccttgagcgcgtccgacagtctgtctgttcgcgatcctgccggagcccccccgccgccggcttggtgagtgcccggccccgccaacgcagggggcagctccttgggcccgggtcatcacggagggggccctggcgccgcgtggggccgcggcagggcggcgcgggagtggcgagggcccccgcgccgggaacgctgccatcctctgggaagggccaggaccagggccgggcgggccccggagtgggcgagcggggctggtgcccatgcgactgtcgcctccacggagtccattttggctccctgaaaccgcggcgtggtgcatgatgcaacaccgagtgagtaagcgtgggcgatctggcgatgcccgctccgcgcgcctgtccggggacccgcgcgccgctacgcacggggtggtcggggtgcgtaggcgggcggcgggcacgggggccagactgggaggcacacggagcccgccggcggcgaggagaccttcccttacatggcgcggtgcagagcaccccgccccgccacgaggtccggggatgtgtcatcagccgtgggtggggactctgcccggccgcccggagggtggtcccgcggcaggtggccggcccagggactctgctgccatccccgcccggtggccgccctgacctagggcgcctggctctccgcttgtccctagaacccgggacgcgccgcctgcacctctcgtctgggtccccaagattgctttgaggaagtctcccctaggtgggcttccttgtgacccagtgtggcctggaaaggccgggttcctcaagccctccacatggtttggaatgagaggaagttcttccgcctttagcaagacaccgtattctcagggtgttcctttctgcgtagtagaaaacttcccaggcatgggcaggtcagagtcattctaaaacctgcgcgtacacagagcggcagctgcactgtagtactacaacagcctgctggttcagctcctgaccctttccaggggatgggggaaccagacagcagttgtgtttgacttgtgtgactaggatagtcagacatgtgccttcaggaaaaaaataaataaataacctacatttcccaatactcacgtcatcaccgccatgccctcatgtgttgggttttagtccagacatagttaccagatggttgagatttcaatcccaggtgtatctccctaaagaatgtgccttttatcttacttacattcgactagtagaattgtgtatgtcggcctctggccgaatgccctaattgtatttaattcgaattataatttatctgggatttttcctaacatttcttgccctttatgtttggttcagataataggaaaccatgatacatttattcctctggtatttttagttgatctcagtggaaattaccatgatttttatatgaacacaccctcctgttattaaaacaaaaggtcttatttaagtcacacgaacagaatagaaacttaggggaaaggtcaacaatagattaaaatggttttaaaaataggtttagcatattacgatcatgtttaattattataaaggtaaaattcaaaggatgtcaaaggagttttgagtaaagaggaaagggcttagtaagtagatcagaaatgtactcccttgtctgggtctggatcctagagccacgtgctcctgtacatatgattacttgctttaggtgaaaaaaaaaaagaaaggcttgaaagacaagactgttgacttcagggagttacaattttctatttggtagaagaactcattctttgatggaattaaatacgtgttgattgattattctggtctgtagtttattttaaccaaagtccatacaaatagataattatgttggagggctcagaattatgtccaattaaattaatcctttctcattatcaaccatgtatttggagggattgctattaatcctagggacaaatttgaaatgtgaataagtgcatccttgttatggagaaaaatattgtttccctctaaccttggagatacttgagtctcggagttatctcttccagaggcatcttcagagatgcctatcactccacctgcctcttggtcctcactccaagcaagaccttccgataggatgtggtgtttttctgtatagttggcccctgcagacctggatagattttaaaggcagatccaataggattggccggtggattcatggaaggacgagaaaggtcaaatatgactccaagcacatcggagttgctgtattaatgagatgggaaggctgagcaaagaacgtgttggatggaagagggactttttgaaagtcacaactgacctttttagaactcttatccccagggtcagggctggaagatgtatcttcttggggcccctctcaggtgcctgcctgtgtgttgcagccacccgtccaggctgctggcctccttccccttcacctagctttactggctcctctcgccaaatctggggggtctcttcagcctctgtctccttgctgcccatggcctccctttgctcccctgccgccttctagtgggccgcctggtggtggacttgtcctgtgggatggagaccctccatacatggggttcaaaggtcctggggtattcctggatcttcaggacatctgcctaccctcaggtttcccaggcctcgggtggggaggcatcagatccctggccaacctgctatccaccccagggtttagacctctcttcccgtgagggaacagagtagtagcttcatttgtggcagattatctgccttgtgataaactttagtggcctccctttctgttttgccataatctgcctcctcccccactcccatacccatctacaaagcagccttgaaaataaccacccctgtggttcagtgtgggtcatgatctgtcaatccaggcttagtacatttccaaatggaattaccagaaggatgggcatcaaactgggaaaatgatttggtggcttgctagccgtgttcctttttctcccaaggcattcgttcagatgtgcagtgttggcagacccaggggatgccatttacctggcccactggtcgagatttggtcatcccaggaacttgggcttcagaaaagatgtttctgggctttggaccagattctggctggtctgtggtttgcccctcctgccacacccagtggctttcattgggcttttttcctctagttattgtcaggaacagtggggaatggcaggtattgcatttggtgaacacactggataactggaatcagagccgtgtgactgagggaagaggccttcacagcttcaatgcagaatgggatgattatctgccctgaaacgaaggatgcttctttgaggggagttgggaccaatactgggaacagcaccgctcctggcttctctggctttgcttctctctgaagtaatttagacttcgtgaaccttacatactggctccatctgtatattgggagagcctgtccctctcagcctcacagtagtgaagttaggaagcatggagtccacagtgttctttgaaagaatcaaggcaccaagtccatgcatttacatttctctcttgagatcagtccttttgttagcagcctgcaattctgaccacggcaaccaaaaatttctgaccgtggcaaccaaaaatcaagcgcgaggaaacctgggggtttatttggaggtgggagaggatgtcccttcttctggtaggactatgtctggctacattgtctttccatttttttctgattgtccccttgcccccctcccttttctgggggcacagagggcatggcaattttgtttcctagctttccatattcctactgcagtgctttcttcagaatacttgttcagatcggattcttggctgtgagggcaaccagctgctttcctgtttctttaaaagtggatcccacactgccgtgtcctgcacagtgagttctgcgttgtagaaaccatctagcagtggtgactcagggagtggcctctgctcggtatggggcctctgcaacatgaggttatggggcttctacgctgtggggtcaaaggagacatcatgatccctactggcagaaagagcagagccccagagtgggttccacttacggggtcagtgtcttttctgagatattcctcggaaccacatttaaattctttttcatattgtttgcataataattgccttctagtgcctactttataggactgagaggatttaaatgagataatccatgttatggatttaacacagcctctggcacaagtctaaatgttgcatgtaagtgttaactattatactggaaagaaggctcagttccttgatttaggtgtgggagaaaaatatatatatattttgagatagggtcacactctgtcacccaggctggagtgcagtggtgcagtcacagcttgtattagcctccacctcctgggatcaagcgatcctcccacctcagcctctgaggtacctggaaccataggtgtgtaccaccacacccggctaatttttattttttattttttggtagagaagggatctcattatgttgcccaggctggtctcaaactcctggcctcaagtgatccacctgcctcgcctccctaaagtgctaggtttatggtcgtgagccacttagcctagccctgagaaaaataatttttacaacaacttaatttcgctctctcattttaccaaggcattaaaatgttgtgctctttccttgggtgggtttctaaattagaaggggcagacatagtcccagggtgctggaggagggatgcgggcctctgaggcatctgctgacaggttcaccatcccatctggtcccaggtctgagggaaggaacaatagtctctgggctgttttggctctgactgcctggatggacttgaagccatctctctttggaatcctgatgtctccctgagcatggggtgcaggtttgcttaggactcagacccatgcaccttgcgctcagtgacttctaggactcctgggaaacagagctctcagcccctttcttagtgtttgctgtgtgtgggtatgtgtatgtttatgtgtatgtgtatgtgtatgtgtatatgtatgtgtgtgtgtttggtggggggcaggacgggagtgactgccctggctacagtcatcccaaacatgttgttcaaattactccgaagcccttgggttttagaaaaagcaaagctgaaaagctgaaactctgggccgtgtttcccacctcactcatcccgtgcttgggtctgtaggataggatgtctccatacagcacaggggtggtgggcgacacccacctgggggcagcagtgagaaggcaggggctcatcctccccacaaagtggctggagttgatctgttatggacgtgttcgaagtgtccttctctgcatcttgtctgcttactgagtgccattagccaaagtctgttaggccaagtaggaaggaagggaggggccctggggctaggtaagatcaatcattgcaagcacttatttagtgctcaccatgtactctgcgctttatctatgtttcatttgaatcttcctaaccacccagtgggatcggcccttctggtgtgactgatggggagaggggaaggcaggtggcccacgggcacacaggtaggcagtcagtggcagagtgaagattggaacccagatgtctgcctgtacctggactccagcctgtctcgggataggcctggcctggcctgccctgtgtacactgagtgggaggcagacagatctgaagcccatctgcctgcgtccctctgtttctggctgagtccaggtggtgctggcaccggtcacccgccccaacgctggagggcaccctgcctcccctctctttgccctgatttccctctgctgtctctgaaagtgggtcttccccctcccaagtccaggcacctggcacagctggagccctggggtccttggggcagctgcgctgggacgtggccagtgtcaggagccggtgtgtgtgacggaggctgggctgcattctttctgggtcagtagtttggcatttacatcaccagcctttggctggatgcaatgcctcctgcccagaccacaatggagccttgtttgatttatcaccatccagccacgcccacactccacctccatctccacctggggagacccctttgcagggggtcttgtggaaatcagagactgttcgtaggggaaagtcagcttccttttctgtgttccatccttcttaaggccagtggccgctgtcatcctgcccttggcttggctttgctgatttctacaatatcttgcggaggtgccccctttccttagaggatgcatctttaacactctcagagaggctggggcaggagctgtccacaccagggcctgcagcaagggcccgtcttccccaaagtgacttgggagagtcttcctggcccgcagcttttccacagtgtcagggacacctcctgccctcccttgggatgaggcctggtctaggagctgggggcgttagggtgcagtttctgggacccagtgaaggcccctgggaaagactggcagttagagttaggagaactcttccctcatcccttttgcccttctccttttccccttttctttttcagcagtttttggataacatttcaaacttaaagaaaagttgcagaggccaggcatggtggctcacgcctgtaatcccagcactttgggaggctgaggcaaacagatcacttgaggccaggagtttgagaccagccctggccaacatggtgaaactcatgtctacgaaaaatacaaaagttagcctggtgttggtggcgcatgcctatagttgcagctactcgggaggctgagacacaggaatcacttgaacccgggaggcggaggttgcagggagccgagatcacaccactgcactccagcctgggtaacagagtgagatactgtctcaaaaaaaaaaaaaagaaagaaaagaaaagaaaatttgcaggagtgcaaggaactcctgggtaccgtctctcagatgcacaggtgggttatgttttgcctccttctattctctctccaccccacacaaactcacatgcacacagacacatacatttttttctgaaccatttgagagtcagctgaagacgtcatgccattttatttgccctctatacttcagtgtatatttcctaagaacaaggctcttctctcacataaccatggtacaatagcaaagtcaggaaatttaacattaatacaaccctgcgatctaggccacagtccatatttgacttgcagtcgtccacataatgtcctttatagctaagtatttttggggaaggagttttgcagtgtgggggttctttcaaaagaggtgtgattttctacctcataagcctttttaagaaaaagtgtttctaaaagttagaatgtttgttgtggaaaatttggaaactacagaaaattaaaagaaggagaaaataaaacccattcataattccagctcagaggctgagtgatcgaccagaaaggtggtggaaagactttctcagctccttcagctctggtgacctggccacacagactcgtgatccctccaccacccacacactagtcaggagccccgcagccaagtcctggggctgtgggaggagccggcccctgtctggagctgacggtctttcatgctcctgcccaccccttgggcaggtgcccaccgagcaggcagacttaaccagccttggtggtgcctttgtggtgcatatcctccaggtggggaagggtggagatcgttaataaatatccagaacttgtttgagacttgaaaagaaatgttgcaggcccactcttgtctggtctataccccttgcttcctggacttggcagaggttaaggatggggcctggagcgtgattgagggaaacagcactggccccatatcagtgagctcttgggtgcttcatgtggttgttagacttgccttttaatgagcctcttggcccctaccagtgggctacggaagaaataaaatgtgaaattttaccatgtgaagtttgctgtttgccaatgactgtgcttctcaaaagttcctagggaaaggttttaaaactggtgcaggtagtgaagtttggatctcgcttccctgctttgtccgcttaggtggtcccttcgccataacagctggaactgagagtggctctcccctttcctggcccagaacgggtctttgctaagcgagtctggtttctggaaggattttgttcttagaagctactacgtcattgtcctcagctccccatcatttgtacctcagtttccctgagctgtaagtctatgttatgtgtgaaaatgggcctctgaaggtcatgatcaaaagccttgagtatttttccatgtgtttgttttttctactccggccccagaccctctccttgaaggagctggccttgagagtgacttcggtgggcagccgcccagactccacacaccctgctgagtccacgtaacgcccaacctggacgggccagagctgaagggctactcttcaaagaaaccctttgaagtgcaaacatttcctttcctgaaaagaagggaaattgaaatgaaaacgtattgttctgtgcagacaatgttctcttcgatcaaagagggagtggggcttataaagggagatgcacaaattagagcttgatgtggccagtggtgtggatgtgaatattcatccctgtggaggaaaatagtggggtctctgagatttgtaagattgtattttccttttttttcttctttttccttaaggctctgaatctaggtctaacgttctatttaatgatgtctctcctttgtgtttttatcttgtggtaagcatttgggagtgtctttcagtaaatcatgataccatttccatgttagaatactatgtagccagtaagaatggcgttttcaaagaacatttgattttgtgggagaaactttaatgttaaaagtgaaaccatctgggtgcaatttcccatgttccgtgttagcttaatgagatatatgtatttgcacagaaagaaaagactggaaaaattggactttgtttttctcactgcagtgtttgtggcacctaaaatagtgctcaagaaatatttattgaatgactattcttataattagtaaaactgtatttaaaggaggaatgtctttgagctaatgttttggcaggtggatgggacaatatattattttaagtttctgttgtaattttgccctagcagctcagttctggtagattttgttctttggcacacatacataccccattttgcactttggtacaaattatactgtgaatgggtgactttgacatttatatttttggaagaatccagttctactgaaatcagagtatcagatgttgtctttttcctaatgttcccagatggggtagaattacagcttcttcttacttactctgtaactaaggaacctttgggccagtttgtcctgtcctgtggttgagaatttttgcctggtttgcccagggtttctcatccttgagcatccaaggctaccaagatacactgttcatatgtcgtcctggtttctaatggatagttatctaaaaatgcagcttcccattcttacctgcactgtaggttagcttggaagatgtccatccctggtctcagtggtcttgttcagggagggtgactgtcacagctgtcctttcctctctggtgagattgtttcattcctccttcaggcacttgggattcagagccctgttggctgcctcttctgtactgtcagcttagcacaggattctggaagcccggtgctgggaaagcctttctctgggctgtttgggatgggactactggttacccgcacacactggtactcactgggtgttcccgaggatggcggcttttaaacttctttgaccgcagtctacaataagaactaaatttacattgtaatcaagtacacacacagaggcacacatattgatatatagataaaatgaaaatttttatgaaacagtactcatttttactatctgtgatacgctgagataatttttattcttttctatttcattacaagaaaaattcctcgtggcaacttggagtttgcaaaacacactaggtttagacatatgagccacacctcacctgcaactccaccacattgtcctgaatttcatgttcactgctggcactaggggatgggagtcaattctccatccagaccagttagggcaaagaaagttgaagagtcaaggtttctttttgtggtgatttaggagtttctgactgaaggggacattattctctgtgatgatgcccaagaaagtgagtaggttttcagggcagacctgtgtgaattccccagtgtggtttgcttttgcatactggggtatctgtccttcgttaacctgacacagtggtgtcccaaaggtggcctggtcaggctgtatgtgagtttttagaaatgggccatacatttgttaatttcagtgctctgattttctttgagtttattttattcagcgtgatgcgacgaagaacctgtctgaaagagttaaggattttggggaagaagagtgagaaaagatactcatagaaatgttattttttgactaaatcttatgggttaatatcgaacggtattgaaactatattaacaatagcagccataccattaaatagttcttcttgaaaaggttggatggacttttgcttaagaaatgcttgaatgttttttctttttttttcttagaaaataaatgtctttaagtctgtgtatataattcacaaaacaattgtaaatcaagggaattgactctgcctaacaaaggtacaatgacataacagaactagaacaagataaatggcctcatttattgaaacaatgtgcaaatgtctgtccttgttcttgggaagtttcttttatttactatgcttctcaataaaaataaatttgttgtgagaactcagagtgcttactttacagtactcttaaaaattcatatagaagttacaaatattggccaggtgtggtggctcatacctgtaatcccagcactttgggaggccgaggcaggcagatcacctgaggtcaggagtttgagaccagcctggccaacatggtgaaaccccgtctctactaaaaacacaaaaaattagctgggcatggtggcgcagtacagctcccgagtagctgtagtcctagcagagggctgggtcccagctactagggagattgaggcaggagaatcacttaagcccaggaggtggaggttgcagtgagacgagatcgtgccattgcactccagcctgggcaacagagtgagactccgtctcaaaaaaaaaaaagaaaaaaaaagttacaaatattaccaccaccattgttggtatttgagaagaaacctcatgaacttgatctgatgctgttatatatgttaacgtttgaaataaatgatgactctgttattgcaagtgtaccacacttcccccacaaatctataacctcacagtttcagcagctaggttttttgtttgtttgtttgtttttttaacttttgttggaagacatttcttttttcagattgctttctttccagagggcaatcttgggagaaattaagcaagagcactcattagttctgtgagtaattttattgaactgggaagaatgtctgtcttgctggtctcagagtttgatacaattagaattttagaaaattatcagatctaatttgtgctgggattcaggcctaattactgaaagactctgtggtctgatgagtcaaggtgagggcattgccgtctcatgtttcttgggtgatttggagtagggcagtggccaggggaggtgaaagctctctgcacaaatccaagtcactttcctgcggctcctggttgcccatgagtggtcctgtgtggagcatctgcaagggaggtcttgctgagtcaccctgcatagagtttgagttgctggaagagttgaagtctactaagagctgctggccttgacccacagaggtcccagcaagagtctctttccagcaaagtgtcctgctgtgtgaaggaagaaagcacgattccaccctggggaggtacttgggagcagggacagagggaaagcatgggtttctcaacacggatgctttgtgggagcaagcaatactgccccatatccaaatgagcagtgactcaaacatttgagttctgggaattgcccttgttcctagacttccttgaaggaacagaactgtgggggcacacttttactgtgcatgcgggcacgggtgtgggctcctttacagttctggggtggggcctgaaggccacatcgctgccaggtctagacctaatgagggacctgcacctaaagatgcaagctgtgtaaaataaaaagttgaaaagttaaacctggggataagactaactggagcgtattgtttctggaaatgtagcacacaaagcaggaaacatttccattgtagttgtgtacattgggtgcattttgtaacagtcctgttcattatgactgttactccttcattgctatctaaagagcgtgtaggtaggtaaggtcatatggattgggcagaagtggcagtaggagtgggcagtaaggatagaaggaacgtatctcagtgagtgtgcaagttaagtacttggcataatgtaatagtgcctttcatatcctaaggtcatactgtgggtatctttaaactgtctagaccacacgtgcatacaaatcctcccctggggatctcctgaaatgcacattctgatttgggagctcagggagggggtctgagagactgcatttctaaccagctctcagggtcacttggagtagcaagcacctccaaaactgctggaacctggaacaactgcagggagacctgatctgcccattagaccacatctccctgagggtctgggatgcatgtgtctttgtgcctcctgtaccaagagcagtgcctgctaggaagtggatgctcaaaatgatcttttcaactgaactgaagaggctgctgtcccagagtccgtttacgttagtggccttgggacggcaggggtgtggcgacccagtcatagcctgtacacttatttcggcccagcttggttatcgctttacagccgtctgcagataggatgtgtgaatttggcagcagaggcggggcttctggcaccggcaaggagtgatagctgagggcttggcagtgaggacaaggacagaacacccatggaagagagggaagaactcagtaactactgccatcagggataattagccgagtggcaagcagccctcctcatttcaagaggtctgtgttgtacacccacatgcaactctgtgcctcagtttcctcatttgaaaaatggagaaacttacagttcccctcttgtaggttatattaaggattgaagcttttagcgccttgccaggcttagcacgagagggcaataaacatgagttgcaattaggattggtgtgtaaagggttaagccccagccttcagggaggtttctccgagaagaaaaatcccattcctgaggttgcacataaatgtgttggtattttgccgctaaaggagtaggtgtaaattaacatgcaaagtgattcctccagaaggctgggggtggtgaaatgggcgaaggagaggttgctacttgttcgtcatcctcaggaaattcttaatggaagaggcagatgtcaggagctttctaattaatgggcagatgaggtgggagatgaacctgtcttgggggtgtgcctcaggggcaggcatggcgctgccagagctagcactggggtgaagttccagggacccttgcccgtaagaccttaaaccagaatgccacttagaggggacagcgcatgcttggctgtatgctgtagtgtttaagcctctttgcagctgacttatatttggttctttaaaagtcttagaagtggctggctaaaggtaacggggtgctgaagcatggctcccacacatctctgtcaccccaaaggtgctgggcacgagtattcagggaaaccttggctgtgtctgacctatgtttacttcagagctttatgcctagcacgggggtttgcacagggacattgaaagtaagaaagaagagagcaaagtagatgggtctctcggaaggctttgaaggggtcccaagcttctgtattttctgcaaacgcctgtgaaaactcccagaacattccttgatcaaaatggttttcttgtaccttctcacagggagagaagcgagggtgggggcagggtcgggatgtcatgggaatggaacgttcttaagctcagttgtatgtgatttttatttttctctgttgcctggttcattaattcataaactcccttagaaggctaaacagttcattagaaatatcctatttctgttaaatagcatagaaacatgtcatttacatttttctttaaaactcagaacttgagatcacttctgtaaaatgtgagccaaggctggctcttctccgggaggctctggcggtggtgggaatgtggggttcaggggatagagggcacttgcagtttaccctgtgactttgggtagcttttgaatttttgagccgtgtgtgtattgccttgttgaaaatcccatcatggcattgcttctttggggaaatctgatttcgtttgtatggtacctcttgcaggaatgtagagggtagcttttaatcaccttcagtctctagaaactggcatattattcatttgcctcagcaggcgttaagattaacaacatattccatgggtgaaacttcgcagttgggcccaggaatagtctctctgctttatagcactcatcaccttgctggagagggaaaatcaatcaggtaaggagacatgtcttgattgtttagtgaagcagccacgtgaggaaattaagacttgtttccaggtgtgaaaaaggcctatgaaggaggaggctctgccagccattgaaagtgtgttctccgcatgtgtttatgtattgtctgggcatgaagaggggtaacatggaatagatctcaaaacggggaggcagttatgaaggcactgagaaataaatgtagaaaagcagagaggaagcacggtgtaggaatcctggactcttaacagagcttgaagtaccttggagcctgagaacccagacatgtcccctcctgcctggcctcgggagtcctcctggggacttatcacacttgctgcatggcagttcctggatgcactggcccctcagcagtcacggcctggagttagagagaccttcaccccacaggctcagccatggactcatgtgatcctgggcaagaggcaggttctccaggccacattttttgccttgggggtctgaagagcttgcactaagatgctaccctctgtgaggtttccagccctaaacaggaagtcagggacattccatgattatggatccgccaaagagctctgagcagtttggtgaccatgctgtgaaagtggatgttgagtgggaacaaccacgatcagatctagtaggaacaatgggtctggtaggaggacgacgacagagacctctagtagagaagtgttactttgcctgtgttagcccagaaacatggagcagggcaccggttcgaccagaaggagcagaatggctcttgtaaaaataaaaagcacttggtaccagcatgcttgtggtccaccaggtttgtgccccatcagaggaatactccggaggaacttgggccgttcagaatagtgtatttccagtgcagctctggaaagagtgagcagtcgtggaccaaacatttcatggtctgatgaaaagctagtggatgctggccaggtgcagtggcactttggaaggctgaggcgggtggatcacctgaggtcaggagtttgagactagcctggccaatatggcaaaaccctgtctctaataaaaatataaaaaaattagccaggcatggtggtgtgtgcctgtagtcccagctactcgggaggctgaggcaagagaatcgcttgaactcaggaggcggaggttgcagtgaaccaagattgcaacactgcattccagtctgggcaacagagtgagactccatctcaaaaaaaaaaaaaaattgctagtggatgcttatccattcatgacaggggcagccgtttcctggtgtcagatccctggccgtggtgtcctgttgtgcggggcgcctcaggtggagtttggaatgtcgggataggccatgagaagtttcagttccatactatctcaccagggaggaagcctgagagaagttatttttcaaaaggattagtgagccatacacatcaaaatatatacaggcttcatcaaaggaaagagacccagcttgaattgaggatgaagcatttccacagcagagtctggccgaagctctgtgttgagatatctagagagagctgtctgctgcctgaaaggtttcttgtagaaaacccttcatggtggcaccacttgtatctgtttctcttctgccctcctgagggacatacttttccccagcggaatgaagaaaaaggcaatattgaaagatgtgtgagagcgagagttcttgcctgctgccaggccccgcctgcggagagaagggcagggctgtggaaagaggccttgggtctgagaacaagaggactcattaaagtctgtggcttttgacaggctgtgacagggagccggggtattgagggatcacttttccagcattggtggatccttagtgggtttggagctctcagagtacccagtgaaaaggcaccgggcaagagctacccggggtgcccggttgaaccagtagcttgccgtgtcctctccagggagaaatagttcagggcagattgtgccagatttgcattcctctctgcagcccttccagggcttttgaaccacggctgggctctgggtagactcagctggggacagacggtggacactcggcacctttcttgggcctcacaacgtttgcccaaggtcctttaggtttgccttagcagatgtgatcctgccgatgacagggtattcttatctacacttgcagatgtgtgtgtattaaaataacacgcccttggattgaacagagcacactcagctgtgccactgagttcacgtaaggtttgcagtaggacaaaggatggcaaagagttcgatttgcaaaaaacaaaaaaaaaacttcagttgtgcagcccaagttcagatgtcttaaatatctgctctccggacagaaatctgataagggttgtgctacaggagaggggaaatctcatttgccagcccctaagaaggcttggcttttgtttggggatggcaaggacttcctaagagggttgactgaaagatcccgaaaatgagagtaagaaatgccctcagagtctcaaatgccacaggccacagcaaggagaaccacggacttagtgaccagctctagaagtcagcacgtgttccttctcagaacttgcaaatgttttagaacaaatgaaaagcaaacaggactttccacagctggtgacaaactgacccaagcagagggagtggaggaggagagggtctcgggctccagaagaacgtggttctccttggttgcccagcacgcgggggctagcggtgcttggggtgatcacaaatcttttgcaaatgctgtcatgggacatgccagcccacaaagcctgctttgtgagctcctccaaagacaggacactcggccagagacgactaaggttgaccaagatattatttcttgtgatcttggccgtccaagtacaggctatgtggcatttcagtgaggagcaggacaacttggtggccaagaggcccgtcagagctgcctggcttgcattctgcacgtcattgcaaagcaagttgcagccccagcgtggacacaactctcttggagacaaatttcagatttccctgttctctccagtgtgtgttttccacctgtccccctttacttgggacttcccagagccacacgcccagaagacactgccactcttcagttagtgtcacttctcctacactgggcatccagcttcctccacagcctcaccaaccccctcaccagcgaggtacttggagctgactcgtgtatttggctccaactgtgggagcctgctgaatctggcgcctggctctggctaaccctgacctagttgggtgggagttcagagtcagagctggatgccagcctggccaccagcttgaggtgtggagaaaagccccagacgtcttcaccaacaaagtggctgggagagaaggtggctactgaggtgcagggagaggaagcccctgccccatccgaccattgagttcactgtaccttttgccgattcaggctacagtaaaagaccttatgccaaatttcatttgaattttagaattcaccttgtgtttcactctggataaagcaatttgtaaacttctgtaatggtatttaaatttaggtgattaaaaaaagacaaccagtgatggaggtgacaggctaggaccagggcccctctgacccagagctacctgaatgggaagaggagtagaggtgttggcgccagacagacctgggttctagcctggtctctggtgctgaccggctgtaggaacctgctgcaggccttcctctgcccacttgccaggtgccaacttccagggtgtccgagaatcgaggcaatggttggccaattctcagtacagagctgcgcatttatcagttgggcagcagataccagtttccttttttttttcctcctcattctttcatttagtttcaaatggcactagagatggtgcatctgttgtcctggaagcccacagggcactcacggaacaaggccgctcagcaaatgaacagaccaagtggaccatcgggatggcccagacatcctgtcctgtcccctccttctctcactttctgcagctccaccaagtataggtttgatttgaacttggtactattggtgtcagcctttggaatgtagggagagtgtatgaccctgagaaacagtgatacaatgcaagtaactgattcccaatttcaacaccatgtcagttgcattagctagttctctgctgttagaaaattgttcagtcttatctgaatatagtttgtgtggttcttcctacctgcaggaagctttaaatttcttttgttttctttcctttttttttttttttttttttttttaaaaaacaggatctcatactgatacccaggctgaagtgcagtggcgtgatcacagctcactgcagccttgacctcctgggttgaagcaatcctcctgcctcagcttcctgaataactgggactacaggtgcactccaccacacctggttaattttttagaatagtttttgtagagacagagctttgctatgttctccaagctattctcaaactcctggcctcaagggatcctcctatttcagcctccgagagtgctaggattataggcatgagctaccacacgtggcctaaatttcttgataattccaccagttatcaagccatgagttcatgttgttgttcatgtgagcactaggcaacattaagcattaatgatatttggtgaaaattaataaaagatgtactttcagctctgaatggggagctctgtaggcctttctggaagttgcagggcagaggcaggtgaccacagtgggcactcatgtccctcaaacagggacagaaatctctttctttgagccaactttgaaaaagtttgtactgtattgaaaatagactacatttggaatctaaactttttagacattggtatgaaaaacctttggtttagtttgtacgtaaacttacttttaggctcactgttaactgtgtcataaaatacctaaaagtagatattttacgggattcgggggcagaagtatggcacatttgttttatggcaagtaatacttaatagcatatccaagagctaaatacatctttagttcagactcttatttaagtttgtaaattctaaagttgagtcctttagcacaaaggaaagtttacagaagcaaaacaagtaaaggtttctctttaaaaattcaaaatatactggggatttatcataagttagaggcagtatacagcactcggcttttaaaactatgtcttcttctttttttgttgtttgagtttactgttttgagaagatctgcctgggcattcttccagcacagatcaagagaaattggcaccgggtagaataatacctttatatataaataagaaaatcatggtgttcttaggtgtttgtttgattaaatgctcctgtaactaaagaacagttgcaacggtaacacaaaggggcctagaaaaagtgccttctgaacaagattagcttgagtttaggaggtggtagcttttcttctctgctttatttttgtgaatcttagcatatgcttcattaggtagaacaggtgtttttgttcatttgtttggtttgggcccaggacagatacttgtgatttgtgctgcaaataatcctctgctgacagactggttaaaaagtaaagaagtattagctgctctggccacgcacggtggctcatgccggtaatcccagcactttgggaggccgaggcaggtggatcacgaggtcaggagatcgagaccatcctggccaacatggtgaaaccccgtctatactgaaatacaaaaaaattagccagtcatggtggcgcgcacctgtagtcccagctacttgggaggctgaggcaggggaatggcgtgaacccaggaggcggagcttgcagtgagccgagatcgcaccactgcactcaagcctggtgacagagcaagactccgtctcaaaaaaaaaaaaaaaaaaaagcattagctgctccagtgagtgctacgaaatgttaaggtttaccctagaccttggctttccatttttatgtaagatttcaaatttcaaaacaggctctttgagaagacagcctccattcatgtattcatttgttccacaggtattgggtgagctcctacaggtgctggcactgactttcccaggttcttgcccttatgggccataactcccacagatgagttcgtgttcttgttcacgtgagcactaggcaacattaagcgtcagtgatatttggtgaaaattaataaaaaatgtactttcagctctgaatggggagctctgtaggcctttctggaagttgcaaggcatctcccacagctagagtgataacacaggcagttggtcaagaaccctgttttttaatgattaagtgaatgaaagagaatgtcacactcttaccatctatcttcatccctttgtaaactaagctcctactattctactaaaactgctcacaatttcaatttcctctctcttgaattagacaatatcctgattttgtctcagtcctcaccccctgtggtgtctctgaaacatttaatacgattggccattcctttctacagattctctaattttctgggtctgttgaaggaggctttctttgttttcagcatgtgagagagcttgtcaaagaatggagtcattgcttgttagtagctgggtacgcagaaatgcctgtggaagtcagggttcatggtctgcggctagaaaggtgctgggcaaaggggaggtgttcaggcctgaggcctgagctgtcagtaccaaaccagggttaccaggtttagcaataaaaatactggatgcccagttaaatttgaattataaataagcaatggatactttttttagtataacttttttatactaaaagattatttgttggcaatatttgggacatcattgtgatatatttggggcatacttacattaaccaattattggtcattcacatgaaatttagatttaactgggcagtcctgtatttgatctgacagctctttgctaagttaccatccagtcacattgtcttttgtggctcctggtgcactttgaaaggggacgatgtgggccttaaggcagacacacagagtcagacactctctggctttagagaagtccgtctgcctttggactctagaattgcacctccccatcatctgtgtgctacttcctccttcagctgccagagtgtggtgttccccgcgattctggtaacagctgccttcttttctcccagggatctcactcccggcaacacgtgcctctgggtgtgctccacatccaagttcctcgtttcagattctcacagccccacctgcttgccagatagttctatctgttctgttggacacaggacatgtggcaagactgctttttgatccgaggatattttgactgtcatttaggaatataaatattttatcagatatatgtcatcaccaaagaattttttgatgacaatattgtcctgagtgaccttcagtttaaatcattgtgtttttagagcacaaataaaccatttacatttttcatgtttcgtgacattattctctccaggatagattatttgctatctgcattttcaagaaaggtttcttgtatttaccagccacttgtctgtggcagatctgacagctttgagcttctgtctctgtttctcctggaccacttatcccttccaagtggagttttcctccatcaaattgtgcagctttagatgttgattaccatgttgagttggcccttgcggttgtgtgtgttggctgcttctggttggtgtggttggtgtgcacagtcccatgcaggtttcccaggatcaccttccccgcccagtgctggtcaactgtagtgctcgtgcccatgttttatgagcttctgatcactttgtagattacaaactagggcagagaacgactgggggaaccagagtggtagggccacagtgccttactgagggccaccctcagctcagattcagtgcttccaaatccaagtttaggatttcagagttaccttgggctcattcccttcatattgatgataactgatggcatccggccagtccttcctcccctgcccctcacatggtcttcttgcttttcgttctagtcccacgccctggtgccgcgggtcctgagtgtttcttcccactccccaccctctgtctttccagcatcctcctgggtggcctctgtactttttctcccctgttaaattacactggcacctgcccctttaggtggcgcctgccattattgacagcgtgtgcgtggagtagaaaatccaatgagtgactcttgtgtgaagcgtcctggctctgccctgagggctggggggcccgcactggtccactgggcttctctgggcacagatgtgacttggtgtgggaccagatggcctagacagcgtgtcgcacttggagtcgcgcttgggacccacaggcggccgctgcaccctcaccacctgcgttttggggcagtgtcatgcatgccacaggcagcctcagacctgggcattggtgcctccttggccactggccatcaggcctgcttcccttgtgacatttcactttgacctttcctttgaaggtttttgaagcaacactgtacacgcaaaggtcaacaaagaagagtggatgataggtggacagaaatgtaagttaaaaggcaggaagtgaggctgcttaatacaagcaggttggaggggatgagcaaaacaaaaaatgcccttgaaatgattctttaatcatttgtctttagagacgtaaagcgggatatggaaaacaaacatttccattcaatgtatacacagtttgcaaaacaaataactgggctttgtgagtgtccagacctcctggaaggaggaaagcggctctggactgggcaatccttttccgcctgagttcagagtggaagaaattggagaagccgcccctctggtggaataggtaaagcaaaagcctttcatttccttaatgaagtgtaatgcttccaaatttggcccaaaagccaaactgagatggaaaggcctctgggtgagcgggactatccatgagtgaggaccccccggcagatgtctgatggtcacttcattgcgatctagaaaggccacagccatggccagctcttcaccaccctgcattcaggcaccgccaagggctttggtggttgatgctatagagcctgggacctttacatgtttaaatgttttaaaattaaaatcggccataaaatgtcattatgttatgtttttataattttcccattttgtttatgtttgtaatagttttaagtcaattttaatatttctgggcaacagccctcaagtcttccaccatctgaatcagggcagatggaaatacatcaaacaataaccttattttattttttaaactgtatatttgtatagtactttggtgattacaaaatacaatttttgctattttaatggcaaaaactgcaattatttttgcaccaacctaataccttcatatggtatggcaaaaacagttatcattttgggtacttaatcttcacagcactttataagttggctactaatgagatgtcttatacattaagaaactaataatagtaatatagttaacatatagcgcatactatgcaccaggtgctctgcagtgctttacatatataaattcattgaaacctcctcatcttgcaaaggagaaaagggagactcaaagaaattaaataacttgcccatctttttttttttttttgagacaaagtctctctttgttgcccagacccaagtgcagtggcatgatcatggctcactgccacctctacctccctaggctcaagtgatcctcccgtctcagcctccttggttgctgggactataagcacaagccaccatccctcgctaatttttttttcctgtattttgtagagacttggttttgctatgttgcccaggctggtctccaactccggggctcaagccatccatccgcctgacttggcctcccaaagtgctgggattatagacgtgagccaccgtgcccggtcccatcatgttttgaatccagtttaacctgagagtttaacttctatctgtctcactgtctcttgagcctcacaggaggaacaagatggaggtaggggggcgggtgtgggtgacactgtcattatccccgcttcagatggtagaactgaaacagcaacatagcgtaacttgttcaagttcacacagcgagggcagggcttctgattcctcatcagatccgtgagcaaatatgaaatgggacatggaaagaatttttctattcaatggcaagtcaataacgttgcttgatgcaaactgctaggcctttgtacccaggcacgtggcaggccgtggcctcctcctccatgctgagttcggggcagaggaggttcagcagagggaccactgcacatagcagagcagccattcgtttaatgccagaggaacatgtgaatgagcttccccaggattcacaggcaggtggggagctgctaggtaatttcacctgctggcccacccaggtaatgtgattatgtgaatgtggcattcagggagttctgtatgatgttagaaaacttttgtttctggttctgtttttcttttaatttgtgtaatgtgaccaggacgtctgtggccaggctagccagcagccgtgtgctttgtttgctggttggagcctggccagccatggaggtggatctgcgggcctttggggcgactcctgcctcagcctcctagagctctgataagcaccgctgaaactctttgaggttcagtgttctcatttatgaaatgaggactgatggttgcttttctaggtatgtgaaagacctagcacagtgtctgctgcataccagctgctcagatgttattgcattacattgaagaattttttaaaaatctgtcttgatagtgcaatgtgttgttgtaacctatcactagactcactgtgggtactcttgagaatgggctagtggtgattaatctggtgtccttaggagctcgatttagaaggaggagggctatcatgtgattattgcagcccccgcctcatgaggtcaagccctcacacttgcagtgggcctggtagctgcagacatccagagctcactgcccctaaggctgttgccatcaggggccctgcagggagcagagtgcattctcaggatgggcagtttgaggtgagtttaaataaagtgactttttacaaaggcagggcagggggttcacagcctggagtagtgagggggccctaaccacttctaacaccctcaacctgaggggaagggatggttttgaggctgcacctggcttggtgaagggccgatctccaatgagacagcccgcagagagggtcctccttcgcctcactcctccctgccagtgcccagagagctcgggatgcatacaggtgggcctcgtagtggggaaggcagggagtggctctgggggcaaacaggatgcgatttcagacatggggcagagagccaggtgccctcggctgagctgaggacaaaaacaagtcagatgagttgtgcagcccacatttttctttgctttagataggagtccgttcttaaaatggaatcaaagtgactggacagagacccgttttgatgaatttaagctggtggcttgttgggtaatcttccttcgcttgcttagaagcctggagacctgtgttcaggcgcgtctgagtcacttggtgtattaggacttgagttgccctgtggtaaaataaagggacggacttgatcagggcttatcaagcaagtggtctacagggccaggtagcacatattttaggctttgcggccacacaaggtctcagtctcatgatcatcatctcctttttcttctttctcttttttctccttccccttctttaaaaacacaatcttttacaaataaaaatcattcataattcatggtcaatacaaaagtgggcgaagcgccattgtgtgtcagctcctggactagatcgtcactcccctgtgtgctttgtgcactgctgtgtgcaaggtgattttagggaatgcacatgcgtttttattttaatggtatgtgagttctaatgtgtattaggaaaaatagatgactagcaccttaagagttcactacccatagttgtagctacgcggggccctccaggaaacagttggctctcgcaggctgagtggtggatgtgagttttaagacctgattccaggtaattttggtggtgctccatttatgagagtaatacatcgtcgtggttttttaaaaatttgcctaaattattaaaagatggattcctttaaggagaaatattataagggacagtgtccataccacacagagcagaacctcacagaagaggtacggggtagactgtggtctggagtggattagatcagctcactcctccccaacaccacattccttgattatcccacgttttagatgtagcctgttgggagcatttcacattgatgaaaatattctcagcactttgagaagttttgtgtaagtttagaggagaaaacaagagggcagagccattttttcgatggagtcctgactggcaggtgccaggcatgtggggtgcctgcccaccctgcccctctgtgaagagctgtcccctgggtgggagctctttggagtcaatccctcctagaagttagggccacctcaccctcaagggcatgcacgttccagcaacacagctagtgatttaggcccaggagaacaaattaagtccaaaaaaaaaagaggccaagacttgcaagagcttgcttaattccctttggtaattactggctgtcagtctccttgagcctgagcctgtgctgctctcccgagctcctggccacacccgagacttatttgtctttgtgggcttctttagaactgccgcactgtccgggttgcatccgtgggagggatgcccgcctgcagggagttgtacccagcagcttgtaaacacccaggagtgtggcaggagcttacctgtcaggtgtgccttggcagagaaaaggctgcggccaagccctttgagcattccgaacattcagtgtgggaagcatcccaaaatttgtctcccactcactgagttgggcatgtcttttcctatcctcccggatgacttttttgccctggtagtgagccctgatggccttaggaaatactgggctgggctaacagactgttccattttgactgcctgatgagcttttactcttctgcttacctatgtaagccaccctattctttttgagatcctggaccataggtatccacagagtgagagggcttcccttcccccacaccctgttttgacctaaaagcttaaaaaccacgtgtatggcattatttaaaccaaaaaatgctgcaacctgccccatttttattattctgcgccctgtcaccatgaaatatttaagctgcgtattaaaacaggagcttgtatttgcaatgtaacagaacaccagaagatgaggcggcagttgtagggagagtttatcaaataggagctaatttcaccctcgtgaaactctcaaagcagaatgacggttacatgtaataaatagcttgtgcaagtagagtggagagcctcttaccaacggcaactggagccatgatgattgatttctaggggagtggggtggtagagttttgacttgaagcagaattaaagtatgtgggagaaagtgctgccttagcaaccgaacttgaatagaagttcaagttcaaatctgcctgtcatggttagtgggaaaactatactggggtccctttggatagggctcctcttgactttttttacaaaaaatagttttataaatctgatttacatagtataaagctcacctattgaaagtataaattcagtgatttttagcaaattcacaggattatgcagccatcgccctaattctggaatattttcgtcacccctaaaaggaaactcgtacccattaacagtcattccccacccgtagccaagccgtacacaaccacttatttcctttttatctctatcctggacatttcatataagtggcatgacacggaatgtgaccctttatgtctggcttctttcacttagcatcgtgttttcaaggttcatccgtgttgcagcatatgtcagaatgtcattgctttttatggctgaataatattcctttgtctggatgtaccacatttcgtttatccattcagcagtcgatggacgtttgggttgtttctgctttttgcctattatgaataatgctactgtgaacattggtgtacattttcatgtggacacttgctttcctttatcttgagcattgaccttaatggaattgctgtattgtacctctgtgcactttttgaggaatcttcttagttgttttgttcttccgttttgaattgtaagtattttttaattgtgggacaatacacagaacaaaaattaccatcttagccatttttaagtgtgcagttcaatcacattaactacatttacattgttgtacaaccatcgctgctgccatccttttcttgggttttggcgaaacagtccacaccatctcttaggccccagaaaggataaataactttggctttgactcagcaaagaggtgggttagtaatgatcgaactcactgccttttgagaggtgtgagagtctagacagggtgatggttccttggcccagaaccgcaggatcccttctctgtatagatgctgctgcgttaggaagctttggataagaggagcaggatggggataacttgaagaggctgcccgagaactgggagcagggaaatggtaaggtgggctactgtctgcatcctgggggagcccaccgggcatgtttgagggacactgtctttcccgggcttttctccagggcataagtaggtgcacagaggcttctttttgtgtgtggtggactgagatccacctgtgtcctggcagatggcagaaagggatcctgagtataaaggtatgtggatcagatttactgagtcactggagagtgtacaagtgtggaccaaagtgtgtaagtgtgtttaaggaagaccgtcatagacctataagaggtcctggagaaggtgggcctagaccatcaacagcaggccccctcttccccacctcttgggaggccaatgccctggtgctccttgaaccctttgtgctcctccaggccctgttctgggaacgcctgctgggtctgttggccctgccctgaagtactccccaggcctcctttctctctctgctggccatcttgagattaccctgctgtattgtatttgtattgtttgtattgtactcatgcatcttcatgagcagctctcttatcttctcagtaacatagtcacctcctcactggaaaggtctgtattttatactcttttgggttaagtcactggcagacagaaacatcaatatcctaattcaggatggatgccacagtctgcccagttagctcattaattagataattctttaaaaatattgacaaaccattaattaagagctgattattcacacatcaaacaattcttcacttaaactagaggatttctttaaatagcagctccccctggctgcatttatctctttgtgtagtttattagctatttggcagagaaatttcagaatgccagctacaagccagtgcagttgaagaacagaatgtaatggagggaaagtatttctggaagcatgtcatttattcaaagaaattatctaagaatgtatttcttttgaaaagtgcttaatatatttatatatgtaatctctatttattttcttaaataattctgtgaatgtagcagtattttctgcattggagaaggcaggatattgagattcagagtaatttgcccaggcttattcagctagtccatggttgagcagggattgatatcaatgtcttcctcaggacctgtgcctcctcatcccattgcctctgactgcatttgctaagtgggaggatcgtccttgcatctaattaaacttgtactataatttcattatggctcttgccctaggggagctattataagtctggcatagagtttcagtagtattgaaaataatggagcatcgtggatttagagttagacgcacacactgaggtttgagccgagattccgcttcatagaacctactttatgcagctggttttttcacatgtgaagcaattgtaacagctgtataaccttcaaaggcttggcttaagtattaaatgagattacatactcatttaagaagaagtgccttaggagagggcactggtgcatcgtaggcacttaatagcagtgttagcctttgttattattattgtcagtgggcctataactgacttcacgggtgcatttattgttggctgagccagaggtgagctgtgcaggatagttggtgagagcatgtcaaatggaaggcgggaaatgactgagtggaaaatcagtgtattcttccagaccaccccttcctccagcccttgtcctcccttcctctttctccccactattttcctgtgttagtcatggttttccttttaccatcttgagaggattctggcattccgtgactgtgtggtccttccagctctccgagcttaggacttggtgtttttaaattctcattggccggcagagcatcacttggagagaagctgccctccccatggtgaaaactgcctctcaccggctaaagatggccttcccccaggagcaccaaaaccctgtcttttttgtgacaggaggactttttaataaattggcagtggtgccttagtttcagagttgagctacctttcctgagcatcagcatctcatccataaagtggggatgggtatccctgcatgtgctgggagacccatggacagcacagggtagtgctggcagtcccgtctcttcaagctgcccatcttctccatgctgcctgcagggcgaaggcatccccaacagttggacaagctgtcagtttcactcttagaaaccagagcctggattcattgcgatgggaaacttgtcttcgtctcctacgtcttttcatcctttactgctgttcttcccctgtttcttcttagttattctcctatctggttcagggacatcgagggtgttctccaggggcgtgatgacagagtttcgctttcctgtaaatatgtttgtgcctattttgcagacaatatttgtaatttttaatattacaatttaaatagtgaaacatcaaaaaacccacttaagtaaatttgtagaacattttgccgtccaccgttgcacacggtaaggcaggctttctctaccttggcacatcatggatcattctttgttgagggaactgccctgtgcatggtaggatttagctgtatccttagcctctgcctgctagttgaccaccatccttcaattgcgacaacctaaaatgtctccagacattgtcagatgtccttcagggacagagtcacccccagttgagagccactgcactgcagcccccgactctgtcctcccggcctctctcgttgccccttttggagccatcattagatttacaccagttggttagaatggctttctctagccttttgcagtgcacagcacagaaggagtttgtagccttttctcagagtattttgcatctcaaaggaaggatgaatcatgcaattttgagccaaatggtcttttcctgggtgcaaaatgagctggagtaattttaattattgaagggctggaggtaggataaatatcttactgtttcttccttgaccacatttcctttagcatttgtaagtattatagaaccacaaatattatatagattgtgtggtcttttcaacagcttttgcgtttacattttattgctgcctcagggattggacaggaactggtataggttccaaataacagtggaaccatgacagatattagaaattaggagaataccacaacaatgataactgtgcgaggtaatgcatatgttagttggccaggttcagtcatttcacagtgtaccggttgaggataccttatccaaaatgcttggaaccaggagcatttcggatttgggattttttcagattgaactatttgcattatacttaccagttggacattcctaatccaaaaaagtctgaaactgaaaatgctccagcgagcgtttcctttgagcatcatgttggtgctcaaagtttcagattttgaagcatttcagattttggatttttggatcagagacacccaacctgtgtatacactttaaaatatgatgttgtacatagtaaatacatacaattttgtctgtcaatgtgaaatataaaatgaaataatcttaaagaaagtaggggaagaactattgacattctcacgtggagacgaatccattctatgagtttgcctgggaactgttgagtaacagctggaacattcactgtcatcaggtgaaggacagggcgtgatcattgggaaactggcaggctgagaatatgctatgctgggatggaactacggaagtcaggaagtgtgggtccgtcaggaatgcaggggaacgtgatacttgacagttttggtttctagtaccatccatttgtgagccttgccattactctgtattactgcagttaacaagagtctggataaatctaagatttggactttcaggactggaaggctcaaggacagaggggatgcccccgtttctgtggtccagaaaaccctttgggaattgcagctttcagtgtgtctgcagaacagccgctgggatggtcagccattgatgcagtccggtggtgccatgtgtggggcccatcacaaaaggggcagaagggcctcagacctcgagagcctcagagggcagttctggattcttcggtgatgcctggggcctgcccttgtggttccagggacgctgaggtctttattgtgcacattaggttttgatttctgtcctccatcactctccttgaacagaaaagttatttcagtctcttagcccaatgcttttaacaaaaaactcatggaaatttcaagacaatatttatgtcaaaggataaattaaactaattgtagtttgccttttcagactagaaaccccctctttttacaacactctgacacccccgacatatcccctcgggagctgcctgggctgttccacaggaatctggccatcccaaagggcttgactgtcaccagaatcattggttgtagctattggttgacttcacagagttctccccactgccttgaactgtggtcccttgtagcttcattcttgataccccctcagcgcgtcaccactaactgtgacgtcgacctcctgctgggaaggagcacctgtgtgtatagttggggttcattctgtttctccttgtttcatgcagttactttaggagatgagaagtgtgctgccttcattagtgtttggtccgttcttagtttttgaagaggcattcccattaatagaacattaactcctcaaagatggggattttggtctagttagttcactgctgcatccccagtttctggaactacacctggcactcagtacataactgttgagtgaagaataggataagaacaggcgaaaccgctttgtaagttgccaaaaagttgggcattatgtttaataaaataaatataaagatttttttagtggttcttataagtgtacttagtggaaagacctgactccttttgatttataaatcgttcagtgggatatgttttctgatattttggggttattttatgcccggattttctcttggcctgccaggtgtccactgtaaatatacagtcatgagccccataatgatgttttggttgatcgtagacctcatctatgacagtagttccataaggttataatagatctgaaaaattcctgttgcttattgatgtcttagcctttgtgacattgtcctgctacacgttactcatgtgtttttggtggtgctggggttaacagacatactgcattgccagccatctaaaagtatagcacatgcaattaggtacagtacataatccttgataataaatgactgtgttattgggtttttactatgtaatagtaatacatacatacatagtaatatatatgtatatattaatgtaatataattaattaatgtaatatatgtatgtatatattatgtatatatgtaaatactaggtatttactatactatttatcgttattttagcgtgtagtcctacttacaagaaaagttaactgtaaaatcacctcaggcaggtatttcaggaagtatttcagaagaaggcattgttatcacaggagatcacagctccttgtgtgttcctgcccctgaagaccttccggtgggacaagacgtagaggtggaagacagtgacattgatcatcctggctatgtgtaggcccaggctaatgtgtttgtctgcatcttggtttttaagaaaaaagttgaaaaagtaaaaaaaaacaaaaaaattcaaaatagaaaaagcttatagaataaggacataaaaaatatttttgtacttctgtgtaatgttttgtgttttaagctgtgttattatgaaaaagtaagagttttaaaaaaaaggtccgggtgcaatggctcacgcctgtaatcccagcactttgggaggccgaggcgggcggatcacaaggtcaggagattgagaccatcctggctaacacggtgaaaccccgtctctactaaaaatacaaaaaattatccgggcacggtggcgggcgcctgtagtcccagcttcttgggaggctgaggcaggagaatggcgtgaacctgggaggcggagcttgcagtgagccgagatcgcgccactgcactccagcctgagcgacagagcgagactccatctcaaaaaaaaaaaaagagttacaaaaaagtttgtaaagtaaaaatgttgcggtaactaagcttaatttatgactgaagaaggaaaaatattttttacacatttagtgtagcttcagtgtacagtgttcctcaagtctccagcagtgtgcagtcatgtcctaggccttcacattcactccccgtcactcacattcactccccctcactcacattcactccccctcactcacattctctccccctcactcacattcactcccccctactcacattcactctgcctcactcacattcactccccccatacacattcactccccctcactcacattcactccccctcacattcactttccccctcattcacattcactcctccctcactcatattcactcctccctcacattcactcctcctcactcacattcactctcctcctcattcacattcactcccccccactcatattcactctccctcattcacattcactcccccctcactcattgacactcagggcaacttgcagtcctgcaggcttcgttcatggtaagttcatggtaccaatttttatcttttgtatcttattcttgctataccttttctatgtttccattcacagatacttaccattgtgtgactgttgcctacagtattcagtacagtaacatgctgtacaggtttgtaggctaggagccaaggctatcccatgcagcctaggtgtgcagtaggctatcccacctaggtttctgtcagtacactctaagtacactccaggatgttcacacaaggatgaaatcgcctaaaggtgcatttctcagaacacatccctatcattaagtcatgacacatgactgtattataatatagccacatggtgtcacaatcacacttttatagtccccacgtacccctggaagcccatcaagagtagtgttggaatgctgcttgcgatatttatgaaacaaatggaattaaactctttacgtctgaggcgtagcattgcattactctgcttttaacaaaggaattttcaaatctcaaaaattacaataaattggttggaacattcttggattaaagaaaagcagtgttaatgaatttatttgctatgcattccagtcccattaatcctgatgagttcatcctggcttaacatatggcatgcctttctttagacttttaagtttagcatgaactgcttttataccacgacaggagactatgactggagcaagcgttactgtggcaggctgctgaattcatgcctaagaggcaggagagcagcgttcttcctgttgagcatatattaagcttggctgtgttcatttcactgggcaaccttacaagcagtggttctcaaactgttgggtctggaacccctctgacacccttaaagagtatggaggactccaagaagctttccttatgtgggttgtgtctatcaatacttatgaattggaaattaaaattttggccgggtgcagtggcatacctctgtaatcccagcactttgagaggctgaggcaggtggattgcttgagctgaggaatttgagaccaacctgggcaatgtggcaaaaccctgtttctacaaaaaatacaaaaattagccaggcgtggtggtgtgcacctgtagtcccagctacttggggggctgatgtgggagaatcacctgagtctagggaggtcgaggcagcagtgagccaagattgtgccactgcattctgtcgcctgagtgacagagtgagaccctgtctaaaaaaaaagaaaattaaaatttagaacaacttgaaataaatgtcttaatttacctaaaataacaaggattaacccattttgtgttactataagtaacatttttatgaaaaatagctattttccagaacaaaaaaaaaatcagtgagaagagtggcattgttttacatatttgccagtgtctttaatgtttagcttatggcagctggattcatatatgtgcttctgcattcagtcagtttggacgtgttgttttagttgaagtatataaggaaaatatggcttcacagggatgtacctagaaagggaggaacactttagtggccttttcaggtaattgtagatattcttccttgatactatattaaaactccacaggcaatcgtgggttccgctgtggaatctgaagccatctcggtaagctctttgttctaaaataatgggtctgtcctgcacttcaaatcagtctgcacatttaggattctgttttactgaattacgtggatcttccaaatgctggcacatttcatcatatatttttaaaatatcccatttgttaacatcacccccagtgtcatcagaaaattcaacttttagggagctgtccacatcttggtgacgaatacaagttttctgaaattcccatttttttcttgaaagttcaaattttatcactcgcagcaaatgttgtcagttgtttcccttctagattctgcccgccccccctttttttttccagagttaactttttaaactacgaatcccaatcatggccccttggcagccaccctgcagtggggcaccaggatgctgtgtccctggtgggctgtgagcctgactttatcaaccttcatggttctcggtgctctcatggtacatgatagagcatcaagaaatagcagtaactgacagttagggacatttggttgtggactgtgttttaaatactattgaattaatgttcagttccactggtgtgatcatggcattacagtttggtaacacaatgtaattcttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccacaatgtaattcttagcagttacttattgacatatgtagaggtcagttgtcatggtggctatagcttgcttatcacgatggtcatgaggaaagcatatatttgtctaaagagggataaagcaaatatggcaaaacattaaatattgggaagtgtagataaagagtaagtattcattcaacttctgtaggtttgacattttcaacatagaaagtgaaaaggaatgaaatatcagtgtgggatgaattatcaatgtatgaaagacgatgtaggtgggaatagaataagattccaattgtgggaaatctggtttgctgctgtctaagttataaaactgtagctgttgattagcatctttatgtgcattttttgtgtaatgataatcttgtctgggttcacattaggtgcaaatcatatttcagacagcttaattaaacctcttcagctcctgggtgagtgcaagaatctgtgcagagtgtaaatggtaagatttagaaaacaaaggactttatatgccatgcatctatgaggttcttcgtagcgtgtcctcaggctgcgttcataccaggtactcccagtcactggccagcacgattccattccaaggcaacaaggtcctgcatcccagatttaggataaccttctgcccatgctgagactcttggtgttacgggcacgtgtatgctttgtgctgccatggcagctgttaatagtacccatagaactccatcactaaattctcgattgtacgaattggagtccaagtgttttcagaagacaccagctaaggttttctgcccctgctggccttgctggtcaataccagtgtcaggagcggactcgttccccttcatggcgcctgaccggggcctcagagcttttgcatgcctacgactatgccctagatttgtggaaattgccggtgtgacgcttttctatcttcctctttgaaatatgagagtcagtttcagaggtaaagcggtggaatctctggtgcggagggcatctattctggctccccatcttctccctgaattcccccgatgatgccccatggtgggcccctttgccgtcaaccctgtcttcagttgctgttaaggtggcatgtgcttcccgctgcagggctgagctgaatccgttttcactgtaccagccacagacttagagattctgaggttgaaactgaacatatctgatggctcttccttgcctttcaggattctgaaaccttccttgtatccctcctgagacatctttgctgcaagatcgaggctgtcctctggtgagaaggtggtgaggcttcccgtcatattccaggtacagtctgcctgtcagcacgacagcagaatatatgttattctgttttgtactagaatatgttattcatttagactgctagttgtctgttgactttttaagttaactgtcaactaaaacccccagttgtcttcttttttagatttccaaatgctgtaatttttcagactcatgtggctacctgtccagacccattgacccagcagaaaacaagcttgtcttctcactttagtgtgttccttaaattcctgcatttccttcagacagaactcttcatatcctacggctggccaggccttccgtccctgaggcctggtcaccagggtaggctctggggaaggatcagcctggagctgtccctcatcattcctggcatggacattgggcgctgtgtctcgtgctctgtgtgccacccagctcctgggcactggcttgcagcacagcggctgtgatgcgtcctgccatgtttctctctgtgactcttggagtctttgcacttctcaaggtcaagggctgcttccagttttcttcctgccccagaacttttcatcttgctcccattcttctcactcttctccttactcctctttctctcccttttacttaggaattctgctgtaactcgttcttggtttaggtgctgtaaccatctgctctagggcagtggtatttcaggctgttccttgcagcttgagagttaattccaagtgggcataagagccaagtggggcaggggggcggtcaaggctggccagtgaggctgtctgtcccctaactctctttaaatatgagtagcttcatttttatctgattcttctatttgggtttggcatagcatgtagtttgggtgccgagaccagcttggtcggagaccctaacccagcggcgctagaggaattgaagaaacacacacagaaatatagaatgtggagtgggaaattggggctgacggccttcagagctgagagcctcgaacagagatttacccacatatttattgacagcaagccagtgataagcattatttctatagattatagatttactaaaagtattccttacgggaaacaaagggatgggtctggctagttatctgcagcaggaacatgtccttaaggcacagatcggtcttgataatgtttgtggtttaggaacacctttaagcggttttccatcctcggtgggccaggtgttccttgccctcattccggtaaaccaacgaccttcaatgtgggcgtcatggccatcatggacatgtcacagtgctgcagagattttgtttatggccagttttggggccagtttttggccagatttgggggcctgttcccaacatttgggaaaaagagttccactataaaatactttaaactaattgctctggtcatttttccattaaactaaaaatgtttactgagtatggagtcttcatcattatcattgatattttatcacaaaaaatagagggaaaactcttcagttgagggaaagtgtgtgtgtgtgtctgtgtgtgtgtgtgtgtgtgtgtgtgtgtgtgtaatgaccctcacctgacttgtctcccactctcttacattcttaacagtcatttgaggcagttcatatcgttaattctgagactatggctatattaggaatgcacacatacttaggctcagcagcccacacagagttcttaatcagaaggacttctgggggatatagccagtgacctttgccacatgtaagcaactttgagcagcctgccttgaaataagaattaaggaggaaggaggggctgcccataagcttcaagttcctggggaggattaggctataagtaagcaccttgtttatgaggctgctactaccttgtaaatgtcagaaacaaaggtgcagaattaccaggtgcaccttcccaaaggcggtgggtaaaattagctgctggccagcagggaagtgggaggacattctgcacaggccagaagccactgtgtgttggggtatgtgagccttgagcacccttttctttccttccctgtttaggtgcttaattagtagcatgacttaaattagagtgagttcattctgcattcttccccgcgccgccccagtcagatgtgtttctgctgtcttaacagactattttagaacatcttctggtgttacctaacactggggctgggcgttgacacctgagtgaatagcctaagtcagagtcttccgcttcttgggctgggcagtgcattatcaaggtgtgaggggaagcccttgggtggtgttggggcacaagtcttgaaccctgtctgaattgggggaatttatggcttactgggcaccgccatgatgtcatcttttcctgttgaagagaatcaggccaggtgccagatggtaacatagttgccacatctcctggaggcctttcggtcttggccacgcttgttgtttggtttatcacattctgtcttctctcttctgttctgttccctgctcttcctcagcctctgcaaagagggagggcacacagtaggtgcataataggtggttgttgcatggatcgatcattgtgaacagttacttgcttgcttctttctttccagactgtgcactctgagggcagggacgatgtgtggtctcatctttatagctcccataacttcctacgaccatggcccaaggaagatcacccaatttttaaaaaaatgaaataacagctacttaatgtatgccatttttccaggaggaggaaattactttcaaatcattcagactccattaagatgaaatagcttcaggcgaagttgtggttatccccaccattgaagcaatgtattaaagaaaggttgctgctctggttcttagccccccaaggattcagtgagcaaatgaacaccagttcactcattatcacacaagagtgtttggaccatttattagtcatctgtttctctggcttaaaacaacacacatcttactttctcaatgtttctgtgggccaggaatcagcaggagtcagagctcagctggcgcctatgcttggggtctcacagggctacagtctggatgctggcctgggcttggttttcatctggaggcttgactggagaagtgtcctcttccacattccctcaggttgttggctgaattcacgttctctagttgtagaactgagtcctggcctctttttggccgacatgcaggctgctgtcagctcccagaggccactcgcagttcctagcagctgcctgcatctcccagaagccatctgcagttggttgtcacatgggcttccccagcatggctgcttgtctcatcaagccagcccagcacaggtcacctttccttaatccttgaaagggggagttgaaaagtgatttccatctgctgtctatttttataagaaattattttgctccttgattttttttctacatttgtccctgattttaagtcttctacagggtcacagccccacaggactcatttacccttgcagccagcatggatgccctgagccgtcactggccctgctggctggtgggtggctctggagtgcccagtccgactttaggagcgaggtgggttaaatggctttttgtgagctgccttggaatttaactgcagttttgtcatgttgtttgtatacgaaaatgtggtcttgggtctcagatgactggcatgtcagtgaacttttagcaggcaagaggtccttacagtaggtttttctgtggcagtggagactgcagagaatattatttggggcatatgttaaaatgtctcttttcagcctttaagaattccttaaaaaacaatagaagtggctgggcatggttgctcacacctgtaatcccaggactttgtgaggctgaggtgggtggatcacttggggtcgttcaagaccagcctggccaacatggtgaaaccccgtctctactaaaaaaatacaaaaattaactgggtgtggtgatgtgtgcctctagtcccagctactcaggaggctgaggtgggaggattgcttgaacccaggaggcggaggctacagtgagccgagatggtgcccctgcactccagcctgggctacagagcaagactccatctcagaaaacaaacaaacaatagatgtaacctgtgctctccttttctcctgattctgtgaaaatgtagagtctgactgtcacaaagccataaccaaaaaaggaacaattttgattatgcccggtttggaatatttgagttgaatgttggcatattgaggggctggctctggggtcaatttggggtggcactccagagtgacagtgtgtggtcatggtattggtctggtgccttcgatgaaagcaatgcaggtggcactgcctgtgacagatgataaaatatggaccacgtggtgtgctgaaagggccactccacccttcaccccctctggcactctcatgcggtgggaaggaatggcactggtcccgcatcctgggctgccttgttcttcgctggcttcctcctggtccacgggtacggttttctcctggtctttgatcattcaggtgagcatgcgggcaattggccatttgtttccagatacctgaaaggaatttcaggtaaattgaattgcattctcctctctgatagaggctattctcttagtgcccactagcacgtccgctccacgtaaagaggaggcctcctcattagaaaagtacaaccagtacttgttgaagactgaagacaggcaaggtggtcagccaggccaagaggctgtgacattcctttcagattagaagtcagattaaaagtgtgttccttctggagtgagtgtctgaaattctggtcaccagtgaaaaagtgtggttgtgagtagggcaggaagacctaccataaaatgtggcgtttcctggtgggaattacttatgcatgacatgaactgcgtagataatccccatggtaactacgggtgtgtgttttacgtgtgtgtcagggctctttgagaataaaacagggaccggggaacaaatagatcaatatgaaaggtcacagcatttgcttacgcaaaggtgttatattagttggattaaaatattgtgctgtaaggcaagcatattgatttcctacctaaaaggagaaggctggaccttgagaagctggaagtcctcgtgctctgtatttttcccctccggtgtttcttacatagaccaggttagtctgcccaagatcatgttttatggatgctcttcctttgcttaaaacttttgcttctaaataaaggtgtaaatcccttagctggccactgaagacccctaaaggggccaccctgccctgccccaagtcacagatcacagaccagggtgccagcctcgcccggttactgacatgccacctgttgtccagtgggcatgggttccatctccccagtgaggctgttacctgtcaaaaggtaaggaaggggtgaaccgcaaaattcacttgcgttccttccaatgtatagctcctaaccgtgtgtgcctaacgttttagacagcaccagcttttgaatagcctgtgaactactcctaagtctgttctttggtactcatatcagcttttctggtggaggctatcgggtgagagagggttgcttttcagtctgacttgccattgattcagacttaggcccagagaagtgtctcaggacaccaccgggagagttaaggacaggtctgcctgttacacttccgtgactcttggctgtttttctatgtcattatcaaatatggctgaatattgacagtttcatagggctcaacctaatcccatataaaagacgctttaactagttaacatgtggctgtcacttacagcattttggggctgtcctggcactggggttgtggagtagggtacttggtgcaggtagtggagtttcctcggtgttttttgggtcagccccagacgaagtcctttgtttttacatttaattttggaaatttccaaacatgcacaaatgagaaaagcataatgaagccccgtgtacccgcttatcagcttctcctagacagactcgaggtgggcttggcttgtcctgggaccctcatgccttcctttgttctccctctttgttggtttcattacaagagattttctttcccttaattcagaagcattacatactcattatttaaaaattgtcgaaatatggaaggaaccactcataatcttctgtctagagacaaatgcctcacttcttcctgcactacaattctttgtatacacttatttttatgttataattttttttaaggattgctataatgttgttttgacactttttctctaatgtaacacgtaatccatctgctttatctgccacttccttccacataccctttccaggcctctgctatctgtatcctttccacaactttccgccgaagccccggttgggtcctgcagccaaaattacccacttttcctcagtcccagataaagttcctgttacctcacagccagcgggtcttggctagcagctggctggatgggaagtggatggattacgttgattcactccacggcatgaataataatgggcttcatttttacaggggtatcacatttaagaagaggttgtcacttaactcatgactcttttatatttgtaggatttcagacagggtaacaaataaagtaagaattatcaggcagcagggagaatgagcttggtcaaagttgagtcagtttggcacctggcagggaatagggtttcaggaattagatgacctgggttcaaatcctggcttcactattacaagttacgtgacagcaggcaatataatctgccagctacactccgcgctcttattcttacaagaggattagcaattgtgactcgattgcttccttgtggggatttaatgcagcagtgcatgtgtgtggcgtggagctggtgttgtgtgatgttggctgtttctagcaggccccgctcactgtgaggctgttcttcaggtcatttcctgggctgtgccccattgttcatagcttttctttgtctcctctcgaaccagtgaattttctaggagttccaagtttttttcacaaaaaaaagttgctcgtgatggtggggagactgggggagaagtgaaaatttccaggagtttatggattaaggtgttcccaggcctatgtgtgaattggtggactgcctgagtttattaaaggtttgttgagtgaataaatgagtgagtgggaaaatatcagtctgtgaatgtccagtgaaaattaagttaggttggcatggaaccctctgctttgctctcgtttgcaatgctgattctccttttgcttttggaagaggaaatatttagaaggagggaaagaaaactaatttaactgccaggaaaccttagaggctcagaaaattaaagtgccagtgttctaatcttgggggaactttgtttaaaacatttctttttaaataaatgaacaaatttgtttaaagaacaagtttcttctgagatgtgagagccagttccatagccatttccaaggcccgaatgcagtgccggcagggaacttaaagcctgtttcgtggaagctcccactgtgtagggccagctccctggttggttctggctcactgacgctgcacttgcgaggcagtggagagtctccctgcggacctgcccacaggttgtgcagactgatgttttctttccatgctgcccaagtgtgatgaaaaggcacgtgtcagaggagccctggctccaataggataggataggataggatacctgtttttgttgtaacacatttctgcacacagggcgtgggcgtctctcctgatgaagcaccgccctcccgagtgatgatggaaacacatcgaaagacatcaactctccactcatcctgctggcttcaggaggaaacgcttttcgggtgttctctggtttttgtgaagatgtccttgatagcttttccactggcttctcgttttttatgtcatctttgatttgagtaaacagaattggaagacttgagctgagtggagtaggtggtacttacagtgactgtggcaaagtttcgatgaagggaaaccctggtgacgggaaccttaagctgatggggattgtctgccctctgcttctgtgaggcagagacaggtgaccaacaggttgtaattgggatttaaaagaaaaatattattatgaggaattaatagctactcatggggtgatgctgatggttctttgcatttgaagagcagcgagttctgttttctgggcgtttcctagtacattgtctcatgtgagcctcacagcaccttgcagtggcaggactgtccatccccattttacacacgtagaaacagagaccttgacgttgtgccttgttgaacacaatgaatttgggcctatggaaacctggacaggaagagtggtagggacctgagctggtccccacagtggcatgggggcgatagtctgattggggtgaagggggtgggcagagggtgcagcctgtgacagaggttacctgtgaggagacgggcttggagagggcttcctagacaagactgttgctttagattttaatctgtaactagcatctttttatatttatattcatttagagaaacaaatttattcgttggtgaatgaaaccattcagtattcagctaataagatctcttttgatagaaagaccctcacaagttgttgatggtcatggtgatgattacctgagacaaaagtgggtgccctattagcttcctgaatttcaggtcattggtgattactgactgctgcgtgtgctgtggtcctgtcaatactatttggtgcctgctaggtgccaggggcatagaaggatgatcaggatgcagcccttgccctgggggagcatcttgagggggccgagttgagtcagtgggaagagcttgcccccccccccgatgaggcaggtgcgatgtcacctgtgccccctacgacagggcacagtgccatctgtgccctcttctgtatttacaccctctccccactgccctcgccgccatgccattccccagaatttgttgatctaattcagagagcagttcaaggctttggaggcagtgagacttgaaccccaactgcacctttcattggtcaaatgcccttggggacgttccttgggagaatgttatagaagttatttgatttgtgctggggccaggcattattacttaaaaaaatctccccagatgattctaatgtgcaaccagcattgagaattactgagttgtaatcaagcctgcgtctccttgtctctagaatgcaaagtattgcctacctgataagggggcgaaaagatgaagtaaaatgtaaaggactttcatttggctggtgctccaggatgttaggtgtttttagttattactattgttttctcattgaaagcgtgacatgtcattctagactacacagcaaatgatggaaaagaagaaaataacaacaaaaacatgcgtataatctcagttaatattttaggattttacacccacatacgtactcattggtattatattatgttcttttggacttgatgttttctcatgacattaaaagttgaaaacggtttactgactgcaaaccatttcagcaacagattcacgctgtaaagatcgcactgggttccttcctgagacagcattgtctactttcggcctgtgggttatttgtttatttgtttgggcctcttcgtggtgtgagtgggtgggatcccggcgctcccatgttgctttaacctggctgaggcccgatgctgtggtctttgccatgcctgcactggggcctctgttggcagttgttcttggctgggcaacttccccactgtgcctggaagctgttctgcagttggtggctgctcagcccaaggaatggcacctgtggtagagcctcatgtcctctcctccccgcatgtccccgcctctcccccactctgtcctcctgcagaacctctgatccttgcctcctctccaccccctccctcctcctgtagaacctctgatccctgcctcctccccacccctcttcctcctcctgcggaacctgtgatccctgcctcctccccacccctctccctcctcctgcggaacctctgatccctgcctcctccccacccttctccctcctcctggggaacctctgatccctgcctccttccgcacccctctccatgtaatgttgcttttgctgtaagacttagagtggtgggctgtaaactttgtctatgggacctcagaggtccctgggaacttctgccatcagccctgttgagtcagtaggcagaagcgcgtggcggggaggcagggctctcaggctttctgattgtgaagtcagggaggcctgaaggactgaaacccctggttgagtcatcaccctggcccttgggcccccttgtgccagacttgagcagtcacattgcctgcagcttgtggattttagaagagtgtaaagtgtctttgtaaccaaggcctccagctcgatatatggaagtgcccaaatggctctgtgcctctgtacttcttgatggaaggccaccttttttcccccatgaaagtagtggccttttgagacagaccttttctttgtcccacactctcctttgggaccctagtgctccaggagtgtatgttcatagcctcgcaccccccgcaaccccaccactctgtgctttccaagaataaggactgggggtttgcccatttctcttaaaccccagttgtcacagtgctttgcacataacaggcatgggatcagtcactttgggtggaatttagttatatccttagcgtgtcactagctgcctggagtcagccagatgtagaccccagggcctttaaaagagtccaagctcagaagtcatatttcattgtaggcagagccgctgcccagtgagactggggccttgcactgtgccgttgtttctttctctgccgctcactgcacaagtggacgattggttttttttttaagctgcataattttgaaccacccttcccatcctcatacttttgagtatgaggattctttgatttactctctccaattcaattttcttatggtcgtggagctcatttagtctttttttttttttttgaaacagggtctccctctgtctggagtgctggagtgcggtgtgtgatcacggttcactgcagtcttgatttcctgggctcaagccatcctcctggctcagcctcctgagtagctgggaccacagatgcataccacagtgcccagctaattttaaattttttgtagagatgatgtcttgccatgtggcccaggctggtttcgaatgagcccacgtagtctttttttttgagacagatttcgctgttgtcacccaggctggagtgcaatggcgtgatctcggctcactgtaacctctgccttccaggttcaagcaattctcctgcctcagcctcccgggtagctgggattacaggcgcctgccaccacgcccagctaatttttgtatttttagtagagatggtgtttcaccatgttggccaggctggtctccaactcttgacctcaggtgatccacccacctcggcctcccaaagtgctgggattacaggtgtgagccaccgcgcctggccgagttcatgtagtctttagtgacgctttgcacagtgaaaggtattctctgcctgtactccccgtaggtgaacatgccttctgcaatgcagaatgactttggaaagattgtatgtgtttttttttatgataaaaataaaatagaatttttaaagagaattttgaaaagtattatgatagtgaatagtaaaattactgctactaatattttgatatactttttatctggcatttaaagaatacatatgtactttgtttatccaaaaatatatacttttgtagtatttttctgtgaacctgtcatgaacatttcttcattgtccatacatagtctagaaagacattcttaatggctacattattttgtcatattttattacaagttattcataatttttcctactcttggacgggaagggtttttctcattttttccacttctcttagtgacatcatgttaacatccagaatgatgttaaactgtattcaacattagtgagcatgttactcatgattttcccagttatgctagtctctatttgtcagtcttctatacattgtacgtgaattgaatgtttatgaataggggttttccctttgctatgtactaaacttgttaagatcaatcctcctatctgctccctgcccctcacgcccaaattggcagtggcttctgacgacaggagaaagactgtggtctaccattgtaccagactcagttcacctgggattaatgagtccctgttaggtcagttatgacctgtcctctgatggtcttaggcactgaccacggttaatttccttttctgttctgagtctctttctgcctgttaagggacctccattgctccttctcaagaccgtgttcagttctgtctcttccttacctctttttttataacaccatgcctacctccttccgtctccatccttagtgtccgctagtcccatctgatctgacttgtttttcaaaatgtaagttcttgcacctgggcctcctaacatctggggggaagtggatcctgctttgagatcacttccttccacacaggttttgcccttgtcattgagactccacgtcctctctcatcgtggccagcatccccttctcccacctgtggctgcagctcactcagctgtgtgagccctgccccttctgtgcacactcagtctggaacactccttgactgctgagcagctgcccacatgccagccatgaggttgaccagccactcttgttgaggaaagctgaaaagacgccattgactatgcccacccattcatgatatcctataatagtaataccaccctaataaagacagagattccttagcctgatacaaacgtagaccacagtctttctcctgcgagggtgaaagatttccctctggatggctcccaccaggtgcctggagaaaggggtcgactggggcctggccattctgaaggccactgaaaggggaagctaaaagcattggcttcttaaagatcccaagatgaagattttcttgaaagaagggcatttccgagtgtcgtataacagcttgcttttgactcctcctggcccccagggaagccattaagctggaatgtatcagtggtggaatgatccgttaaattcaaggtgaaaacgtcacaccattcaccctgtcacttgtatcagaaatctttaaaatagaacataagagagtctttatctcaaattctgactcattgggtcattttactcctggtgttatgtagtggttactagaatagaatgcagagttagaattcctgtgggaaacgtgcttttctgaggatacccctcaggtaagtgttctttgataataaatgacagggagcaagagggatccgagacccttgggcttgcaagatttccatcaaaccctcaaataaaaggaggcatcaactgttgtataaattcctccccacctaatttccaggtgatgctctcaaagtattctggcaactttctgtgtaaaccccaacagcaggaagtctctaccaacctgactttgcttgctggggttggaatggttagctaagtctgtgcggagtagcttcgtgcagcctcactgttggttgaacaaccagctttggagtcctggcatgaatgtaagagctggtataatgtgtacaaaatgctgacagataaaaccacttggagaacaggtttttgcattacttccaaggagacaggatatttcttaaaataaacccaggacagagtaagtgtctcattttctcctaccctgggaagtaggaatgaacacctagcctgagacatttacattctccagattatcagccctgggcttctcagcagcagttggctgcatctttgttccagtgtcttccaaaggaattcagtttgccctctccctagatagcaagcaatacttaagaagtaaccaaggtaaaagtaatctcctgtaggggtcccagttgtccccaccccaccccactgagacccaagcacttccctccagcacttccctgggcttggtgtgggggaaacaggccaagaactatacccggataaaacgggccgctgcgtacctattcaggggaaatgagcgcagctgtgcacaggtgtctcaccagaaagtcccttttcacattatgttagaaaaccgttatctgtatctaagcttacagtaatttaataacctgccccttcattttgaagggggttcagaggtccccccagcataagttgcttggttctttgggttctcaactggcagcagtgatctgtgctgtggtgacatacgtgcatgtgtgcacataggctttgcatctgcgcacctccatggacgtcatttgtcctcttatgcgagcagccggctcacattcgccttccgttctacagaggcccagaactatgttaactggagtgtgtctgggctctggtgcgctccttgccaagaatccgtttggttcctcttgtggctttggttctgcctaggacaacagcacgtttttgagaaaggagtgcaaaaaggaaatagccctcctgaaaagcccaggacagagaaaggcagggcgaccccttctcaccttctgggcgcgcttaggttatgttatcctgtgaggcctaggaaagaaaatgctattgagtagctttgtctctcccttgcacttggcctttagtgttttatggagagaatctgcttattcttgagcagaagtgacatctgggagaggttgggagcaggcaggcactgtctgtgcatcccctagccacatttcccagccagatccgaaacaagagctttcacaccctgtttctcttcaaggctccgtctacttaaacgactccctccctgccaaaagggatattgagaagtgacttcgcagcaatttttgcacatctcccagcacaggcttttcagctgagggctatgttgcaatgttgcattttcccttccaacttactatccacgcaattgtttactaaacgctttgttgtgctttgcaatttgacttgaataaatctggctaattccccaaaaggaagaaaagaaaaaggcatttccaggagaaatcactccctgagcctgcagatcctggggtcccagcagcactaggtccttggttcctgctcctcctcctccctagtgccactcggaggctctcacttaactgcctaggaagccgcaggcatccctgtgttgctgagacacctcagaactgctctggcatgagagcttgctgaagcagtcccttgtgttgctgaaagcaacctgggaagccatccatctctctgcttgctcttctcttggcctcaggggcccttttcctgctcttctcaaactctaggttctgattttcccactccatcactgttccacaagcagcgctccctcctcatttcctccccactttgccccacttgctaaaccatgatatcatttccttcctacctgtgatactgccggaactccagaggaggactgcgcctgcagagcctgtgaccctgtttgacatttggctctctgagctgttttccccatctatgtaacaaagggataggatcagatgatttttattccccattctagctcaaaattttatgagtcttgagattattctcttcctttggcctgtcagataaaacagagcaggcaccatccccagttgctgcacgacctggagctgatcagtgatgcgaccattgctgaggggccctgagctgcagtgtggggaggccctgctgcactgcgcccgcccggcagctgagggtgcaaaggtgtgggcaggcagggaagtgttcaagtcgttaggcacggacttttctagacttgttatctcaattgatttaattgcagccaagttaggtcaataaataccaactgatgatcaacatgaacgattggtgattttttgtgtgtaccttagtagccaaaagtcatgacgatagcatatctgtgcacatgctgttgttttgtcttagatttttaaaataaactctgttttaggatagtgttagatttatagaagaattgtgaagagtacagagcttgcatgtgcccctcaccatttcccattaggaacgcgtatcttactttggtgggtacgttggttacaatcaatattgatgtgctgtcactaactgacatccatatttgattcaggtttccctcattttccccaggtgtcctttttctgtcccaggatcccatataggatcccacattgcatttagtcctcacatctccttagctcctctaggctctgacatttctcagactttcctagtttttgatgaccttgacagaaccagtcaggtattttgtagaacaggatgtgtccggtggttttcccatggttagcctggggctgtgggtttttgggggaaagactgtggagatgaagtgcccctctcatcacatcgctctgccaacatgactgtcactgttattggcctcggtcacctgccgcaggcggtggtcctcgggtttctccactgaagagtttatctgttttcccacccccacccttccatcctggactctatggaaggaagtctcttcccttcagatgtggggagcaaagctccccctttttgagggtggctgctggcctgtccttgccaagggctcacctgtcgcatctggtcgggcaaggtgggcccgtaggttggaggaaagcaatctcagagccatcccacaaggcacaaggtgtcctgggccctaatggggcatgtcccatgtgagggtgggatggatgaatacatgtcctctcatgataagtgcccaagagcatatcagatatgcatatatatcatataccacagagcacattgggctgacatttcagcccagaagaaaagtgcttcctgtagtagtaacagtgacgaaaagccctcacttgtaataactcaacatttttctgcttcgacctacctctgtgttaccttaaaagtgaaaacaacttgctccttaccctcaggggatcctagaaagatctagaaaaacattgttattgccattcagggcctctgagttttaataatttaataatttaatttagtaatgaaattaagatatggtttggtttgctttctattacagcatacttgaactaacaccttgtttttcctggtgtattatctgatgactgagtgtaggaacaatgtcattaatgtgtgtttcctctactgcataatttccatccatggaagagtctccattaagaggacctgctacaaatgtggaagctcagagacctcgaaatgaagtcatctgtatctgttggcctgctgggttaattctgtatgtgctggtgaaactggagaagtctgcgtgcttctgacaattgatggtggaattctacgaattaaagcgttttagcaggaaatgattatgaaggacctgatcactgtctgtgtttccataatgtgataagattagagtaatgggtgaaatgaggagcaatcaggaaacatctttgttctttttcaacagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacatcatcggtaggtcccaggggtccggagctcgtgccctctaccacttttctgtttgttcccacctccaaagtgtgggtggatgccccacagggaggtcattcttgttaacacgagaggcacagaattaataggatgtttctgattcatttagaagtatttagtttcttttagtatgtttttaaattactagaataaatgcatcactgatagagaaaaattgggaaaataaagaaaagcatgaagaagaaagtagaaataccctgcctgacaacatggagaaactaattctctcattcattcattcattcttttaataaatgttcattgagtacctgctctgggctgggcattgtgctagatactagggatcccatgaaggcataagacactctgtgttcagaagtttactgtctacagatacaactatggttaacatttttgtgaatttaaatgtgtatttttctacagtgtatctctttataaaacaatatatagtaaacatttctcatatcattagctatttttccacagtaacatttctaatgcttgcctaccattgtatagatttatatacacagcgtaatgtattggtgtctttatgggatgttcagattgtttccattatgttgttgctgttgttattaacagttaattactttatgtctttgggcttagccatgattcttttccttaaaactgtctaaggagcagaatggctgtcagtgggtctgcgtgtttttaaggcctttgttgactgtgatcctccacgtagccaggggcccctttccctgcagtgtgggcactgggcatcggcctgtaacacatccacccagcaaataaggaagcaaatgtagaaaatctttccggtttgccaggtaaacacgctttgcttctctttatgcttttttgtattttgattacaactgaagttgaacacatcaacttaaaagaaacaaaaacctaagtctcagaagcaaagggtacaaacggccactcaacatgccatttattttttttctcaaactttttggtaatagcgaaaaatcagtaagacctgttaagttgagccatgtgggttccgccttgcttctgtgtcagctcccactggaccccaccacaccctccctggccacacatgctgcctgctgggatcctcgcagccctgggctccccacagccctatctctgcatggggggcatcactcccccttcaccaggacagctgggggagggcacacgctcacattctccgagcagcaccttctctttctttccagcagctgcagtatctgctgagagccaacatagcttagtcttctgggttctaaaataaaattcacaatgttttctttcaatgccacatcaaaacttaacaaccacacatggttctcacaagctgaagtctctcactgggaatgtagctattgtaaatggaccgttatgtttccagaggatttacctgagcataaaatatacattgagcatgaaatgcttgcagcttctagaccaacaaatgtaaggctctgcgagagtgccgtttgcttgtgtgaaaccatttgcatgcattataaaaatgtgttctcagccttagctgctgggaagggcagtttttccagcaaacatttttttaaaaggcataattcagaaattgggagtggataggctgggaagaaaggctggggtagcccctgtcactgagcaggacagggtttgggagccacgtttgccataagccagctgctttgggggtgacagggagatggtgagaccatttttacagaattcataatagattggctgcttaggaggaagaaatgtggttaaacttctgagttgttggaaagatacttacttatcataagaccaaatagtgaaattgaatctctgcagatcactgtggcaatatgctgtggataattaggaccatggtcaccgacaaggcccgctttgaaaataaaggaaaacgctctatgaaaatgctggaattttagtgacatttcctgagaaacaccaatggaaacacattctgacaccctttagaattatgtgagaggagagaatgagagtgaaagacagcagccaactattgttggcattttgagtgctgccctgttggtgttcttcggcgccggagggtgcaggctgaggggagaacgaggagggctggggtctgtctgctgtcctgcactctggggatgctgtggcctccgaatcaggttcaggcaaaaagtggcagaggtggctgatgccaacactgagatgagcaagtggctttgtccctgagatggagttcagccccttcaaggacttcctagggcccctcttcttgctgagagaagaattatggtgcaggcaccatcatctctgctgccaaggggttcctagaaaagaggcttcctaagcagcattcctccagactgccagctgcaccccaggagtgcattatgaaatcaatttttcatgagttgtcatcaatgtttactttttttaatgaaacaaagtaggtagcattaaatattatcagagtgcctctcaggtggtaagggtaacactcgttttgcgaactttttattcggatatatatatttgatagaatacacctgtgtatattgggtaggatgtgaagtgcattcctctgtaggccctagaagccttctcgcacttagcactagttgaccgtcacttctggctcagcatacactgtggtctggctgctgctgccagattccagtgcaccgtcggtgactcctgcaatgatgttatcaacatggagctccactacaaatacctggctaacagttgtcctcacatctcctctgttgtgtgtgctttgtggcaggtacttcaagcgtagcgagggcctggagcgccaccttcgacgagctgataggcagacccatcggggagttctcacggacacacatgactctgaacgcccccggcgtgctggctgaaaaccccgacatattcgcagtgatcataattctcatcttgacaggtaaagcccacacttaaaaagagatcgggtcagagtgatgggcaaaggtttggtgagaggctcctgttaagttcctttctttacttatctctttaaccataacccccatttctttttgttttgtttttgtactgcatgcaggcatctttatttgttcctgtcttcattgcttcttatagattcagatagggccggcctgcttcatagctgttgaattgtgtgccatttcattaaaagagaatcttaggtgtttagcctagctgtttgtggaataagattttgtctgcactgcaggctttttgtgtgagtgtcctgggaataaaagttcttttgactcagtggatgaccatttggaaagcaaaactgtcattcatcagccaggaaaatgtggaggaatgagctccgtctggaacactaatgtgtgcctggggcgtctgaagatgacttggatggtttttacacctaacaaccatcaaaacaccctttcagtaaataagtttcatgacagagttgtggttacagaatttgaaaaatcccagagactgcctgaacacagctgatggcaacttcttgctagtgacatttgtgcgtgtcttggccagtgcagcgcgagttttgctctgtggggctccataaacatgaagctgaaatgcagataaattctcatttggggttagaaaatcttggatgagttttaaaaatgacatgccttattttacacaccacataattgaaataacttcactcaggctggtctcagcagtatttctggtccagctggcagaaacatgcatcagaaagtaagtctgcactagtgagatttcattttaataaacctgagagggagggacactaaagaaacaatatattgttgtttgttgaggtgttctccctgtgattaattacacaattctcttctaacatctgtactttataattcaatctcaaaagtacagcagtttttattttattttattttattttatatttgagacagagtcttgttctgtcacccaggctggagtgcagttgcgcgatcttggctcactgcaacctctgcctcctgggttcaagcgattctcacacctcagcctccccagtagctgcgattacagacacgcaccaccacacccagttaatcttttatatttttagtagaggtaaggttttgccatattggccaggctggtctggaactcctgacctcaaaagatctgcctgcttcccaaagtattgggattacaggcgtgagcgaccgcacctagccaatttttattttaaaacgatgagaggcgtccatggcagagcagtggtctcaaatcctggctgtgttcgagtggtaccaaccccttctgtgccacttttcttgcccagcagagagttcagctatggaagtacccgaatgacctcttcaccctaaggtggtgctggggcatgtgcctcaaaggcagtgctgtcagaggttcctgggcatctttattacttatagttttctttaaaaaaaaaaaacgtgagtttgcaagctagagctagcctagctcagatgttattttatatgcactgagtccaacgaagaaccatgtgtgttagtggttccagaaccatagctagttgttattgttaatatcactaacatcccaaagtcaaccagaataatttcctcttctgaaaaatgtccattctcccaggaaactatgcaaagtctttcttcctggaattgttcctagaggttgtttcccagcaacgcatccttttagtgagagggagcggcttggtgtgcgggtccaggctttcccctccctatgagaggggctcatgctccagatctctgcagttctcgggtgccccttgggtgggcttctcagttcccaagggtatctggaggtcacctaggagggcctgggaagcacccacaaccttggtgatttaaacccctgatccccgcccccagaaagataattaatccaccccattcccagaggctcacagaggtctgcagaggctcgatgcacttggattctttttcagtcgccttcttatccccatccaggaaggaccttcccagtttgtggttaacactcagacaaagttttgtgtctatgcactttttcaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaagtgagttgctgcttctgaccatttttcttagttgacatttaatgacatagattgtatgggggatataactggctaggatggcatgtgcttttaagaaaacattatttgaggatattttgttaattgttttgtgtttttgcagtgaagtagctgagggtattttgtatgtatcaagtttgtgtgaaggtttattcccctgaaatggaaagactattgtatgacaagaaagactgaggaaaagaaaatcatcaccctaattccaaattgtgtatcattcaggattcttgtcagactcattaaatgatccctctttccccagattctgtttgatggccaactttggaattttgtgttcagaaaagatttttctctgcagtgccgtggtgacctcacttcacctttaaataccttcctattagattaataatgtagagggaagagaaataggtgaaactatttttgaaggttttcagaatgactgaagtgtcagaatgtgagcacaatagtctttcgccgacatttgacttgtgctgctcaagccctggcgacagtggccccatcaccctcatgtctctgacacagacatccggaactggaggtgacagctccaccctgtgccatctcaggtctctcgcccagccctcattgaaagctcagataacctaggaaaaaaaagccaaacagtcatatcttttttatctttgttgtcagatctccatgtaattctttaggtctcaggatggacaatggggacttggattttgtgtgtgattcttcattaagactgaaggttgaaactgctatgataaagagaccccctccaactgccacaatggagtgtggctttaaagaagagatgtttccagtcctgaagtgagcagtccgcgttggctggccagctttgccacaggcctctgtggacctagacatcttctgtcttgctccatcttcccccaggacattgtcctcatctgcctggtcagagctggctgtaggcacgagcatgacccagctcttccagaagggaaaagagagcgtagaggagagtgctcaggtctgttcaggacagaccagaagacacacagacattccattggcaagagtccactgggggccacatagagctgcaagggaggctgagaagcactatctcacattgggaatcttagcagtcacgtatgcccagttggtcactggttcagggccaggtgccagccatgtcgcccagtattgttaccagtgggcaggcattgatgtgtgactacttgaatggaaacaggaaactatggcattcggtgcacgaaacttcactaacactaatattttgtggttagcagttctaataaaactgctttcctaaactctgttatggagaactgaggcctttgaatatgtcatcccgagcatttcagagtcatatttatgccaaatttatgggtgtccattaatctagggtggagtgaagccaattccaaatatgtgttgaagtaacgtgtagcctttgaaaactcagagcatattcgaccggttgctagttataggtcaggaatgaaatatatagggcacctcttgttaactggttgccaatcgagatttaattttattatttttatgaagagattgtgccagccaatggtatttactttcactggtcatcctcatgctggtaccctagtaatgatgagctagctgtaccggcccccagacaaagcagcatttgttgccccaatccctgatcataggtggggcccccttagctacatctgacggcctcactgccagggcccagccccctgaccacagggacggcaggggatcggccatgttaggaggtggagttctgcaggactggagcctccttggcatgctctattatgttgttaaaatatctaagcaactttctttcttttttttttccagccgtagctttgtgtttctgacaacagccatgtagtcttgcatgacattgctggttcctctgaaatagtagggcactgcccaaccaatccatataacatgcaggagcttccgcttgcatgggaggccgtgagaccacatgggtttgtgattttaggatgctgtctcctagccgcctgggaaggcccccaggaactaggtcggtctgtctgttggtctgtgaagaggagtgttagttaccctgcagtctggatggctcttcgtgcctttgactcaggctgccgctggcattcccatccagtgttctgtggacatagcaatagtgaagcatcaaccctgcatggaagcctgttgagaaggttttgttggatggtgtctgccagttaggatggaagccccaaaataacattggcttcaacaagataaggctttggttttctttggttaacctctggggttggtcagtccagcttgtcgcttcacccagccaggaatccaggccaggcgccccagggctgaaggcggcttctccagctccagtcagcgggatggagaagggaacagcagagggtcccctccctccccacttcgtctcctggacatttctcagcagatgcagacaccacttctgctcaaacatcctccatcagaacttagccagatggctactccttgcagctagtgactctgggaaacacacagtcctgattcttaaggctcatatgtccagctgaaataattaaagtttccattaccacgtagaagaacaggggagtgtggcttttgagcacaactaacagttgatgtcagggtggctggtgtgagggtggcggagccctgctgcaggaagttcaccactgatgcagtgggagaccctcgggcctgacccctttctatgccaggcattgtctttgctgcttctgagcgaccagctgagtggaacacagaagggctggtcaaaggctgcagggcagggagcgctgagctgagaccaggactcaagctcactttgtctcggggcgacatttgctgggtgagggctcttggcagcccctctctttcacatgtgagttgccagatgatgagtgaacacaactgccacacgcatgtaaaaggttaattattgattacatagaaagagacccttagtaaatatctctacgttttggtttgcgcctctgtagaatggattctgtggttattttgtgttgatactctgccactggcatcagtaacacccaatcttttcttaaaggtggaatttaactttttgagttggtaaaatactacgtggttcataacgctttaaaaaagatttacaatgcgttcctttcttcatccacctcatctcccacccccacaggtaaactttctaattgtgtgtgtgtgtgtaagcttccagtttctccctgtgtaagcacaagcaaatgtaaatatgtatattttatttctgttttcttacacaaaacgcggcactccgtatatattgttctgcaccttgcattcttgcttactagcatgccctgcagatttttttttttttttttaatcaggcccttgttcattgttatggttgcccagggtcccggcacccgggtcctcctgaagtcggctgtgggtcctcctgaggtcaggtgtagcggcgcagtacgaggagcaggtgtggcagggtcacagtcagcagggaagtttacggatgctcacggttgcacacagctctggagttggcgcagcacagcacgtgccttcacccccattctgtaacctggaggattatccagtctcttctgcaactgtcctgaggagccggggaggatgccttttgttttgcctcctcgctttgcgctcacccatcgcccttgcttccttctctccatgcttttattgttgtgtgtgctttacctgtctgcgtgaggaagacacattccagcccttcttagtccccttctgtgagttcatctctttctgggatttaatcatgtatgcagttccctgcactttccacttgccctgaaatggaggtttcaggacctttctaggtgcctctgcctcatggttgcctaaagctcatctatccatgatagcattcatttatttatttattttttaatttttaaaaattattttagagacaggattttgctgtgttgcacaggctggggtgcagttgcgcaggctggggtgcagtggcacaatcatggctcaaagcagcctcaaactcctgggctcgagcaatcctcttgcctcagtttcccaagtagctgggactatagtcatatgccaccacacccagctaatcagaaaaaaattttttttttgtactaatggggtctcactatgttgcccaagctggtccctaacttatggcctcaggtgattctcccgcctcggcctcccatagtgggcatgcatttattttaacgcaaggccatgttggtagctcttgatgtcataggagctgagtggggatctgggggcttttcactgcccgtctgtcaccctggccgccacagggcaccaaagtggggcccacagaagccattttgactcttgagttcccctcctcccttggcctcatcctccccctcttgagccatttggttgtcacctgctttgtcttcagcataggccactgagtaacagaagccgtttgccagggtgggagtgggtggccggcggggcctctggcctgagaggcgagggggtttggatgaggtgggcacagctccactccagccctttgctgtcccgcggccctgctgacttgtctgtcctgggctgcttggttttgaacttgggttgctagttttagtcatactctaacacaacaaactaaaattttgtttggccacagtttttcctgcgtccatcacttgtacatttctgggggtttcctctcgttactgtttatgggaccacagtaaaccccacatctacatgagctttctcatgcatgtacttccagcgtcttcatggcagtttctgtaactgagagctgtgatgatcctctaggaattagtaaggcttaatccccattagaaagtagttgggtccatcctgtctgtctgtctgttttatcagccagtgagtaaatcccattgaaagcaaagttcaccaaatgggctgcccagccaacctgagggatgtcagtgtttataggactgggagcatcctacagggttcctctcttcatgctgacaaggtttagggcaggttgtcctgtgcagctgggtggctgtcaatatggttgagtgggggcaacagaggtgggtggtgagcgtcctcttgggctccaggccagccagtgggaccctggcacaggacagaaagcctgcggccctggggctggcaaaggtgtgggagtagggactgcccttcttgaaccacaaggagtgcaattgcttttcgggtggcagcagagggttggatgcagaaagcttagggttacttggtgaccagcaggggctatgtgcctcctgaccaggggacagtggccagggaagccgcctgcactgactgcatggtgcacccccagaacacagcatgtggggggacaggccagggctttgtacatcagggaacaagggcttgaaggacccccgacagggccctgggaggggccatagcgccacactgaacctgggcaccgtgtctcggcacaggtgtcagatttatgggactgttttctgaatgtttaagcagcctgcttcttctggactcctgagtttgtaaactgtgcttattttgcttttgcgttcatcagtgtagcaaagatgtgctgagcccctcccgtgggccagtgcccagctgtgcccgggccccacacacctggcaaaagctgcgccctcctggactccaccttgtgcatacaggcagttaaggaatgcctttgctgacaaagacttttattttagccttagtttctctggaattgtttgttttgagattgagttactggtaaatatgggacccggggtaggactggctggcggctctgcatccttcctccgaggggccctggggagaagggtgtgggactggccgcgtggctggtttctcccccatttcctgttggacccctgcctcatagtccccacgtctccctaccctagtcattgtttagaagatgcttctggaaggggcgatactctgcacccttgtgaccctgggccacgaacagcagggaggcctgcacacacggagttagcatgcagtggctggactcagcgtctgaagcccagggcctggcagcggtaacagggagggctgactgccaggttccgctcatatcaggagatgagcacagctccttacgccagactgcgcagcgagtgacgtgacatttgtttgcggctcttttttctagtgacacaaaagaagggaagcccggtgttggtggattcatgcccttcgggttctctggtgtcctgtcgggggcagcgacttgcttctatgccttcgtgggctttgactgcatcgccaccacaggtatgtccgccagccactgcggtcccgggtcctcctgcaccccgggcaaacaaaccaatgcttgccatttccctccttgctggcacggtccagtcgccgctctttcacacatgagcaacatgtagatttgtagcttcctgccaagccctcccacccccaaaccattatcacatccccaactgtcaacacctgatgaaagctggatcttgaataaggctaaggttccgctgttagaatgggatcatagctgtgtggctgtggcctgatttcatatctgagcgtcttccgggaggagtgaggccattcacaacattgtcatcctggcggactgaataggccaggcttcagtgagcctcccagattttctctgccaaaggaaacaagtctcttccttggctgcatcaccacattcaggccgagaacactgttgcagggccatgggctgtctgatgtgtcttcctgagcaccacccctctgctcccggaagcacaggaggccccagtgcccacagggctgagtgctggagggaggtttctcgtagggtcacgtgggttccggggcactgagaggccttgggtgtcatgtgggcagatacactgcctcttgctgtgtgccctcctccgctgaccccttgtgcttctaggtgaagaggtgaagaacccacagaaggccatccccgtggggatcgtggcgtccctcttgatctgcttcatcgcctactttggggtgtcggctgccctcacgctcatgatgccctacttctgcctggacaataacagccccctgcccgacgcctttaagcacgtgggctgggaaggtgccaagtacgcagtggccgtgggctccctctgcgctctttccgccaggtgagaggcctttctgtggtggctgctcctaggggtggaaccaccagcaggggttaggctatagcaggccaggtacagccatgcgagacacacattggctgccagcattctttacccttgaaatagacccagtacccaacccagctttgatcatgtggcttttcccttgttggccagtattcatcatcccaagagttgtgttattgagaagaacctgaggctggcttttcagcatcatctgcttagcaagggactggttctctgtccctaaatctggccactggaacaggcccgctgtttgaacaccatattttggccctcagtttggctgtcatgcagaagctactttgatgaagggaataagtgccttttaatgagaaacattttcaccaatcgtatttcctcttagcctgtataaacagagctatttggtaaatattgatttaccacagggaaatcttcatgaatgcagtgatgcttgtattttctgtttgattcagctagaaataattgcaggaataaatacagttttccatctgtaaagactgtactgggtctcatgctagtgtatgttagatagatgttccctattctttaccttaatccttattcacagtgtgtgctctttctgggattgatttattaaatgccaagtcttttagccacaggcctcacccagcgtggagggacggcagctcttggtgagctcagactccctctcctccgtggtaaaccgagcatggctggatgtggtgcctttatcccttatgagccaggttcactcacgcggtttgcctctccccatctagtcttctaggttccatgtttcccatgcctcgggttatctatgccatggctgaggatggactgctatttaaattcttagccaacgtcaatgataggaccaaaacaccaataatcgccacattagcctcgggtgccgttgctggtgagtactagaactcatttcacatggaaatgttttaacaatggagtcattactccctagggagacgtcttgcgcagttctggtctgtgagtaatcttaactggtctttttaactcctggtttttatacttggagcctggttcattgaaagttgactgaccttttgacaaaaggcagaggcccgtttgacagaggatgggagagaatttttgaacagtttgcactctggttttcatctcaatgggcggagcttagaacacacagtattcgaaaaccttttctccccatttctggacgtttccctgagtagtcaagggcaggctgacaccttcctgcatgacacaggccaagggagacctcgccagtacctggaaattcggcgtccatttctgaattctctggaaaacaagtgtcccttatgatcagtgttttatgaaatgtgccgcctcttccccagagagtatcaagggtgctgctgatgaagccacttgcccctaagtttatacgtaatagcagacccagtggagtttcatcttgtcagatgagcctcatcgctgagaggaccattttgatggatgaaatcagtggactaatctgagccgtgtaggtgttccagggccccagatgaaggaaaggagaacctacaaggaagctcgtgtgcacactgtacctgtggtctatgtctcctcctttcgcgattgcatttcatagccccgagaggcagacgcccgcccctttcgcaattgcatttcgtagccccaaaaggcagacgtcagcccactgtacagatgtagaagtggaggcccagggaggtgaagcgaggatgtgcacccagggcggtggagcggccttgtgattccagggttgtttttatgccaaagtagccaagctccttccagagtctgagcagagcagtgggtctttttggcaaattagggcatgtgagatcagtcacagtttctaacacagcgacttgtcaaatagccattggtaaggcacttgaccttcttaaatgaatgaattattcactaagttttattagcatttatgcctttagcaaactgtgcttagttttgtggattaatattgtataataaaacacacctatttttaaattatgaaacattttcttatgtgattctatgctcttgagagtgaccacagtggtcagattgagaggcactatacatcagaatgtgaccagtatatttacaggattaaggacttggaaatagtcattgttttctcaggctttacgtggaatttgatcatattaaagactggccttaatttccttcccctgctgatagagggagatcaaatcatgctctttgaagtgactgtaaagtacatgccattcacaaaatccaggatttacccttttcatttggtgggagtggtaaataagtatttggttttctaaaatcacctcacatggaagaaattagtctcaagtttcccgtgagtaggaacatcggcatttgtggcatgcacagttgggcgctgttctgattatccaaaaggccctccctcattgctctttaattttgtgttttattctccatttaaatttgttttagttgcagtgatctagaggggcttgagagatatttgtggaaaaataatggctttgtgtttatattttagcttgtgttgattgcatgtgttttgaaaatatcccaaagcagatgtagccaagttgttttttaatgagtacttgacatacacacccatgtgaatagacacgtatactctcacaacgctcacaaaagatgttcaaataagggtgcaggttttaattcattttaaaggcaagggacacagtgaaggggctgatactatattgtttgagaacaactcttcagatttcttccacgtgaagtgacttcacatgtgaagaactctgctctcctgcccgcctgcctgggttaggacctcctgtgagtcctcccagagcaccagacttgcccttctttatcacccagcactgttgtccactaatgcctgtgtcttggtggggtacactcaggaaggctggggactgtggtctgccctgttcaatagtgagtacctagaacccaatgatgggcacactctgaccggagctggatggatggaagatgggtagatggatagatgctgaatggatggatgggtggatcggatggatgaatggatggatggatagatagatggatgagatggatgggagatgggcagatggatgagatggattgatggatggatggtgagtggatgaatggaagataggtggacagatggattgatggagaatggatggaccgataggatggatgatggatggatgcacatgagtctgtgaatcagcatggtctagaggaagacacacaggactcagagtcataagaacccagttcacatccttataccctatgcttgtgaactgtgtgaccttagatgagtctcctaacctttgtgaatgtttatatctataatgtagggatggcttacaaagttgccattaaaatcacaagaatgaagggattctctatacaaatgttaatgatgattactgtctgttgaggactgtgtctgtgatttaatcacaagcttaaagggaagcttgacttccctttaagctgtgtctttccatgggaaggccagggagggggtgggagtaaaagcagcccccttcgctgccctggatggtgggcggcagtggtggtcctggttgtcattgcatgcagatggccctccacagatcctggtgtctgtctcttcccagctgtgatggccttcctctttgacctgaaggacttggtggacctcatgtccattggcactctcctggcttactcgttggtggctgcctgtgtgttggtcttacggtatgtatggcttttgggggtctcatgacagaaatgcagatgcacctggtagccttttcacagttcagctatggtttatgtgatgaatgaaacttttaggttggtgatagctccattgggagctgccaaggagaggggaggacctgggttgagagcccagttaggaggacgtccttggcaagagttgggtggcccctcacccccctctatcatgtgccctcatttttatggctaaatgttgggtggatagagacagattctcggtccaactattaggccaggatcctgggatcagaaggtttgaagactgattgcaacttggttcagattcttgggacagagaggattgagggctgccctggtaggagttaggaaaacccaaggcctgtgaaacccagctcagcataatgcttctgcagcttcgttgcgctgtggctggaggaatgaatcccattatgtggcatggcgtgccctaggttgatgttcagagacactgtggagtcagcttgttatagcctggtgggggccaggcaagcctctcgcagtcgcagtaaagctgctctgggcctaggcttggtgtctcggtgttctcacctgcctcagcacccactcccaaagcacatccctgcgcagcttccatcctgagaacctgtgctcatggagacgctcagcactggtctcccctcaagagcctcctcatttcttttcagggattcccacctgcaaggccattgattgcatttccaaggtgttcagcagctgatgcacataaaacccgggctgagccttagcagaagctctttagaatcagctaagactattggggaccccttattcctcccaaggggcccaatgctagaatattctctgaggtctcccactttcttaattgaccgagtgaggttgcacaagtgaatccatacaaaaatggttaatatctttatactccctcttagaattgatcatatgcaaaataattcatacagaactctgtgtttcaaagctggtggaaaagatttgcactctgttcatttcgggtgggaagataaggcacctcattcagaatggatgctccactagcaggtagctcatgtcttggaaatcacgctgcaggctcggccctccaacaagccacatagaattatttaccctaaggtacttggagttttaaaataaattgatccaattaagtcacacaaatagaatttctcaaatccatctagcctgcagccacatttctctggctctctgtgccaaataggatcctggcattactgcttcctatttctctccttcccttttgctccctacagcagtaattttgtgggaagtggcctagtatctttagcatctgagggccgctgccacttctcagagcaagagagatcctctcagcgtattcctctgggctgctcatggtggaggtcatgtcgccccgaaggagagaccatggaggatgttccccagaagcaacagcgggaggtggtgttcccggtctctcctcgtctatctacaatgcagcatttgactatatccttcccattttataccttgtgtcccgggcagctcactttggaggcttattgagaacttgagttggtgcacgtcattttgcttgaagcagatgtggcggtcacgcaatgcctttcttcccaggtaccagccagagcagcctaacctggtataccagatggccagtacttccgacgagttagatccagcagaccaaaatgaattggcaagcaccaatgattcccagctggggtttttaccagaggcagagatgttctctttgaaaaccatactctcacccaaaaacatggagccttccaaaatctctgggctaattgtgaacatttcaaccagccttataggtaagagctagcccttccctggggccttgcttgttggcattgcatggtttctaggcagtggagctggagttgggggaaggtgccagagaagatgagcatctgtcttgctcctggactgggacatagttactctgtgttaactgtagttgtgccttcggaaatggagcctctctctccacaagtttaggggagagcagtggatgcctgtgggaaattgggaaatggttgagttgcagcttgctgtcttttccttcccccttagctgttctcatcatcaccttctgcattgtgaccgtgcttggaagggaggctctcaccaaaggggcgctgtgggcagtctttctgctcgcagggtctgccctcctctgtgccgtggtcacgggcgtcatctggaggcagcccgagagcaagaccaagctctcatttaaggtgagcagctcggcctagggaaggaaccctggtacacagaccctggccctcctgatgcctggccagccctgcgtgggctcagccgggcctgggtgctcccgaggaaggtttttgctagccagcttcaggtaagatggggcaggggtcctgaaggcacagagaggaccagaccctggaaggaggcagcagcccttctcccctggacgtttccctgagtagtcaagggcaggctgacaccttcctgcatgacacaggccaagagagacctcgccagtccctggatattcggcatctatttctgaattctctggaaaataaatgtcccttgtgatcagtgttttatgaaatgtgctgcctcttccccagacagtatcaagggtgctgctcatgaagccacttgcccctaagtttatacataatagcagacccagtggagcagtccctccggggtggtgggatgcttctcgtaaatgtctgctcaagttgatgcatgagttttccaagccttggagacgggcaaggcttctgcatttttagattacacaaataataaaaaaggttgttgaccttagaggtaaagtggaggtccgtcttctagtcctttctttagcaggagaatcgcaacagagaaaaatgagaatggagttcatttggccattcagagcttagaatcaaatccccacctactaagatgtacccttgggtgtgtttgtgtgtgtgtttgggtgcgggctgtgtgtggggtgtgggagtgggggtgggcactccctctctcttccccacactcgcccgacggtccctgtcactctcagttgtgctgcctttactagacagttttactgaactattggaaccggcgccactgccatggattgaggccacctcctgtctcttcaggttcccttcctgccagtgctccccatcctgagcatcttcgtgaacgtctatctcatgatgcagctggaccagggcacctgggtccggtttgctgtgtggatgctgataggtatgtgatgctgctgccagcacgtccaagatcctggcttcccctgggggtctcccttgtttcagatttcataacagaatgacgcacatccagtcagcagctttctcgaagataatgctgaatccctggtaggctgtgagtcctctcctccctgttagatactttttgtttccattgcttcttgtccaaactatttattcttttgggcaagaccttgatattaacaggaacaaggtgatgagtctgctgcagataaggtaccagttattttcaccccagacaggaaagtctggcctgtgcctcctggccccctggcctgcccagcaccaaattggtacgggcactaggcccaggcagggtggatgtcatgggctcctctgtgattgcgtcttctctgtggagggagagtgctttggagcctatgggagatgccactagggtggggagcttccacatgagatagatcaccaggggtgggtgcagcctgtagtcccacgcctctgggcatctcaccccaggggctggaggggaggatctcatttccttcccctcagcatctgagtcatagtgctgatagccaggaaagtggccctggccattgcccctcaggaccatgtccctacagcctcgcagccctgagtttgcatgctacgggcagatggctgctgcctcatctcccagggccctcgaggggtgcttttcctccaggaaatactttgcggcccactgtctgctggcagccgggtgggtcctcattccctgcaaagtccagcctgttagacagacgtctcctagagcctttctgagaaaaagctgctcacagctcactggccacttcctccaggcctggtgaaggcagaggggcgcctcttcccagcatccctgtcaaagtccctgtgtgcaggagcctgagctcctttcctgggctgtgggtggctgagtccttgctttaaggcctgttttcctgtgtcagccacacaaggtggccccagcccctgggcaggtggtaagaagcataggtcctggacccaccctggagtcccgtgtgcaggaacaggctgtggactcctatgtgaagtccattcctggggctcagtgtctcctgcagtctgacgctcagttatgtggagaaatgggcagtgggactgtccaggctgagagcctggagacctccagcacctgtgggaaaccccatctccatagtgcacattctcgatactctcgtggcctccgggggcatcagggggctaagctgaaggacccgatggcctctggtggccctggcccagctgctctgtctgctcaggaaacaccgcagcataaggccgtccagaggaacgtagggctttgccagatgtcgaagcagacagtggccttcgtgtggcagctgctccagatgtggaaaggtcacaggggccgctggctgcgggctcatgccaggcaggggcaggccgcctgagagggtttgctgtgggaccgccctgggctctgagccctgcctgcggtggtgcaaccggcggtctgttcacgcccgtctctgctgtcggcccgcaggcttcatcatctactttggctatggcctgtggcacagcgaggaggcgtccctggatgccgaccaagcaaggactcctgacggcaacttggaccagtgcaagtgacgcacagccccgccccccggaggtggcagcagccccgagggacgcccccagaggaccgggaggcaccccaccctccccaccagtgcaacagaaaccacctgcgtccacaccctcactgcagccaaaggtgcaattacttgacctgcagccccagcccaccctcggctctgcagccggttctccgggccctggtcacctccagacagctgcctggccggggccactaggctgcggctggccactgtgtctcctcacttctctgaacaaagcagttcctcccctaccagctcagccccgagctgccgcagcctcaggcagaacggaggtcaccttctctccttatcttgggaaccaggccttcctcccggggactgttctgggattgaaattgtgcatactccaaactttcgcagccatcttcccgctcagccccagacacccagcaatcaagccagatgagtaccacaaaacagtgtgtccccagcagctccccaccccagagccaaatgacagtagtgcacttaaaaaggaaaatcaggcctgttgtccttctccggttgcattcagttgggtcattagggccggaccctgcctgccccttggcttctcagggctttgctctgacaccatgacagctgcccggggctgagggcagctggctccactcaaatgaggaagaagggatcactcccattagggcctgctttgcttatgcatgtgtgtgcacatgcatgtaaaccagggaccttcagctcacggcctccaggcctgggccagttcttgctgctcctgccgtctcccccgactggctgtgtcctgagtaactggaacatgagactgtatctgcaggactggccccatggtggccgagtcagaagtctgtttcctgtgagtcgccaccgttcactcagtcttgccctcccatgctttggagccagtctggtggctcctgtaaggttctcaaggctggtggcagctcagtctggggtcaggacatgtcggggtcatgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggacgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgggcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgta

SEQ ID NO: 15379 - DNA, 150597 bp, Human
  misc_feature (1)...(150597): n = A,T,C or G
aggctgaggcaggaggatcgcttgaggccacgagttcaacatggtgagatgccatctctaccaaaagaaaaaaaaaaaaaagggaaacagcatgaaagattgcttgtgggaatttcttgttggttttttaacaataggttaagcctggatggctacacctaacttcaagggaggctggacaatgcaattctatactaagaaagaagagtaaatgggtttggtgatcagctagtaccctcaacagtacctggcacaacactccattatgaagaaacaaagatgaattagaaatggatcaacacctgtgaaagaagggaagaaaaaaataaaagaaatggaacttgttctaaaaaagtttattaacgtatacacagaaatcagtattatatctgatctaagagtataatgaatccttcatttccaggaatctagagatagtctctaaaataaaattaatgaatttatagatttgtttctcaggacaataaagtttaaaaaaattaatctatttttccactttaatttgtcaccttcaagttttccattttatttcctctgggttttagccttcctaaatctggtcacttcactaagttcacagagtcacttaagtttctccttccttaggtttggatggttacgttaggacaagcctatagttaaggcaatctaatagaacagaacagtgacagatgcatagtaaacattagggaacctgtgtgcgtggagccacagaagcttagaacttggagacgtgaccctagatcaccatataaaatgtttgcaaatatttttatggtattctttttctgctcagaaggaaactgtagaaattaaatactgcagaaatttgagttctacactcagactaaagcaaacacatggtcacgtgtgttaatctgtttgtacttaaagcttttccattctaaactggtttacatgtcctggactaaatcttagtattaaaggcacagaaacacagaactctaagggacctcattcacaaccattcaccttaactgagtcaattcagaagggacctgaaatctagagttgaccgatttatccgacagagagagaaaaaagtgaaacatttttgaacccttatcaataggttttggcttacttttcccaaaacagaatcctccctgaggtagtcggagagcagagtcctggacagcagttccgtgcactagggaaggaaattttagagtcgagtgatgcaggcggagaccctgcggctgagaacgggcgatgcgggtgttgctgtgacccctggaatgcaaaggactgcacccccatcagaaagttagaaagccagtgcagagtagccaggagtcctgttcactcggcaggagcaggggtgccgagtggggggatctctggtcccgcagctcggccgccaccaagagcccgaagtgctgggcgcggtgccaccagaggcccgccacgccccacgccgccctgcaggcgaacgctggaggccccgccgggccgccgtagcgctgcggctcgggccgctcctcccgcgccgccctccgcccccagcctcccggcgccgcggcagctctgggcagggagcgccgccgccgccgccgccgccgccgcttcctcgtctgcagccgttcggccgctgcgtgacgcgtcgtttcctcccaacatggcggccggggcaggtcggcggtgatgggggccagttcgcggccgcggcgggtgctaatccccacagtagccagggtagcccttctctcgcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttaggtgagcggggaggaggcccgggggatggggtgcttgttgtggggcggggaggggggcgcctgtgggggggtggggtcgcccggggcttgcccgaggcccgcgcctctgacctcgggaagccctcgcggagccctctgttccctgtctggagttgacaggaactcggctggatgtggggcagaggcggggtagaggaggaagggcagtgagctgggctcgggaaacgcggcagggcttaggatcgcggggcacctgggttcgagggatcgacttgagagtgagaggattttgttggtggtccgtgaggtgcggactggataccaccctttgtgatgaagcagaagatgagctgttgtttattagcttggaaattgaggtggggctggtatgtcaagattgggtgtgggaaaggttccgtatcataattaacaataactttttcgtttggcgaggtactttggggagataggctgctgaagttgtttccttgttgacagtcttgagaaggggtttgcaagaggtgcagcccgttctgacatctctccgcctccgccacaggaaaaacatagagtaatattgtatctgactgggctgacctggaagaacaagaccggtggttaaggggtgagggtgggggtggcggcatgaaagcagggaagcaaagaacctttagataaaatggctttaggtgacaagggaagggagggtttgaaatgaggaaaatgaaaaagacaatgacacccaccagccacatgtctggacagtggcagctgctctcaagcttgaattgtgatttatagttcagatggaagagatctagtgtaatgaagcccgcagcagggaaaatccaaacaatacctcctacctatgaggttaggcagatgaggagttgttaaagggggaacattgttagatctattgcatccatcaaagttgaaatcgtttgagagaccagaacatttaacacaaagatacattcctaatgtttacactttatagcactggaaatacactaggtcaaattggcaagaaaaggaagcttgttaaatgggctttacaaaaaagcattcttgaaaggggaaaaatccacaataacttaaagtatgctagagttaaggagtctagacaacttaaaattagcttttaattattaaatggaagactaccatttaatttgctgtaatatactgtagtttttttttcctagatcgttaaaattggtaatatgaaaaacgtcgaagaaatttcatcttaaaacatttgaatgtgtagtattaggggcttaagattattttttcaccttacttatcgaccagaagtttgcattttgttatttttgtagctaacaaaagactgttcccggtgtatgagaagacagttgtctagtggcaaaaactgtatttatatctagatcctgaaaggaataatattaaattggagtgagactggggagaaagtgatttcaggatttttaaaagaattgttatatgtaggtttgtaaattacttgaaggttgaagaactttagagagattcaaattaaagttttaaatttttgtttgttttttgagacaggggcttgctctgtcacccagactgaagcgcagtgacacaatcagtgctcagtgccgcctcaaactcccaggatcaggcattcctcctgcctcagcctcccaagtaattgggacttcaggcacaccaccacacctggctaattttttttttttttttttttttttggtggagatggcggtctctctatatcgcccaggctggtctccaaatctgggctgaagagagcctcccaccttggcctcccaaagtgctgagtttataggcatgagctacctctcctggccttaattttttataattcagatttttcatgttacaacatatttttaatacattaaattgtaagtatcaaactgaagaaatggagtgtgttgtgtgtatgtatatattttccttctccaaagtagtaacataagtaagcatattttaatggagagcctactggaatgagagtctgagatcctaggtttaaatcccagttctgttacgttgtagtattaggcaagtccctgggccttaagttctctgtaaaattagggtattgaacttaatgattgtatggtcacatctcctctaatgtgccataaatgtgattgcactgtcctgttaactcgtgcattgggtattccctaccactcatgagcatcatctttagagggcctatagcgctctaaatggtccttgccatttctggaggtcgggattacttgatatgtgtgccaactgtaccagggttgtctattccagattttgacagtttttacttttttgtcccttctgtatactcaatagaagcttgttacgaggaatgtgactatccagggaagggctaggcaccacagtactttatttacttgagatgtatgaggcattttttcccacatttcgtaaagttacatttagcctccaacaaagcaaaatctcagtaatctcatggtagctaatccctggtgaactttgtttcttcccttgcagtctatctacatcaccacccaaacataaattgataagcataactcattttgtctttgcagaaagtatattttgcaggaagatggtattcccacaaatgtattgtccttgaagaccgttagagacttatcttctccacttcactattgagacctgggccaggcccgctctggtctgttggtaatctatgtggccattaagcaggatgggaaagcaaactgaaaaggcctgatttagtcctctcggttctatagattgtgagtgggtaggtgttggatggtgaagatacagagatcattttgtgggtggtgttataacccttctaaatacccacctgtctgtcttcattctttccccaaatatttattgagcatacagctgaagggagatggacagttaacaggaaaatacatagtatgtcagacatttaatccttttttgtttgaaaatcattgtattggcatgtgagtagatttctgagtattgccattcaaaattaattcagctaccttttaacatatggccaattatagatggattttctgtaaactatactcatgaaattacagcttattgtgtattcttaaaacttttttttttgtcaaaaagtataacttatgaaacagcatgtagattaggggaaattttacttcattaaaacaatccattctcaaagacttctcaaggaacttttattttcacagaaagaaaaataaacctttaaagggatgcagagttaatgtaaaacgtttttcaaattttcttatgtcagacttcattttgaagtaaagaatggttaaaaaagaaagaatccccccccccgccccacactgttacactgttacaactgataagaagcccacaggcccaggaacagctccaggttgccctcttttggtacctgccctactacagctctctgcagagagagggagtctaggctgccctagcttagcctgatccattcctgctctcgagaatcctgacttaaaaatagtctggccatctgctggcagatgagacaacagctgagctatttttagtttcaaagaatttaggattgttgtgggattgggcttgaaggtagcattgtttatctgctagggagggtgcagttgggacttattccagtaaggcctctaagtttcaggagtttcttttatgttagggttgtgactagttcagcttatgctttctgacatcgaatgaagagtatctatgaagatactctgcaaatgttaggatgaaagagttcaaggttggaaactgtcactgatacacaataagagtgaaaaagttgaagagctgaccagaagaaggttttaaagggaagggaggcatatactggcagtgataagggtgggttcccaggaggtatatgggaaaataatggagacaaaattgttagggaagtaatttttgcatcagacagggtatgaatttatattgttcatcatattataaagtgatcctgctgacttagttttcttatataagagtctattacctgtaattatagtttcatccagagatacaatattgagactcaaacttttcagaacttgcttccttctgcccctttaatcccacccttatttttgttggtggagttataaaaaagatacgtcagtggaggggaaattacttgaatgctttgggccctggttttatgctacttttggtaactattaattttcatcactcttcaccatttatgaaaaaatgatttatccccaaacaatatcctgccatcagtgaacaccttaattataatttaaatccattaacaaatctccgtttaagccttctttgatatctaaagtaaaaggtgttttcagtaagccaggctacctgaatttttgagatgggtagaagaaaagagtataattaatgacataaccgaaagattgatcctatttgtatttgttcttttctttcacatttcagatttgtttttaggacacttgctctagaatagtgttgactgaaataaatgttgcagagtacaagttcttagagaagctctttgaagaaaataagtttgggttgaaaaaataagtttggattatagtgtgtaatctgtttccatttgggaaatttataatgcacatgaacatagttaagattctgaaaagtcctccaagaaagacacctgctcaattttgtttaatgaagttcttcctgaatttatgtgatcctttttcattgtttgctaactcagttaactcccctaggatatgttgttccttggaacttactttgggacactggggaaagaaagacaagtacaataaccctaactactggtgagaccatcttctagaagaggtttggggaaatcagtgcacaaacctgtgtttctctaaacacaggtttggggaaagtagtagatgtgttaatagtgtgggaaggagaagaaagtccgaaataaggagcagtagaaatatcgagatcagaggactgtttgctgactagctttctttcccaccccatctaggggcaggtaactcatttgtgtctcttggtaaggtttaacttagagagaaaattgtgaatgggaaataatttggggaaatatttgtcataatattcctcacataatggaggaaggaagatatttgaaaaggaaaaatacatgagtaagttattgttgccattccgaactaggtatatatttcaatcagatatttgttgaactcctcatatgttccagatactacttcattgctgggtatacagcagtgaaccaaacatgctttcatagaacacacattctagtggggtgagggtgatagtaacaaccttatatcatcagaagaaagagttcagaaggttaaagggaaaagggtgggagtactgatttagttagagttgtcaggaaagtcctatctgtgagatgacatttgagcaaagaagtgacataagtgggggatttagtctttcagatacttggatgaaatagaaacaggaaatagcaagatggatgtgtgcttggtgtgtttcaggatgcaaggaggcttgtgtggctgggagagagacagagagaaagatgggagggggtgggcagatttgggattttagtgacagcatgtttatgtttttaaaggctcactgtggccagagaccatggggacttaggctaagttggtggtggtggaaagggtgataattgtgtgcatttggaatatattttggaatccacaggatttgctgatgggttggttaacagaggggatggcatccagtcttgtagccagagcttcagggtagaggaagatggcattcacctcaatgggggacactaggatagaaaaagcctttgggaaatagatttttagacagtaaaacattttcatcctgccttttatatgtattttagaatgttttaatgatagaattttcagatgatataataggatattttctactgagaataacacaaaataatttcaatttgttttgtctgttttttttttttttttttttttttgagacggcgtcacgctctgtcacccaggctggagtgcagtggcgcgatcctggctcactgcaagctccgcctcccgagttcacgccattctcctgcctcagcctctcgagtagctaatctcgtgtagcgctaccgcgcccggctgattttttttgtatttttattagagatggggtttcaccgtgttagccaggatggtctcgatctcctgaccttgtgatcctcctgccttggcctcccaaggtgctgggattacaggcgtgagccaccgcgcccggcctgccttgtcaggttttttgcagggaggtttttttatcaaagaaatgagcctttcacttgtctggttcttttcctggaataggaactttgtggatgtagtgaaagatctcaaggtgaagttgagatcctcaacttagagcctttaggtgggccctaaatccagtgaatggtgtccttttaaggaagaggaagggacacagtcacatacaaaggaaaaagtccatgtgaaaatggagacgagatcagttactgctgccacatgctatggaatgccagaagccaccagaagtaggaagaggcaaggagggattcttccctttggatgtagcatagctctgctgtgaccttgattttagattttgggccaccagaactatgagaggaaatttctgttgttttaagccaccaaatttatggtaatttattaaggcagccttaggaaatgaatgcaagttcccttttatcctaacttttcagacccattttgatttctttattcaagtttccacttacagagtctactgtacatatgtttacacaatcagatcctgtctttggctcatctctgattgtttcatgaatctagaaagcagttattctgaggctttagtgtgttataagtagaggctcttgaaaagcttcttaaaaggtctgggctcaagtatttaagaatatttaaaaagttttgtgttctgcttttgatattttgttttgcttagacttagacttgatgtaactaaatttgtttatataacctatgttatcttttcattcagaaaagtctttgaaaatctttaaaatggccgggcgcggtggctcacgcctgtaatcccagcacttcgggaggccgaggcaggtggatcatgaggtcaggcgttcgagaccagcctggccagcatagtgaaactccgtctctactaaaaatacaaaaagttagccgggcgtggtggcagtgggcgcctgtaatcccagctatttaggaggctgaggcaggagaatcgcttgaacctggaaggcggaggttgcagtgagccaagattgtgctactgcactccagcccgagagacagtgcgagagtccgtctcaaaaaaaaaaaaagaaaatctttaaaatatttcatattaccactggcgtgtctttaggaaacgccatgtgaggctattaatttttcttaacaaaaatgtgtacattgagacttcatttaatcagctgtttaacaatcctcatctgtcagaactttgctaagaaataataaaaatataagcagtcaaagtacatattttgaaggccaagcactttatatagaagagaatctctatggcttttactcagtctgtatgcttttataattccagtaagtttggtaatttgatattttttataaacgaatccttcaaatcattttcaaaagtgtaactacaacaataaaatttactgtgatacggggcccggcgtggtggctggcgcctgtgatcccagcactttgggaggctgaggcgggcagatcatgaggtgaggagatcgagaccatcctggctaacacagtgaaaccccgtctctactaaaaatacaaaaaattagccagtcgtagtggcgggcgcctgtagtcctagctacttgggaggctgaggcaggagaatggtgtgagcccgggaggcggagcttgcagtgagccgagattgcgccactgcactccagcctgggtgacagagtgagactctgtctcaaaaaaaaaaaaaaaaaaaaaatttaccgtgatactcttagctgaagataaataactactgttaactttttgaaaaacaactttctgataaatgatttacatactatagtatttactttttttgagtgtaatgatttttggtaaatttactgaattatgcagccatcagcataaatccagttttagaacatttctattacctcaataaaatctgtagtgcccttgttgtcatccctagcttctggcattcactaatctattttctgtctttagagttgccttttctggacatttcatgaaatgcagttatacacaggtggtcgttagtgtctggtttctttcagtatgtttttgaggttcattcatgaagtttgtatccacacttcatttccttttattgatgaatagcattccattgtttagatatcctatattttgtttatccatttaccagttgatggatatttgggttgaatgaataatactgccatgaatatttgtgtgtaagtctttgtgtggacgtaaactgttatttgtcctaggtagacaaactgggaagggaattggtgggccacttgataaatttatgtttaactttttaagaaactgctaaattcttttccagcctacatacccaccagcagtgtatgaggcttcccgtttcttcaaattctcaccaatatttgttactgcctttttatttttagccatcctagttgttatgatgaagtgttacttcattgaaacactgttaactttttgaagtacagattaaatatcctttatcagaaatgcttgggatcagaaatgttttcaattttgtttttttttttttttttggactttggaatatttgcatatacataatgaaatatcttggggatgagattgaagtctaaacacaaaatttactaatgtttcacatccaccttatacacaatccaaaggtaattttatgcactattctttttttttttttttttttttgagacggagtttagctattgttgctcaggctggagtgcagtggtgcgatctcagctcactgtaacttccgcttcccaggttcaagtgattctcctgtctcagcctcccaagtagctgggattacaggcatgcgccaccatgctcagctaattttgtatttttagtagagatggggttttgccatgttggccaggctggtttcaaactctgacctcaggtgatccgctgaccttggcctcccaaagtgctgggattacaggcatgagccactgcacctggtcttatgcactgttgttaattttgtgcatgaaacaaaattttgactgtgttttgactgtgacccatcacgtgagatgagattcggaatttttcacttctggcttcatgtcagttctcaaaaagtttcagattttggaacatttcagtttaggaatgctcaacctgtatttttccaaaacttcattctacacacacatacatgggagcatggacatgcacaagcatattcttcaaaaaattgaacagccagatgtggcggctcacacctgaaatcccagcacttaaagaggccaagacagggagatcccttgatcccaggagttcaataccaacctgggtaacatggctaaaccgtgtgtctacaaaaaatactaaaaaaaaaaaattactgggtgtggtggtgtgcacaagctacttgggaggatgaggtggcccagaaggttgaggctgcagtgagctgtgatcccaccactggactccagcctgggtgacagagtgaaaccctgtctcaaaaaaaaaaaaaggccaggcatggtggctcatgcttgtaatctcagcactttgggaggccgaggtaggcggatcacaaggtcaggagatcgagaccatcctggccaacatggtgaaaccctgtctctaccaaaaatacaaaaattagctggctgtggtggtgcgtgcctgtagtccagctgctcgggcggctgaggcaggagaatcgcttgatcccgggaggtggaggttgcagtaagctgagattgcgccactgcactcctgcctggcaacagagtgagactcttgtcaaaaaaaaaaaaaaagtatttaatttttaaggcaataataggaggaaaaagaatagctaacatttattgagtgtttactgtatgccagtttccgtgccaattaaatacttcattgactttatctcagttagtcctcagaacaaccctatatgcttaggttctgttattacctgcattttgcaaatgaagaaaatgagtttgtgtttggcagaattcgaatatgaccttagagcctacatagtcatcttgggagttgtgttgcactctgctttttggcctaatgtgtcagtcctgtgctgcacctttaatcacagtactacatgtttgtaagtaacaatacaaaaaggaaaagaagggcaactgtagaaagaaaggcactgtcaaaaagagaaaaagggccatatactgaacagacatagaaataacagcaatacaggaaaatattgccatgtacatttcagtgaatctccagggtaaatattcatgtgttcatcatgggatccccaaatctgtcgtgtacaatataattttaattctcttttctgcttaagaagtcaggcaaattcgtgtgtatgtatcttctaagatttaattttaaagtaaagtgtcagtaatttaagccatttggaaatttaatgtgccctgtaacacctcccagggattcaggataggttagcttttattgtgcttctatgcctaactgtttaaaactactctcatttgctttttatattaatattttgtaacatttcaaatcattttaagaattgatacaagaacaaaatcttattaaaatgttatgttatgtgaaattaccaataagactttatcttaaaataactagttgtaaatctcagtgacttcatatgtaagtatataaaagtacttattgtgtaattgtcatgattttctgttctctcatcaatatttcatgtgcattttctatatatctatgttgtcttcctacctagcattttaacagtgtgtcatttgtttaaatatttttgagtttggggacatgttacatttaagttttgctgcacagattttttttttaaattaatcccttgcagagtttgtttagtgtttgttatatatgcagaactgtttaaaataaactcttaagattttgattgttggattagagtgtggtcattcatgactgttccttaaggcaaggttgccatacatagtatacctgtgctaggtacaaataaacaacagagcactgaggaggacaagacagagaatttgctgtctttagatttattggttttgatcagtgttttatcacttcatctttcctttgcattttttttttctgttctaagagtgaaaaacaaagacataaaaattcctctttatagttaggatatctgtactttcattttctatgaatttgatatttttcatcctttttttcttgagggttattagagtatatcttagtctgtttaagctactataacagaatactgtaaactgggtggcttatggacaacagaaatttatttctcacagttctttatttctcactgggaattcaaagatcaaggtgctgacagattccatatctggtgatggctggttccttatagacagcaccttctagttgtgttgtcacatggtagaagagtgaaatacacctcttttataagggcactaattccattcatgagcgctccacccgtatgacctagtcacctcctgaaggccccacctcttaattccatcacactgggaatcaggtttcaacatgtgatttttttgggaggacacaaacatacagaccatagcagggtatataataagtatgtattttaaaagttcattttgtttctctgaatcgatgggtgttttaatagcagttactaagtaattttaaaacatcacatcatattccatcagtcattttcaatttgtattagtatagtacttaatgtggtatctggtaagattgactagtcttcgttgtttcttaatttttttttaataatattacttctttttccaaataacttaaggattttcttttaagttttctaatgctcattcttaacatcttattaacatgttacttaatcagattttcttgccttctcttcttatacattagataaaaagtgttatagttgggaagtagttgattattttgtttcatccaatttgttgggtccccatgcttccattccctaagttttactttttacctgataattgagaatgtgtttgtttaatgcagtatcagaaagcaacaatgtttaatgcagtgacaagcaaagcttatgtgtaatttctgatgtgctttgatctttagaaataagaatggaaccatgtgcatcttctgcaaagatgaagagtaaaaataaggtgtaggttgtttgatactagttaatagtcagtagttaagattttatagtatacaccagtgtccaaaaatgagtttttacaattattagagaaaaaattttttatagtaaataacagctctgtgtctatagttatcttgctagaagatacaaaggcagaaataaagttatattattagaatgtgttttttttactaactgcaatgatgaatctgtgtgtttgaataaatgaagtgaaggtattttgttctttttgtttctaccctcaatccccatttttatgactgttatagaagattccttgagtggtaaagtagaaggaaaggttcttttgtttgtaatatgtacacattctttccttaaaaagtcaatgagtatgccaacatatactctcttaaacttgtatatatggctacctttattgaattgttttccttatgaaatagttaaatatttctcaattcttaattttcttttacatttcaaaaagcaccctttagtaggtaattaatatgcaaaattatggtttctctaagaaaatgttaggttctcaaaattgtcactattatagttctttttgtttgattgctttttcttggtttgaatgaaaaatatctttaagaaagatttgctaatctttttctgttttatcactaagttaaaattatatttatttttactaagtagttttcagttttgtgttattaaattgagtagcctttgtttttttttatttttagcactcccctaaatggtttctaccaattcagtctcattgaagctttctatccttaacatttgtaaaaataatataatctttcattaatagcaaataagctttgtttggttttgctgctcatgcatgcctaatgctgttctgtgtaagatatatctcactagttagcttgactaaaacttcttaatgtaaaggttttattgatttagtaaattaatgtccctaaatattttgtctaagatagtcactgttaataatttggcttttcagaaagtgtataagaaaacaaaaattttttttttgagtttggaaattaaatgttcttaagaatatttgctttttttctagctctttccattttttaaaaaattctttttatttatttatttatttatttatttatttatttatttatttattttgagatggagtcttactctgtcgcccaggctggagtgcagtggcacaatctcggctcactgcaagctccgcctcctgggttcacgccattctcctgcctcagcctcccgagtagctgggactacaggcacctgccaccacgcctgactaattttttgtatttttaatagagacggggtttcaccgtgttagccaggatggtcgcctgcctcagcctcccaaagtgctgggattacaggcgtgagccactgtgcccggcctaaattcttatttttatcctgaattgtttgtttttttgttttgttttttgttttgtttttaaagatgcccaggctggagtgcggtggtgccatgtcggctcacggccatctccgcctctcgagttcaagtgattctcctgcctcagcctcccaggtagctgggattacaggcacatgccagcatgcctggctaatttttgtatttttagtagagacggggtttcaccatgttggccaggctggtcttgaactcctgatctcgtgatccgcccgcctcaaccttccaaagtccagggattatacaggtgtaggctactgggcctggccctgaattttttattttaaaaaattaccacagtatttccattcctttttttgacccatttacgttaatttcctaccggattctccttctttctccttcttttcaaaccctcagaatctctgtcagcattgatttatgaaaacattcttgatttataaagacattttaactcaattcaaacagtttaaaaataatcagagggtaagctgaaatacaaatacacatttagtttacaactcttgatgtatccttacaaatgaccactatgttgcagaaatgagggaaaattcactacatggtagaacagtgataggtggaagtttattgctagatcccaggaggaatgaaaagctaaaaggatgagagagaagagctagatatggaggacagggaacataaagctgtgtaacatatggataactcattttctgaagcataaaacaaaaactagaaattgctggcaaaacaataatcagagagatgctggagaaaacttctgcactaaaaaatacttgtgtgtgcaaactgctatattctaggaagaaaaatactcgatgtaaaaagacttacaaatctcagtctagcaatattttttaatattaaagataaaaaattaatcttgtaaatatccaggcagagaaaataagcttccagaagaatagttcagtttgttaagactgtaaagaattagtagcacccatggctatttaaggaaaaaaaaattataacagtttcagcctaggtacatttaataggaatttgctgaaaatgataaaacagcaactctgctaataaacataggcattctcttttatatcttttttaaaaaaatgtcttatctcacctctctgtcatctttttcccttgttcccttctttatctccctcatctctccacccctttctttcaccccctctatttcaaattcttctagaatattgttagaaaacaatgagaaatgtgttacaaagatatatgtacaagtgtattcatcattttgctgtttataattaataaaatgaaaataactcaagtagtcaacaatataggattgattaaatgatgttgtgttaatacaagggaatgttacaaagtactatgtagtgatgtgcttgaaatatacttactgaaatgggaagatgaatgattggaaaaagcagattatatagtacttttcttagaacaaatatgtgtaggtatacagggaaaaagtgttgcaaatacaaggaaattttgacaaatataatcataccaagtaacacgttttactgtcttgtggtagaactactataaaatattcatggtgtggttagaagtatgtcattgggccaggtgcgttggctcacgcctgtaatcccagcactttgggaggctgaagtgggtggatcacctgaagtcaggagtttgagaccagcctggccaacgtggtgaaaccccatctatagtaaaaatccaaaaaattagccaagctgtggtggcaggtgcctgtaatcccagctacttgggtggctgaggcaggatgatagcttgaacctgggaggcgaaggttgcagtgagccgagatcgcaccattgcactccagcctgggcaacagcgaaactctgtctcaaaaaaaaaaaaaaaaaagacgtacgtcatcgaggagtctgtatgcttctgaagaacttctacaaatgcaaaaatattacctatttatcttctttctcaagcatgtggtatttaaatatagagtaagaggaaaaagaaaacatacacacaagtataagtagtgggcttattgaagtagaaaaataaaatcaaggaagaaggttgctgacatcaaatatagataattgaataatagtcatatttatttacaagcaagtcaacctcatagtgaacacagggataatttaaatgtttttgatattgcttggagtatgcctaactagggtattagatgttgattgtactttgggctttattacccaattagcttctaataataggaaggaaattgttttgttcttcaagtcaagacctttctcactttgatttctcaaaatgaaagaataactggcctgacataggattttgactaggaaatatttatacagtaaatcctgacttaatgtcattgatataggttcttggaaactgtgactttaagtgaaatgacatacagcaggtccttgaataacattggttagttaaacatcatgtcattataaggttgattagaaaaaattgattttgttatacataattttgcttaaaatcacagtttccaagaacaacaatgttaagtgaggacttactgtaatttatgtctttggtaatcttaagtattatataagaaataaaaagtatttttgagagaacctaattggttgctgttattttctaaaacacaagccttagcttcatcacaaaaaagaaacctaagttaagaaaggtgtgtaaggtttcagatctcattttcatgtatgtatccatttaggccttctcaacacatccagaaaaggtatggaaagctaattcaagagtataggttgttttaatgtttgtagaaagcccggtgttaaccagtatagatttactcttgcagatacttcggtttacatcctttctagagatggataccaagttcttttcaattatatggaaactgccatttatcagttattttcctgtatttcatatttgagtcacaaaacagtactgtgagtcatagatgttctttttcttttatttctttttttattttttgagatggagtttcactctgtcaaccaggctagagtgcagtggcacaatctcagctcactgcaccctccatctccaggttcaagtgattctcctacctcagcctcctaagtagctgggactacatgtgcatgccaccatgcctggctaatttttatatttttagtagagaaggggttttaccatgttggccaagctggtcttgaactcctgacctcaagtgatctgcccgcctcggcctgtaatccctttgggattccaaagtggtgggattacaggcatgagccactgcgcccagcctttttctcatatttcatattcataagtgctttcctgaaattagctaaaatttgtgcttattccattataacttgattaaaacttttttagtcctgagtagatgcacttctgtcttccttcccttctttgcccattgggaaatttctcaaaagtcttccttcataataattcaatatttatttatgtttgttactagtatttatttgcagataacctttgggaatattagacgtattagttattcatatgttggtactgtccttagatttttggagagagctttcttgccttcaacatctagctgagttttgtcccactgagagaatgggaaacttgactgaaatgatgggagagaatggattaattttggaacatggggcattatgggacatggtaggactgggacaggcctgatagaggctcctttatgtaatgtaagcatagcatgaggttgtaaggagacaatagataggaaggtgcagactggtgagatgagaaagtattaaaaacaacctttgaagtgatgagatgagaaagcattaaaaacaacctttgctttgcccttaggaataatgtgtattatttaaaaggtgtaagcactcattataatttgttgatgatagtttaagtatatggggtatgcccattagccattttctgttaaaaaaaaaaaaaaagtggatttttcggcctggtgtggtggctcacgcctgaaatcccagtactttgggaggctgaggtgggtggatcacctgaggtcaggagttcaagaccagcctgaccatcatggagaaaccccgtatctactaaaaatacaaaattagccgggcatggtggtgcatacctataatcccagctgttcgggaggctgaggcaggagaattgcttgaatgcaggaggcggaggttgcagtgagccaagatagcgccgttgcattccagcctgggcaataagagtgaaactctgtctcaaaaaaaaaaaaaaagtggatttttttctctctggctctttgggttaacctaatgttttgtattttaaattgtgttactgtgaactccagttttaccatgggattaaaagctaatgtaaatactttttagtcttcactattttatttaacaaacatttattgaacatcttaagtgtgtcttaaaattgtattaggcactagggaaactagggaacacatatgtggttcctaccttcaacagcttgtaatctcttgggggaaggcagatttgcagtaaatagatgttagaattgataaataggcgctatggtagacatatatgaaattgatggaaacccaaaggaagaataattgataagttcttttcaggagtactagggtagggtcatgggtcaggaacagctttatagaggaatcactctggacttcaggcttggaagatcactagatgagtttgccatagaattataggaacatgctgtggcagaactaattgtatgagcatagagaggtataaggaagcatgtctgcacttagggaactgcagggagttcagtatgactgtgggaatacagtttggcaaagaaagcaaggatgagatcattgaagacctttttttgttttgttttgttttctttgagacagagtctcactcagttgccaagctagagtgcagtggcgcgatcccgcctcactgcaaactctgcctcccatgttcaagcgccccaccttctattgtagacagtagaatgccaagcaaaggagtgaaattgttgttgcatttcagagaaatcattctactctgattggcatattgaaaagtaggttgtggctggctgcggtggctcacgcctgtaatcccagcactttgggaggccgaggcgggcggttcacaaggtcaggagattgagaccatcctggctaacatggtgaaaccccgtctctagtaaaaatacaaaaaaatcagccaggcgtagtggcaggtgcctgtagtcccagctacttgggaggctgaggcaggagaatggcatgaactcaaggggcggagcttgcagtaagcggtgatggcaccactgcacttcagcctgggcaacagagcaagactctgtctcaaaaaaaaaaaaaagtagatttctgggattcagaactgcaggcagtgagactgttaataaactgttgccttagcacaggtttgaagaagtaagggtttgaacctgaggcactgaatatggaaagcttagatctcagtaaattaacaggacttcataaatgtttgggtgtgaggaatgagagaaaggaaggcatttaggatgattctgaggtttctaatgacatgattttgagaagttggatctgttcaccaaaaatggcagtatgagaaaataagcacattcgacataaatgggttgaggaaaaatggacttatggttatattgagtttgagtgcatatgggacaccagagtaaagatgtttggttgatagtagtttataacatgacacaagcctaggggagagatctgagttgtagatcaacttttaagttatcaggttaagtttaaggtttaggtgttaccaacatatgttacccagttaggtcttttggagaaaaagagatgtatattaagttacctggtaaatttactctctcatttattgcttttttgttgttgttgttgttgagatggagtcttgctgtgtcactcaggctggagtgcagtggcgcgatgtctgctcactgcaacctccacctcctggattcaagcaattctcctgcctcagcctcccgagtagctgggattacaggcttctgccaccatgcctggctaatttttgtatttttagtagagacggggtttcaccatgttggccaggctggtctcaaactcttgacctcaggttatccaccccctctcaaagtaatctgggattacaggcgtgagccaccgtgcctggcatttattgctttctttggaaaacatttaagtatatatttgttcccgattttattctaagcctgatgaatgtaaagatgtggtataaaatgtggtctttgctgttaaggagcagattgaaggagataaatacataaaataatttcaatatgctaaggtaagtagtgatagtaataactggaggaagctatgggaatagagaagtgtaattatcttagcctagaagtgcaggagaagacttttcggtaaagacaggcttttgtttttgtttttaagagacggtctcactttgttgcccaggctagagagcagcagtgcagtcataacttacagcatcctcgaactcctgggctgaagtgattctgctaccttagcctgcctccctagtagctaggactatagtcacatgccatcatgcctggctaattttttctttaactttttgtagtgatggggtctctctatattgcccaggctggtcttgaactcctggcctcaaacaaccatccccactgggcctcccaaagtgttgggattataggcatgagccaacatgcctggctgataacagctatttattctagaaggatgaatggattttagccaggaaaagatgggtggaaaaagtattctggggaagaaggagcatcattagctaaggcatgaatagccgaataaacccaaagtgtgagagagttacctagaaggttggcattttaagagacttaagtgtacagcaggaatggtaggagatgaggctcatggaaagtgttataggtaaggatggttggaaaaccactgaaaggggttttagttgggagtgacagagaacatatgactgaggcaaccttgaaaggtacctgttggacatagtggtggtgggatggaattcaggcagaggacaccatttgagcaaaagcctagaggtatgaaatggcagatctttacaggggatttacaatgttcctttacaattggagtgtggaatgcaaggaagggcatgcagagagatgagagtggtaggcaggagccaaatcatggaggcttttgtgtgccatgctgaagagcttgagctttatctttgtcatgatcactctggcactatgtagaagatggattagagccagtaggcctgatgagagatgaagccctgacctaaagttaaagtggcagaaaggatggagaaattaaaattaaggcattaaaacagaagttctcggccgggtgtggtggctcatgcctgtaatcccagcactttgggaggctgaggcgggcggatcacgaagtcaggagatcgagaccatcttggctaacacggtgaaaccccgtctctattaaaaataaaaaaaaatagccgggcgtggtggcgggtgcctgtactcccagctactcgggaggctgaggcaggagaatagcgtgaacccgggaggtggagctttcagtgagccgagattgcaccactgcactccagcctgggcgacagagcgagactccatctcaaaaacaaaaaacaaaacaaacaaaaaaaacagaagttctcatccttggctatacaaatacaccaagatcacccgtggagcttcttaaaaatacaaccaactacgtcacattactggagatcctgcttcactaagttggagtatggatgtaggcaacctattttgctttgtatttttgttttttacgttaacatacagtaaatttgactttcttttttactgtacaattccatgaattttaacacacatgaagatttgtgtaacttctatcacagttgggatacagaatagttttagcacccccaaacccccccccatacttatagtcacaccatttctcacatacctaacccctggcaaccactgatctgttctctgtcgttttaagaatgtcataaatgtggaatgatacagaatggaggcttttgagactggcttctttcactcagcatgcatttagggtttatccaagttgttgtatgtattagtagtcttgtttctttttttgtttgattttttttttgagatggaatctcactctattgcccaggctgaagtgcggtggtgcgatctgcttattgcaacctcttcctgggttcaagcaattctcctgcctcagcctcccgagtagctggattacaggcgcctgccaccacgcctggctaatttttgtatttttagtagagacggggtttcaccatgttggccaggctgacctggcctcgagctcctgacctcaggtaatccacctgcctcagcctcccaaagtgctgggattataggcgtgagccaccacgcctgactgtctgtttcttttttactgctgagtgtatggatgtcgtatagtttgtttaacactcattgaagggcatttgagttgtttccagttttggcagtatggttagagctgctataaatattcatgtacagatttttacataaacttaagttttcatgtttgtctagggtagatacccaggagtgggactgctgggtcatatggtaagtatatgtttaacttcatgagaaacttacaaactgttttctaaagtggctgtgctattgtgcatttctaccaacggtgtatttgcgttcttgttgctccatatccttaccgactcttgggagtgtcagtatttttaaaatttaaccatgttaataggtgtgtagcattaaatcattatggtttttcatttgcattttcttaatggctaattatgttgagcactttttttttttttttttttttttttttgagatagcgttttgctctttcacccagtctggagtgcagtggtgcgatctcggctcactgcaacctccgccaccccaggttcaagcgattctcttgcctcagcctcccaagtagctgggattataggcaccggccacaccaggcccagctaatttttgtatttttagtagagacagggtttcgctctgttggccaggctggtctcgaaatcctgacctcaggtgatccacccgcctcggcctcccaaagtgctaggattacaggtgtgagccactgtgcccggtctgagcatctttttttatgtttatttgccatgtgcatatcctctttggtgaatgtctaagtcttttgcccattaaaaaatttcgttgtttttttactgttgagttttaagagtttttaaagtatatattctagatacaagtctttgccagataaacaatttgcaaatattttctgtagcttaccttttattctcttaacattgtctttcacagagcaatcattttaatcttgataaatccattttattttttcttttatgtcacatgcttttggtattttatctaagaactctgccgaatccaaactcacagagagtttctcctatgttttccgaaagtttgatagttttttgttctaacatttagatctgtcatccatttaagttaatttttgtataaggtgggagttttaggtcaagagtttttttttttttttgcaaatgggtgtctaattccaacactatttgttgaaaagattatcctttctccattgaattgcacttgtacttttgtcaaaaattaatcatctatagttctgtgggtctgtgtctggactctattccattgatctgtgtttctgtctttaacactacattgttttgattattataatttaaaattcttaaaattggagatagggatttctcccaagttattcttctttattagaattgttttgtctatcctagttacattgcctttcctaacaaatgttagaatctgtttatgtgcagaaaatcctgctagaattttgattggcagtggattaaatctgcagataattttggggaaatctttattgtttttatactttcagtcaatgaacttgatatatttattgttttttagttctttgatctttttatcagcatttctttcagtatatattttatatgtgttttgttaagttcatacttaagaattttattttgtggtgagctattgtgaatttttttttgtttttgttctgttttgagacagggtctcgttctgttgctcaggcagtggcatgagcctagctcactgcagctatcaccttgtgagctcaagtgatcctcctgccttggcctcccaagtagctgggactacatgcatgcaccaccctgcctaatttttaaacttttttgtagagatggcggtctcactgtattgctcaagctggtcttgaattcctgaactcaagccatctttttgcctcagcttcccaaagtgctgggattacaggtgaaccattgcacctggctgtagatagtatttttttaaaattttgggtttccagttgttcattgctagtatatagaaatgtgattgatttttgcatgttgcagccttgctaaattcatttatgagttcttagagtttttttcttcttcaagatttcttgggattttttacttaaataatcatgtaatctgtgaataagaactgttgtatttctctctaacctatatacctttatttacttatttacactgtctgggatgttcagtacaaagttgagtagaaatgatgagagggtttcctcacccaaccagctcttggttttgtgtagctactgtttatcattctcctctattgctaggttactgagtttttaaaatcatgaatggatgctgaattttgtcaaatgatttttctgtatcaattgaaatgatcatgtgatttttttcttctttagcctttttttttttttttttttcttgagacggagtctggctctgctgcctaggctggaatgcagtggcaccatctcggctcactgcaagctgcggctcccgggttcacgccattctcctgcatcagcctcccgagtagctgggactataggcgcccgccaccacgcccagctaattttttgtatttttagtagagatggggtttcaccgtgttagccaggatggtctcgatctcctgacctcgtgatccacccacctcagcctcccaaagtgctggaattacaggtgtgagccaccgcgcctggcctgtttagcctatttctatggtagattacaggggttgactttttttttttttttttttgagacagagtcttgctctgtcacccaggctggagtacagtggcacaatcgcagttcactgcaagctctgtttccctggttcaagcaattcttgtgcctcagcctcccgagtagctgggactacaggcaagtgccaccgtgcctggctaatttttatatttttaatagtttcaccatgttgggctggtctcgaactcccgacctcaggtgatccacctgcttcagcctcccaaagtgctgggattacaggtgtaagccaccgctcccaacctttttttttttttttttttaaatattagttctgtgtctttagaataaaccccagtgggtcatggtatttaattctttttataccttgctggattctagttagtatttgatgatttttgcgtctatattcatgagtgatatttgtctgcatttttctatactgcctttgttcagtgcagttctgatgctaactacatcataatttggttctggagttgagtcgtatttcacaggttaaaggcatagtccttggcaaaactgttttcacttcagataccagctaatgcttgagagtttccagaccacaagcacttctgaccaactggctacaaattcaggggttcctgttatctcctccggttacgtagagcaactcacagaactcaggaaagtgctatttcaggattgtggttttgttataaaggacacaaattaggatgattcaaaagaagagaactataggatgagtttggaagggcctcagacgcaaagcttttgtgtcgtcagaatgctttaccctctcagctcattgatgtgtatcactaaccaggaaagcttacccaagctttgggtgtccagggtttttgttggggtgttattacacaggaattattgagtgagtcattggtcacatgattgaatctgaactgcagccccctcccctccttggaggtggggctgagatcatgtggttcaaagcccaaactttactcacatagttggtctttcactaatccctatcctgaaactgtccaaggggttcatcatgaataataaagatgctcctgtcaggaagtgtcaagggtttagaggctccctccctgaaccagggacaaagaccaaccagattcttaattatacaacagttcaggctgaggatggtggcccatgcctgtaatcgcagcattttgggaggtcgaggagggcagatcacttgagcccaggagttcaagaccagcctgagcaacatggcaaaaccctgtctctacaaaaaatacaaaaattagctgggtatggtggcacatacctgtgtcctagctacttgggaggctgaggtgggaggatcatggagcctggggaggtttaggctgcagtgagctgtgattgcgccactgcactccagcctgggcaacagagtggaccccgtctcagaaaaaaaaaaaaattatacaacagtccagttttgttatcaagataatattggcctcttgaaagcaactgagatgtgttttatcccctaatattttctagaggagattgtacaggattgttataaattcttttataaacgtggtagaattctcaggtgaaaccatctggtccaagatatttcatttttggtagtttttaaactatgaattcaatgtctttaatagttataggactattcaaatgatctatttcatattggaagaattgtggtagcttgtgcttcttgaggaattggtctattcatctcagttctcaggtctttgtatgtagaattgtttgcacctagtccctcttaatgtctgcggtgtttgtagtgataccctgctttattttttctttcctcttgttggagtttcaattttattgatcttatcaaacaatcagctttttaaattgatttttcctatttttctattttcagttttgttgatttctgctcttgtatttattatttttccttttttttctgcttgctttgggtttattctgtgctgcttttcctagtttcttaaggtgggagcttagatttgggacttttttctaatgaagtattaagtgctgtaagtctccctttaagctgtatcccatacaattttagctgtatcccataaaatttgttatatttttatttttattgagttccatgtattttttaaaaatttcccttaagacttcctctgacccatggattatttagaagtgtgttgtttaatttccaagtgtttggaaatattagtttttctccatgattcctatttttatttcattttggtagagaacacactctgggctgctctgcctgtggagtaaccattcttttattccttactttcttaataaacttgctttcactttactcggaaaaaaagaacacactctgtatgatctcagttcttctaactttgttgagatttgttttatggcccaaaatatggactgtcttggtgaatgttccatggacattttaaaataatgtgtgtctgttactgagtggagtattctataaatttataccctgccgattgatggtggtgttcagttctgtatccttagtgattttttttgtctagtagttgtattgttgtaagagggatgtttacttcttcagctaaaatagcagatttgtctgtttctccttttagttctatccatttcaatttcatgttattttgaagctctttgttatatacacatttaggattactatgtattcttgatgtatttgacccttctatcattgtgtaatgtcttttgttctggtcattttttgttttcagttctactttatctgatattaatacagccacgcctgctttcttttgatatctttttccatctgtttactttcatcctactatatcatataggtgtgtgggtatgtgtgttttctttttcttaagagacagggtcttgctctgtcacctaggttggagtgcagtggtgtgatcacagcttgctcaaggagtcctcctgactcagcctcctgagtagctgacactacaggcacatgccaccatgcccacccagctaatttttaaatttttttatagagttggggtcctgctacgttgccccgactgcttttgaactcctgggctcaaagattttgggatcatggaggacaggaggccagattagattgcagctccggacagagcagcatgtggaggcttgcattgtgagttttagctccagatcgactgcaagaacaaaccagcaatcctgagaggacccacagaccctctgaaggaagtggactgctttgcaggacccgggagatttccacccaccctggcccccaaatactgtgagtgccccaactgcagaagtgggaaagggagaccctcctctcccaaacacacacccccgctggagaagctgaaggtctgtttgcgggagaagtttctgactttacctggagctgagtcaagttagttgagccaagcgaaatacaggggtagaggaagcagcagaaaggccctgggagcttgctgggtccccaagcagcccattcctgcctggcatcacagggatccatcaggaggttggctagaggagcaggggggtaaaactccacagggagaaggaattctctagctgaattttgtagcaatttgaatgagaagcctcctagtcagaactcaggggaggacttgaatccatctgcggcttgtagacttcacagttagggaaagaactaaagtccttttctttcacagctgggaggcggaaagcctcaggcaagttttcaagctccttttgcgcttcacctggaaacagacttggggctgttgcagggggcaaggtgggagtgagactgacccttcagttttcatgggagctgggtgagacctgtgactgctggctttcccccacttcgctgacaacctggatgactcagcagaggcagccataatcctcctagatacacaactccagtgacctgggaatctcactcctgtcccccacagcagccacagcaagacccacccaagaagagtctgagctcagacccacctagccctgcctccacctgatggtccttccctacccaccctgatagtgtaaaacaaagggtgaggtgtataatcttgggagttctagggccctgtctactgcaggtccctctccacactactacagctgatgctttctggaaagcaccactcctggcaggaggccaaccagcacaaaaatagagcgttaaaccatcaaagctaagaatttcacggagtccattgcaccctccgccacctctaccagaactggcactggtatccatggctgatcacagaactttgttcagacaagcctcagtaccaagcctggagctgggtagactcgctgggtggctagacccagaagagagacaacaatcactgcagttcggctcacaggaagccacatccatgggaaaagggggagagtactgcatcaagggaacaccctgtgggacagaaaaatctgaacaacagccttcagccctagacctttcttctgaccgaggctacccaaatgagaaggaaccagaaaaccaaccctggtaatatgacaaaactaggcctgtcagcatcccgcaaaaatcacactagtttaccagcagtggatccaaaccaagaagaaatccctgatttacctgaaaaagagttcaggaggttaattcttaagctaatcagggaaggaccagataaaggtgaagcccaatgcaaggaaatccaaaaaatgaactcctgggctcaagtgatcttcctggctcagcctcccaagtagctgggattccaggtgcacactatcgcacccagctaaatgtcttctaattgttgtgcttggaccttttatatttaatgtaatatttgtatataagggcataagtctgctactttacttttgctttctgttgttccctctgttttttgttgtccattttcatgcatttatgtggacctcttgaaaaatttttagaattccattttgattgttctgctggagttttgagtgtatctctttatatttgatttttggtggttgtactaggcattacattattcatacatagcttttcacagtatactgatgtcagcattttaccagtttgagtaacctgtagaaaaaccttagctccatttaggtccttttatcttccctctctgtagtattgtcttaaatactttttctgcatacattagcaaccacataagacagtgttttattttttgtgttaaatgtgtaacaatttttaaaactcgaggagaatagtgttatatgtttccatatttttacacttcccattcttcacggtgtttcaaaacttctgatttcctttgtgtttgaagaactttagttattcttttaggacagatcttgtggtgacaggtttgtttgttttttttgttatccttcatctgagaagatcttgattttacctttattcctttaggatttttcacagattatctatataactctgggtgacagatcttttctttcacctcttggaaatgttgtgccacagctcctattggcttccatggtgtccaataagaagtccactgtcactgtaatcatttttcttctatcgatattatgtcatttctttctacctgctttcaagattgttttgtctttagttttctggggtttgattctggtgtgtgttgtttttttttttttttaattttttttttattgataattcttgggtgtttctcacagagggggatttggcagggtcatgggacaatagtggagggaaggtcagcagataaacaagtgaacagaggtctctggttttcctaggcagaggaaacactgccttccgcagtgtttgtgtccctgattacttgagattagggagtggtgataactcttaccgagcatgctgccttcaagcatctgtttaacaaagcacatcttgcactgcccttaatccatttaaccctgagtggacacagcacatgtttcagagagcacagggttgggggtaaggtcacagatcaacaggatcccaaggcagaagaatttttcttagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccccccccacctccctcccggacggggcggctggccaggcgggtggctgacccccccacctccctcccggatggggcggctggccgggcggggggctgaccccccacctccctcccggacggggcggctggctgggcagaggggctcctcacttcccagtaggggcggccgggcagaggcgcccctcacctcctggatggggcagctggccgggcgggggggctgaccccccccacctccctcccggacggggcggctggccgggcggggggctgacctccccacctccctcccggacggggcggctggccaggcagaggggctcctcacttcccagtgggggcggccgggcagaggcgcccctcacctcccagacggggcagctggccggtcgcggggctgacccccccacctccctcccggacggggcggctggccgggcagaggggctcctcacttcccagtaggggtggccgggcagaggcgcccctcacctcccagacggggcggctggccgggcggggggctgaccccccaacctccctcccgggcggggagctgacccccccacctccctcctggacggggtggctgccgggcggagaggctcctcacttcccagatggggtggctgccgggtggagaggctcctcacttctcagacggggcagctgccaggcggaggggctcctcacttctcagacggggtggttgccaggcacagggtctcttcacttctcagatggggcagccgggcagagacgctcctcacctcccagacggggtcgcggccgggcagaggcgctcctcacatcccagattgggcggcggggcagaggcgctccccacatctcagacgatgggcggccgggcagagacgctcctcacttcctagatgtgatggtggccgggaagaggcgctcctcactttccagactgggcagccaggcagaggggctcctcacatcccagacgatgggcggccaggcagagacactcctcacttcccagatggggtggtggccgggcagaggctccaatctcggcactttgggaggccaaggcaggcggctgggaggtgtaggttgtagcgagccgagatcacgccactgcactccagcctgggcactattgagcactgagtgaacgagactccgtctgcaatcctggcacctcgggaggctgaggctggcggatcactcgcggttaagggctggagaccggcccggccaacacagcgaaaccccgtctccaccaaaaccagtcaggcgtggtggcgcgtgcctgcaatcgcaggcactcggcaggctgaggcaggagaatcaggcagggaggttgcagtgagccgagatggcagcagtacagtccagcttcggctccgcatgagagggagaccgtggaaagagagggaaaccgtggggagagggagagggagagggagaggggagcgattctggtgtatcttaacttggatttctatcctgtttgggtttgctcagctgaatctataggtttgtgtataataccaaagtattttgtattagtggttacaacgcaaagttggatcgtgaagtcaattttgtggcttatgactagtattatgattggtttttaatagaatagaaaatgaaaatatatcccagaataacaaggataataattaattttttattttcataacatatatgtaggtgttttctgggatccaggatagtggtttgcagtcagaaacgttggaaaactattgattaagaccattcacaagattttgttttgtttgacaaaagaggctagttaacacccctgaatctgagactctgatgctaatgagcaaaaagtatttttttctccaaatcacctgggcttcatagtttgtttcttctaaccagttaaattgtttaaaaacttatgaatctaagtagaggttacactttgtataaactcaaaacagatggctttaggaacagtgtcactttctgcccctgatgttatatgtaataatcataagtagggaaggtatgcgaaggaaaaggaaagaaaatagcaaagaagaacaagatggtattttttctttctcttttagttctccagaatatggtagcatttattaaatgtctgcatactatgtaactcacactgtgctggatgctaggaatgcaaagaagaatgaaaaatgtccctgttctatgtaacagatcactaaagcttattcttctggtctagctgaaattttgtatcctttgatcgctatctctcttttccccatttatgtacctcctctaacttctggtaaccctcattctactctacttctatgagtttgacttttttagattccacatacaagtaaaatcatgtgtctttctgtgcctgacttttttcacttagcgtagtatcttccattttttcacttagtgtaatatcttgcctatgttgtcgcaaatgacaggatttccttctttttaaggcagaatggtattccattgtgtatattttattagattgtctttatccattcatctgatgatggacacctaggttgcctccatatcttcgctactgtgactgtaataaataataatgcattatatatttcagaattactaaaggtagattttaaatatttttacaattaaaaaagtatgtgagttggatttgttaattagcttggtcattccatatagtaaaaacataccaaaacacctcattgtaccccataaatatataatatatacaattaatatgtgtccattaaaataataaaattaaaaaataaaaaaatttccttgcattcaagtagctcagaatcaaaggtaagcaaataatctcagtgctttataaataagtgccttataaaaataggtccttgtttctatgggagcacataagcagggatgatgagtaagaatggcaaatgggcaagaggctgaggctgtggaatatttcacctaagaggtgaagttcagcctccatcttgaggggaggagtcagggattgccaggcatattacaaaggaattgatttaggggacagagccctagctgcattttattaagctctatatctgttaaccatgtggtttccttatctagattttcacaacacattaaaagagctttccatgatcctggcaatccttttgtacctctaggtagctgtctctcccatttgccaagaagttatttcaaaccccattctctctaagcctctttaacttttcctattccaggtgtccatcgctgtataataaaccacccaagacttagtggtgtaatgcagtgatcattttattatgcttacaggttctgtgtgtcaggaattcagatggggcatgctgctgctccacagtgtctggggcctcagctgggcaaactgaaatgactgagggagatgtgaatggccaggaactggaatcctctggagccatctttacttacatgtctggtgcctggatggtgatgactttgaaagctgggctcagctgggactggtgacggaactattttttgtagcctccaagtggcttgggcttctcacaacagggccattgggctccaagagggggtgcctggaaagccagtattctattctaagagaatcaggcaggagctgcttggcctttctgacctaacctcagctgttgttcactgtcacttccactgcattttgttggttataaatgaatctctaaggccagcccagatttaaggggaggggagttagaatatctcctggtggcaaggtcactatgtagaagaacacgtggtatggcagataccatagtggtcgttttgggaaatatagtcagccacactctctcccagttttcaaattcataaatcttgattcttgctgaatattgccacttgaatatcccacagttacttaaaatgaaacatgaccattaactcttcttcactcctacccctccagctctacccctgcacattgagaaaatggcattgtggctaagtacgtctattatccagttatgcaagccaaaaccccttttcttcctaacatgtccctgccttactaggttaatgagattgttccattcttcttccttgtccgtggaatttacatttactcatccctgttgtcaccagcttttcttagaacagtgcttgcacacacacagtttgagacagatcacagaaatactgaacttttgttttgcagtcacattccattcttcagacttggctcaaagctacttgtgattaattggtggctggtttgattctctttctagatgattttcctttgtgagtttattcatttaaaaggaggaggcaagcaggaaagaagcacaaaaagatgaattccataagtatttttgaatactagcggcattatggtaattgatatatagactcccagagttactgctttgaaggagacaatgctttggatgtgtaggttctcatgtgtttattaaaaactatccatttgtggctgggcgtggtggctcacgcctgtaatcccagcactttgggaggccagggcaggtggatcacctgtggtcaggagttcgagaccagcctggccaacatggtgaaacctcgtctctactaaaaatacaaaaattagctgtgcttggtggcgggcaccccgtagtcccagctactcaggaggctgaggcaggagaattgcttgaacccaggaagaggaggttgcagcaagctgagatcgcaccactgcacttcagcctgggcaacagagtgagactctgtctgaaaaaaaggaaagcaaaacaaacaaacaaaactatccatttgctttcgagagctttccttaaattaccacttcagtttgcattgagtagctgctgttactttgtaaactatactatatataagacaaaattgatgtaatgagaggtaaatacaaataattcatagtgtacagataatagaatttgttgaatccatataaatattattttgcgggttgtatttgtactgtcagtggaaaaagcagctaaacaagttgatagtaaaaataatattatgaggggagatgtttaatatacttaggagatcaggtataactcgcatatactcagtttaaaaaaaaagtctttcctgtttattaaatgtgtcctgtgccttataaacagtgttgatttggctagaaaatattacatagaaattccataaataagcaattgttaagttttaaattgtacaccattcttagtagcatgatgaaatcttgccctgtcccacccaggatgtgaatctttgtccagtgtctccatgctctataagctaccttcccatttagtcacatagtagccatctcagttatcacaactgactgttgtagtagggcatgcttgtgttcaagtcactcttattttacttaatacccccaaagcacaagagtggtgatgctggcaattcagatacgccaaagagaagcttgtgaagtgcttcctttaggtgaaaaggtgaaagttctcaacttaagaaaaaacaatcatatgctgaggttactaagatttgtagtaagaaagaatcttctgtctgtgaaattatgaagaaggaaaaataaattcttgctagttttgctgtcgaacttcaaactgaaaattacggccatagtatatgataagtacttagttaagatgaaaaaggcattaaatttgtcatgaaagacatgaacagaaatatgttctagttgacagaaatcaagtttgatttaatctgaggtttcaggcatccgctgaggtcttggaatatatcccctgcagataaggggggaatgtaatcctgataattgtagaatgatatttttcacttcatttgcaccagttattacaagtttgcttaaatatagcacaatgtattgggtaatacactagtttaagactagaaaaacaaggccgggcgcggtggctcacacctgtaatcccagcactttgggaggctgaggcgggctgatcacctaaggtcaggagttcaagaccagcctgaccaacatggagaaaccccgtctctactaaaaatacaaaattaactaggtgtggtggcgcatgcctgtaatcccagctactcaggaggatgaggcaggagaatcgcttgaacccgagcaacaagagcaagctttatctcacaaaaacaaacaaaaacaactagagaaacaagtttctggatcaccgcctatcagttatctgaccttagaactggccattatttattctgatccttagtttccctatcaagttgattgcagatgttcagctgtaaaaactgttcttccactcgtgggctgcacaaaaacttatggtaggcttctgttcacccatgttttagaatataaggaacctttattatctagtagttagtgaagttagagttgtttctcatgctcacagttatttagtgatatttggtatcaaaacacagtgctctttaaaatgtttcatttcctctgatattcctagttagcgtataatttacttaactagaatatcctattctgtaattattttacaaatgggaattcaccttataacaaaaactgccagctcctcttcttcccctgccttgccttttttcctgccttactggtttgtagtagtatctcagcctcttaaataatgataatttttttaaatgaagaatacttaaattattttatgatgatttaggtcagtcaacacagcatttcctccttatccatacatttattttattttatttatttttgacacagagtctcattctgtcacccaggctggagcgcagtggcgcaatctcagctcactgcagcttccgcttcctgggttcaagcgattcctgtgcctcagcctcccaagtagctgggactacaggcatgcaccgccatgcccggctaatatttgtatttcatggggtttcaccatgttggccaggctggtctcaaattcctgacctcaagtgatcgatgtgcctcggcttcccaaggtgctgggattataggtgtgagccactgcgcccagcccacacatatattttcaagtgataaagattatttttgattgtatctgttggtgagccgtgcaattttagtaactgatatacagatcttaaatatcattgtgaacctttattaaagtggtattttaaatagctgcagataatatttttatactatctgccttctagttctaccagtaataaaatggaaaggggtttggttcacagaaaactaaactgaaatactgaacatcagatgcctggcacacagtaggcaatgagtaaatttgtatgtattgtatgaataagttgtatggattgtgcgaatgaattgtagaaattgtatagcaaggtgatttgtcaaagtcgctttttaaagggtttaatacagtatctggtacgtgaaagatgctcagttagtgatagtgttaaaaatgtataggccagtagttgtttatcataccccaatttagcacagtttgttcagtttctcagatacacctatatggtagaacggttaataaaccagaatctgtagttagattacctaatattgaaacctgattagccatacgtccaagccatgcagcctttggacaagttgttcaacctctcttcctcaattttccagtctttaaaatgaagatataatagtacacacctcataggattgttgtcaaacataaatacattagttgcatgtaaagtgtaatagtctatgtaaagtttagtatatgtaaagtgtagtagtacttggcacacatttgaataccttttttccaaatttcaggcagatttagtcaattagccagattccccaatatattaattaattattatttttttttttttttaagagatggagtctcactctgtcgctgaggctggagggtggtggtgtgattttggctcactgcaacctccgcctcccaggttcaagtgattctcctgcctcagccgtccgagtagctgtggttataggcgcgcaccaccagcacgcctggctaatttttgtgtttttagtagagacgatgtttcaccacgttggccagactggtctggaagtcctgacctcaggtgatccgcccaccttggcctccccaagtgctgggattacaggcatgagccactgtgctcagccaattaaatttaagggtcttctattacgggtaggatttgtctaatttatctgataccttatagtataaatagtgaaagggaaaatttcccattaaattgagcatgtgtattttatagggccttgtatagtcataaatagaaaaatgagttaaatatcaatgcacaaacatatttaagaagttatagttctggtctgataatctccctggggtaatcacaaggttggtgcattgaggtgtttttcctcctgtccccaaacatctgccgtacattttgtgacttcattatagcatacacattattctgttgtgattttttttttttggtgggaggacagggtcttgttcttgtgcccaggctggattgtagtggagtctagtggttatagctcactgtaacctttaactcttgggctcaagggaccctcccacctcaaccccctgccccacatagctaggactgtaggcatacaccaccatgcccaagctgatttaaattttttttttttttttttttttttaagagatggggtctttgttgcccaggctgatctcagactccttgcctcaagtgatcctcctgcgttggcctcccaaagcactaggattacaggcgtgagccactgaacttggccctgttcttaatattaatgcttctgcttaatgtaactagttacttgacgaaaaaggaaatgctttgagaaaaggaaatgcgttgggaattaataatctgtaacttcacctatccttatgtttgttaatgtacctattcatatagttttatgttatttgtgtaaattaaaaaatttagatgaaacaattttagcatctaatttttattaaatttgcattctttccaactttttgtagaagttccaaatgagtttatagaacttaagaaattactcagtctttctgctgtccagttttctaatgtatgcttctttttttttcccctcagaggaaataaaagcggaaactgaaaaacagaggtttgtgggatttcttttctttagtaaaaataattttcaaacttgtcagtcttggtcaaaataatatagtcatctgtattttagtgtggcaaattctctgcatgtgagttttatagtaaaatcaactttaaaaataggttttaagaaatacaattatataaaaacaataaatacaattatatttcttaaaacctatttttatatatatttataaaaatgtatgcatatatttttttggagacagggtctcgctctgttgtccaggctggagtgcggtggtgtgatcacagctcactgcaacttctgcttcccaggctcaagtgatccttccacctcagcctgccgagtacctgggactacaggcgagcaccaccatgcctgtctaattttttgtagagatgggattctgccatatttcccaggctggtctcgaactcctgaactcaagtgacccacgcacctcggcttcccaaagtgctgggattacaggcatgagccaccagactctgctctaagcatacttaaaaatacaaaaagattctcatataaataagtatataaagatacttctgaaataccataagataggcttcagagtcttttcttaaagactttgattcatatttggaaaaattactaggttttttgatagtgttggcatttttaggacaatattgaataactaaaaaaactcactttgacttaaggacaaatagaaaggccattgctttttaaggtattatgataccaaatttgttaagtgacaataaaatatttctgtaatagaagcaacttgaattttacagtttttgtagaccagttttgcagacaagatttcagcgtcttgtggttagtcacagctctggccactagcttttgactatgtggcaaaccacttcacttctctgggcttgggtttcctctcgaaatatgggaagatagaggactggtttagcaagattccttttagaactgaaattctgtgtttctacatgggtttattatcaatattataaatgtgatacgctataatcagacttttctttctcatttagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacaggtatgtctaaaatggcactttctaaaaactgtgtactttgaatgtgtttctaaaacattactcacattgatgattcagacatttccatgaaagctttgaatactcttttttgtggtaaaaaatccaagtgattttttatatttaagacagataataatagttgcaaaaagatatttctagtttaatactaacaatcattaacttagtgggatataaaatctttactaagtttatcaataatgaaaagtgttgatttggtctcttctcatcagtgaaatgcaagacctgtaatacttttaacctgctgccgactttacatacatcaccatttgcaaataatttttctaagtgtctgctgttttttttttttttaattttttgagacgaagtcttgctctgttgcctgggctggagtgcagtggcgtaatcttggctcactgtgacctctgccccctgtgttcaagcaattctcctgccccagacttctgagtagttgggaatacaggtgtgtgtaaccatgcccagctaatttttgtattgtttttttttttttgaagagacaagagtttcaccatgttggccaggctggtcttgaactcctgacctcaagtgatctgcctgcccgtcttggcctcccaaagtactgggattacaggcgtgagccactgtgcctggccagtgtctgttttatatgaagcaataggttaatattggcagcttaatataatttaatatttaactgctatactttagcgatggcagtcatttatgtcagaaaaatttctgaactctgttaccctgtttgacacatatacagaggatcttcatagatattatatttgtaagacaagtttctaagtagaggaatacttctcttttcagatgttctcactatttgggaattatatgtattcaactataattcagtagctaggaaaagaccatattatttgtccttaaggataggttaaagataagttcatctgaattgtgatcttgttttcactggaaaattagaatgataatatgtaaagccttccttccagggtatactgataatgatgaatgaacaaatctatgatttatctcagctagtatatggaaactgggttttatacatattgatgaatcatttggaaagagattgggggtcatataaaagcatgaagataattttcacaaaagcagtatcaataaaaccttgtttatgtggaaagcaataagcaattttttttttgtttttttttgtgacaaggtctcactgtcacctacgttggagtgcagtggcgcaggcttggcttactgcaacctccacctcccaaggctcaagcagtcctctcacctcagcctcctgagtagctgggactataggcatgtaccaccacacccagctaattttttattttttgtagagatgggctttccctgtgttgccagctggcctcgaactcctaagctcaagcagtccacccaatgtggactgacaatgtgggaggcaagcaggcctcccaaagtgctgggattacaggcatgagccactgcgcccagcacagtaagcaattctaactcatcagagacaggttctccaaggcctgactttctcaaaatattacctgatggttttattgtggttattgttctgtttttgtgattattacaagtataaataactttgcatatttgaataaagtttctacagaaaaagttggtatagctttggctttgataatacctttatgtttttgtgtaaaaattttatgtatattcaattgtatactgtaattttaatgtatattgcattagtatgtataatatttgttaccttacttaggatctttgttttctttctccattttagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggtaattattatataaagtaaaattgttattaataatctgtatcttcaaaattcagatgcctttcaccttaaaacattaggaaagatcattttatgtgcattccagctataatacaggttattcgaggccgggctcagtggctcatgcctgtaatcccagcactttgggaggccaagttgggcggatcacttgaggtcaggagtttgagagcagcctggccaacatggtgaaacccccatctctactaaaaatactctactaaaaataccaaaaaaattagctgggcatgatggtgggcacctgtagttccagccactcaggaggctgaggcaggagaatcacttgaacctgggaggcggaggttgcagtgagccaagaccatgccactgtgctccagcctgggtgacagagtgaaactcagtctcaagaaaaaaacgaagaggtcatttggatgctttctagactccatattaggggattttaatgttgtatgccaagagtttgttagaggaaaagtatgttctcatatctcttcttttgaaggtctcagtttagacttagtccctagagtcttccaaagtttttctgtttctggcatgtttttcatatgtatatatatattgcatccatcaaactttagggtagttcttaaagctgtgacccctctagtttcttctgtactgttggacctttcatagcttgtcctctcaactcacaaattaccaggtggacactacttatccgccaattctcctgatatcgttgcacccatccatctatagaacttgctcagcaaaaccctgttctgagtttgtgctgtaacgnnnnnnnnnnnnnnnnnnnnttcctatatcgtgcaccatccattatagactgtcagcaaaaccctgtctgagtttgtctgtaacgaacttgttgattgaattcctttggagaaaaattagtaatgttttcattctgttacagatactgagttcttaatgttattgctaatggtagtggtggtatatttttatagcagtaaaattttcatgtgctatatatagtacagtacttttgaaattgtttttacgtgtatatatgaagtgttctttcatgtgtgaatacaacccttttggagcctttcagttttatagttgtgtttacttcagaagccatacaatatctttattctaaaaaaaaaaaaatactgggcatggtagctcatgcctgtaatcccagcactttgggaggccaaggcaagaaggttgcttgatcccagaagttcgagaccagcctgggcaacacagcaagaccctgtctctacaaaaaataatttaaaaattagccagatgtggtgatgtgtgcctgtggtcccagctactcaggaggctgaggtgggaggattacttgagcccaggaattgaggctgcagtgagccatgttcactgcactgcacttcaggcttggcaacagagtgagatcctgtctcaaaaaagaaaaaaaaaaaaaacgggttgatcattttgacctatcatgtatagtttcatgtcatttatggtttaagataatgcccattaatgctgaccctgcatagcattgtacaacataaagaagacaaaagataagagtctttgctcttgagaaattggaagtaacccaatatgtgaaaattcacataggttaaatttgttcattttattgaaatatttgccttaggaatttgttttttaatttgggacagtctcactctgttgcccaggctaagtgctgtggcatgatcacagctcactggagtcttgacctccctgactcaaatgatcctcccacctcagccttccaagtagctggggccacaggtatatggcacttacgcccagctactttgggattattttaaatgctttattctaaaacatttataaacctcttcaacaataacaacaacagcacagctattgagttcagtgtgttaaaaaaagatctcagaaaaatttagaggcaaataagacacagtgtgtatcttcccaagttgatggtctagttcaacagatatctcatgtgacgtatctgtgctctgctgtaacagctttcatgctgtgcattttagtaagttaaatagtattttcattaaaatgaaaccttggttgaaacaaatcagttaaatggttttcagattatgtggaaattactgccgcagtgaggaaaacatcaaatattttaacagttgatgatatattcaaggccagtagaaattctgtgtatactacccgcaagtggtaattgtttctgaaagttttaattgtaatatgaaaatgcttaatttttgtgctgaaactctagatgcagaaaatcactttaaggctgggtgtggtggctcatgcctgtaacccccgcactttgggaggctgaggtgggaggcttgcatgaagccaggagtgagaccagtctgggcaacaaagagagactgcatctctacagaaaaataaaacaaaattagccgggtgtggtggtgctcacctgtagtcccagctactcaggaggctgctgcgagaggatcacttaagtccaggagttcaaggctgcagtgaactatgatcacactactgcactccagcctgggtgacagagcgagaaagactgtctccaaaaaaaaaaagaaaaagaaaatctctttaactttttcctttttttttcttaaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcagtaagtattttaagaagagagaggttgtatagaacacaacaggcattaaacatagaaaggagtttacagtaattagagtgaaatctttgtacctgtagaaaagaatgtcttttatttacatttccacttactggagatttgtgggattgtgttttattttgttttgttttaaggtttaccgacttaactttggacaaagtatttttagttgttcacaaatagtatgtgaaatatgctgattgccatcttccttgtggaagtacttatgaattaatacttttattgcattcaaacttagtagagtgtaatgtagctataaaatacttaatctaatctgaaataaaattattcattaagccttaaaaaagtatatttccatattgatgaaatacgttttttcccctgtatgataaaggggcatgatattccttatactttgaactgcttcaggttgattgttaagagatcagcaactagagaattgtttttaaatgcataagtcttcactattaaaaatcaacatcaagcttcttattttgaactctttttaaacgtagagaaaagttgcaaaaatttttcagagcaatcccttttacccttcaccctggttcccttaatgcagttaacttacatacctacatagtacaattatcaaaagcagaattaacactggtacaatactgttaactaaaccacagaccctgcttgaatttcaccaattttcccactaatgttttaagatttgacccaggatcccacattgtgttcagtatgcatttagttcttatgtcttagtcttctccagtctgtgacagttcctcaacttttccttatctttttcatgatcttgctatttttaaaaggatactaataatttattttgttgaattttcctcagtttactttttgtgatgttttctcgtgattagaatgaggttgtgcattttttgccagaatatctctgagacaatgttgtgtccttttcagtgcattttgtcaggacttcatgatgttgatataccttaatgttggtgatgttaaccttgatcacttggttaaggtagttatctgtcaggttcctccactatgaagttagtagtttttcttttgcaattaataaatatctttggggagatattttaagacagtgcaaatactgtttctcttcagatcctcccctcacttgctcagttttaatatctgtcagtggatcttgttggcaacagttaattattgtggcgtttccctaatgattttcctgtttctctcttctgtatttattaattgaatttctcctcccttaatttatttatttatatcaatctgtaatcacagatatttattttattttatggttgtaatgtgtgctacagttacttattttgttgcccaaattattacacttttggccctgtgtccttgtgaccagctcccatccttttttgagtacttccatgctttctggattctcaagattttccaggctcattttgaattttcccagcttcagccttggaatcaaccacttcaataaggagctgtagctcttttgattggagaatggtatttagaaaccaaaatctgagtgctagttgtattcattgtcactctgtgttattgcttctaggcctctcagcagatagagttaggaaatatatgtttatatactatcccttccgtcccactcaattcctacacctgtatgtgactttccatatgtaggtaataaaaccatgtgttcatactgatatttctgattccagtgcaacaatacagggttcatttcagtcttctccctttatatgtaaacttctttctctaaacaatgagaaatatggcttttgtattctaaatacattgattgttcaatcctattatacccattagttttagaattgctaatcattaccagtgtgagaaacaaatttactaagtagattatagcatttatattcaggtttttttgtctttagccttatccattcaaaatattattttctagttacttagattagttcctttcttccccacactctgcaatagggtaatgctattcctttgtgataatagttagactcatttgttactctctgcttttcatttttggtattcgtcacatcctggttagttttaattacagtcatccctcagtattcatgggggattggttccagggccctcccatggataccaaaatctgtggatactcaagtctgttttataaaatggtgtaatatttgcatataagctacacacatcctctgtatactttaaatcatctctacattacttataatacctaatactttgtaaatagttgttatactgtattgtttagggaataacgaccaaaaaaaaaagttgtctgtacatgtttgttcagtacagacacagctattctttccccccgccatcagtattttcaatccctgtttggttgaatccactgatgtagaacccatggatacacagagggcgaactgtacttatttattttttaggtatgtaaaacattactgcgatttaagagtcagagctgtacaaaaggtctactcagaaaagtaccaattcctactaattcctaccactgcattcctcttcttcccttctttccaccccttgaatgtaagacggaagccacatgtctaccttataatcagaagcggtcacaccggtacattgtggaaagggactacacaagggagtgaaaattgagaggtggacatcattggtgaccatcttgaagactagctaccacatatgctatacattctcttttgtattttgctcttatcattgagcagtatgtcctagaaagcatttcatatcagtccttaaagaccttcctcattcttttttatagatgatagtactttaggatatagcctattatctattaagtcactctcctctgtagtggcattaatttatttctaatattttgcagccacaaacagtggttttgctgcttttttttgaggacataaaatatttttgtcactttttaataacaaagttttattggtttgatttgattaacagactttttattaagttccttatatgttcctggcactgtgctaggcctcacttatacagtgacgagcaaaaccgacttgactattacctttggaagatcttaggaacatttgaggcaaagagtttcccttaaacaactgcagaactgaattatgataaaggctatgaacatgtattgtgttacaaaggatatttagttctgtgctatggataattatagaaaaggtggaaaagagggagagaaaataaggggaaatgggatacagacgacttaacttccacatttgctaaaatgcttctaagccagatgttgaattgctttgatattagctactggtaaccttaattttccccttcccccacaaaataaaactccttacaaagcaaatcttgtcagactttattattaaaatcctttaattcaagcttattttataaattcgtgtaattctggcatttccacctaacctggaatattactggagaatatgaaatgttcatatttactactgtataagatttatcttggtggaaattaattctgtgagactcattcttatcaggtcttgaggaccaaaagagatgtgtgaaagcaataaagtgctaaaaaatgaaatcttgtgatcccagttaatgtttctaacattttgtgagccagttttacagatagtattatatacataataatgacagtttttctaaaataaaattcagacatttgtagatatagtttttttcataattattagatggctaggcagagtgatttaagccttcattgtaattctattaaatgtaattttaatttttttattaaaagatatttgacaaggtgacataagaacatgctccagaaggataaacactgaaaagttgcctcccactcttgttttccattttatttcctaatctctaccctctataggtaattgttagtactagcttcttatgtatttttatagactttctgtatgtataagcaaaagtgaatgtgtgtgcgtgtgtttcatccacacaaacaccaaatacagtgaaaatgctatatagtgaaagtctttcatctctgttcttatgtgccaatttccagccacctaagaagtaaacattgttcattgtttttagtatagtttatgttctccatttctgataaactttaatttccaagcgtagagagaatggcaccttatagaaaggattgttggaggtaacattatccttccaaattttaaacaacttattttactaatattggaaattttatttatttccagttacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaagtaatcttcttgaaaagggggtttggggtgtgtgttaagggaaatgtgtaggaatgagagttttgatgaagaaatgttgaaaggataatatgatttaataagtgtgtcagacacattgtggtaattgtggactttcctcattgtaggtggtaaaattaatttgactctaacctacaagatatctatgaatgatactttgcatttattagcatctcatgagcagtatgatttatagatttcctttggagcgcagatatatttctaaagagggtcataaatgtccgttaaatgttatataggaatttcagttttcttaagattggtttcatagcaaacaagtgacctagtaaggttttctggaatatgactgaaaattttaaaaaatcattaccagttttaaaaatatgattatggtaaaaaaaaaaaaaaagtactgaaattaaatataaaaacaaagtttttgagtaaccaactgacagaaattttcattttttaaaatcatgatgcatagtaatcactaaaattggagatgttctctgattttttaagtgtatattataagaaaacgcttataagattataaaaattatatttattttacaaatttgtttctctgtaaaaataatcccatgaagttatttttttcctaaatgttattttcagctttagctgttctgtgaaactaccagggagttggtggtgttctccctttgcccttccttagcttgatgtcatttttaaatgatgagaattctgttgcctctccagtgtggttgtctagaactagcatgttaggagtcagttacagttcatctgaagtctgtgtttttacttcactttgaggaaggatttctgtaatatgttttcagctcttgatttttttttttttaaaccatgccttttccaaaacttagtagtggcatgaatacgtgcctttttacattttccccccagctttctgagaggcatgcttttaaaaacagtactttactatttgttttaaaaaggatgacttcgataagctaagcattcatagtactgaagctaatagtgaatccataccacttaaatgatttacatttgtctagcctgcccttgccaaaatttcccccactttcactgtgagcttataatgggcagattcaaagggctaatctctaataaagctgggactttatttatttttttgtttatatatctatgcatttagcaaaccttcattgagcatactgtgtcttaggcaccatgctaggacttgaggttaaaaagatgatggagatacagccactgcttttagtgtgatcttagcatacttggaagtcaagtgagcataaataaggtataatatgtgataggtgtcctaaaaatgccatgcacaaagtaattctgctgagaagagttaggaaatttctttgtagagaaagtggtgatattttagttgaatcttgatagataggggtaggaaatttccaatcaaggaaacaacatggactaagacccaagaaatgggagcatctgctgtgtgtgaggtaccttaggggtaggaaattttccaaccaaggaaacaacatggactaagacccaaggaatggaagcatctgccgtgtgtgaggtaccgctgtagaagccttgtagaatatagagttagaaagacatagtttcctgtgggattgtgatgattattttggctctaaagatgtttttctcccaatagctgatataaatgaaaattctgtttgacagccattggttcagagtgcatttttggagcacacctctgtcacttaccagctgcgtgactttggacataatagttaacttctctaagcatttcctacatgtaataaatattagtcattgttattctgttctgtttctttcagatacttatgtgaaaattgacccttcactagtcatttcgtacacttttagatagtggttatgtatattaagttactttgaaactctagttttcagacttgaggtaattttagccaactagagcatggaaataaaacacttaagaatggcagaaaaattatctttcaagacatttatgtttttattcacagaagactctaaatgctatttttatttggatattttataaaataaggttgctcatttacatgcatatttatctggttttctcttgtggcattcagtatttttgggatactacagacagtaaattagtaaaagtgaaattatagggaggacaggcacctagaagccactattataagtagtggtcctttttttgtccttttttcctttttttttttttttttttttttttttggatacagagtcttgctctgtcaccctgactagagtgcaattacacaatcatgggtcattgcctgcctcccaggcgcaagcgatccttccatcttagcctcccaagtaactaagactataggcaggtgtcaccatacccagctaatatttaaattttttgtagcaactgggtctcactgtgttgcccaggctggtcttgaactcctgggctcaagtgatcctcccacccagcttcccaaagtgctgggattacaggtgtgaccccccctgtgctcagctgtagtggtcctttatagtagtgggaaggttcaaggagttgaaactgcagcaccatcagctaatatgctgtctgatgccctttggtgtagaacggtagctcaagacagcattttgaatcccagggcattctaaagtgatagttgagctgctttgacatattttcaacattttaaaaagcccagtggaattcctatttttctctgcaatagactgtgcaagctatccagaacatcagatttcatcagtttctcttaggctattcagaagttcgattggcagttatctgttgttggtgattttgttttttttttgttttttttgttttttacattaaattggacaatgaattcttttttagcttcttaaatttagttttacattagatatgtagattatgttggtgaaaaaataggaagggccagaaagtactggggaaggcccagatgcttcttcagggacctcaccatagagtaccatgttgatcttactattgatgagcctaagtaatcgaaacaagctttaattactttttttttttgagacgtcgtcttgctctgtcacccagggtggagtgcggtggtgcagtctcagctcattgcaacctctacctcccgagttcaagcagttctcctgcctcagcctcccgagtagctgggattacaggcgtgtgccaccacgcctggctaatttttgtatttttagtagagatggggtttcaccatgttggccaggctggtctccaactccccacctcaggtgatccacccaccttggcctcccaagttgctgaaattacaggcatgagccactgcacccagcctacttacattcagtatatttgataagggatagtgtaatgtgtgtactaagtataagtaagcatctgtaggacatgttagaaatgtttcatttaaaatagtttttgaagttttggtacttaaaggactaatctagaaaattcagttaagtgtaataatgtaatagcttgtcaaaggaatcattgaaattgacttgaatttggaaaatatttaagttttggtatacattttgaaggtttagcatataattgcttctaatttcatgttatctatttgattttttttcttttattcctcatgatttaggagttttttcatcataaatgtttagtaaaaagcttccaaaaagttaaaataatgttctgttgaatttttcttcttttaaagcattatctaaaaatgaagtgttatatgacggagaaaaccatgattgtgaggaaaagccacaagacattgtacagaacattgtagaagaaatggtgaacattgttgttggaggtagtatacttcattcaaaattattttactctgtctatgggatttcatctgactgtggagactttgtaatgtctggaatagaaagggcaaaattaaaacgtttggagccaaccaatggaaagttacaaattccacatttaggattttggccttgattctagaacaaatgggttaatatggaagattttagcactgagaaatgaaatgaccagaactatgctttaagaagctaagtctggaaataagaattcccagtaggataccagcacagtattcaaagcctggataggacagaaaccgtctaaatggagacaaaaatatggataagtgatataatgtatattgaatcaagaagactttgtaactgattaagtaggtaaggaaaagagaataaagtgtgtcggaggccttcaagattaccccaaggtttggtgatttcactggaagccgtcacaggacccagcatatagttgtactcactgcatgatttattagtgaaaaagtacaaagcagaatcatcagtaggaagaggtatatggggtgaagcctggagaaaatcaggtacatgctccaaatgtcttctctcagtgaagtcatacagattctcttaattcaacttgtgaagtgtttaccagggaagctcattagagactcaggtcccaaggtttttactgggggctgttatgtaggcacctaccatgtacgaaaattccaggataccagaaggaaggttggtgttcagcataaattacactctttgtacagtttagacacagtgagtcacttttatcagttctgggaatagtgggatccctcccaaaatataagttcccaggtgccagccaaaggccagtcttgcaagtaggcctttctaaggataggcagtctctggcctgctatgttacctctttcctgcacaggtagtgtttcagtttttgagcctaaatggataggtggatggtggtgctattggtagagttgaatcatcttggaagataagtcacttgggaaaaaaggcacttatttacttttggtatactgaatttgaccttcaagttggccatctgtgtggaaatgattatgaaatacgtaatggaaaataaaactctggctcaagagttgccaaggcaggtgctatagatgggagtcattctgttaaaattaatagtgaagccatgagattaccaagtgggaaatggtagagagtgaagaaccgaccatgatttgaagagtatgaatttaaaatatatattaaaaaaataaaaaatagagaagaaaaaatagcagtacatgcccgtgcattctttaaacatataatagtatagttaaggagttggcacattacggcctgtgggccagattcaacccgctacctatttttgtatgtaaaataatactgtgacacagccatgcttatttgtttttatactgcctacagaggtctcctgttgtacttcataggtaaagttgaatagttccagtagagattgtacgacctctaaagcctaaaatgtttatcatctgaccctttataaaaaaaattcaccagcatctaacaatacagagtctgaagtgaaagttttcgtttttctgcaactttttacttaggaaaaacatcaaacctagagaaaagttcgaaaaaaggaacagtgaacacctgtgtgtcctttatctggattcactagtggttaacgattttgctatgtttactttatgtatctttaaataccatgcacataatgtatgtgtctttgctgaaccatttgaaaatcggttgtatacatcatgacatttctcccgtaaatacctcacagcatatatcttctccaataagagcattctcatacaataagcacaattccattttcatacctagggaaattaacacgatttcaagaatatctaatatacatatatttttcagtgttcccagttttcccaaaatgtgtcttatatccttttttttcttttctaaatccagaactcaacctgggtacactcgtatttgcttatctgtctctttggtttagaacaagtcctcttgatttttccccccaactttcatgacatttgcttttttgaagaatcttttgccttgtagaatatttcaaattttggatttattggatggtttctttaccatcctatatgagtagattgagattgtcatctacatgattagtttagattaaatatatttggcaaaaatactgcatggtgatattagtacttaataccacatcatataaattggtacataatgacaggttacccccgttggtggtagggttggatcatttggttaagatggtgattatcagctctctgtaaaggaacatttttcactttgtgattaatagccaatctgaggtgatactttgatacttggagatgatatgaaaatttattcacccagtgtttttttttgttttccccccaagataaggtcttgctctgtcacccaggctggggtatagtggtacagtcttggcttactgcaccctcggtctcttgggctcacgcagtcctcctgccttagtctcctgagtatctgagtctacagttacacaccaccacgcccggctagtttttgtatttttttgtagagatggggtcttgcttgtgttgtccaggctgggcttgaactggcctcaagtgatcctcccacctcagcctccctaattgctgggattacagatgtgaaccacacacctggcccactcaatggttttagcacccattgatgatccttgccttactcagatattgggttgcaatatagcaattttctaattcttaacattcattgacatttttctatagagaagagctctcccaccctgccccacccccccctttaaaaataataccatgggcttaatgaattcttttattatttgatgtgttataatcctgtatcatcattatttttatttttttgtctgccagtaggaatccgttcaagctaacacccacgttcttttgatgtgattctgttagtctttgagcttttcctttatgtttggaacagaaagatgttccaggttcaccttcaacttcccttttcctcagccctggaatcagctagttctccgaagagtctttgtcctttttagtgggcagttgttcttagaaaccaagaattggttacaagatgctcttgttgctagctgctgagatgtccttacttgcaggcccttccagtggatagagagggaaacatacaattagtcttaagttcctatttgtagttctacttcacgtccaataccacaaggttgctcctcatctttctgtactttctatttgtatcttccgtttcctacattgaaaacccagatccccaacaagatgccattactaacagcaaacttataaagttcaagatttttctgtaattatatgtatccttaaatatatcctactaaagatgagtgagagtactgttttgaaaaagttacttgtattattttattggttcgtttttttaaatatgaagaatatttacatgattcaaagtcaaaattacataaaaggcttacttggagaactccatcagctccttccttctctgatcctccttctataggtaatcagtttcactagcttttagtttatctctgggggttagggggttgtgcgtacatgtctgcttgtacataagagatgtaagcaaaggcgttttttatttccctttctctcattttttgttagagtactgcatgtatgtgtgtgttgcattttttcacctaacatattagaaattattctatttcagttgatagagattttcttcttttctctcatggttttctgcataatactaccttatgcagatatatcatagtttattcagccagccccctgttgtacttacgttgtttccagtgttttgctgttacaaataatgctgcagtgaataactttgtacatctgtattgtttcatatttatggaagtttattttgagggcaaattcctagaaatgagattattgggtcaagtggtaaatgaatatgaatatctgttagctattgctaaattcctctttataggtgttgtgccattttgcactcttaccattaatgtatgagagtgcctttctctccacagctggtagtactaaaagattttgagtttttaccaacctgataggtgagaaatgtatctcagtttggttttaatgtgcatttctctatgagtgaaattaaacatcttttcatatctgtaggatcattagtatatcttttagtgagtcatttattcatgtcttctgttcatttttccatcagatttttatccttttccccttaagaatcctttatgtattaggattctgtgatatattttacagatactttctctcagtttattattcgcccaagtcttttgatcttattatggtgtgttttgctgtacatgattttttaaataatttttttcacacatgcctgcatatatattacatatgtttaagataaatgggaatatattgtacttacagtttgataatctgcctttttcacatattaaactatatccattcacatccatttgaatttcattatatcactgggccataatttatttaaataatctcctgttaatactagcatttagattattttcaggtttttgctttttataaacattggtgtgatatacattcttactatagacatctttttgcacttatcttttggctaaattataaagaaggaatagcttgatcaaggtgtatgaatattaaaaaatttgtatacagtgctataatgtcactgtaatgatggtatttattgtattgttttaatttgcatttggctatttccagggtcaaaatataggcaattatttttataggtcaaacattggccattttgtatattccaactaaatatcattggactacttatctttttttgaattactattcttgtcttttgcctattttttccttttctttcttttgttcttattttcaggagttcttcatactaagaaattattccttgttcagtgtattgtaaatattttttctactcagtctttgttttgtttgaacctttgcttatattattttctttttctttctttctttttttttttttgagatgaagtcttgctctatcatcgaggctggagtgcagtggcaagatcttggctcactgcaaactctgcctatcgggttcaagcagttcttcttcttcagcctcttgaggagctgggattacaggtgcacaccaccatgcccggctaatttttgtatttttttggtagagacggggttttaccatgttggccaggctggtcttgaactactgactttgtgatccacccgccttggcctcccaaagtgctgggattacaggcatgagccaccgcgcctggcctatatttttatttccgagcacatacttgaccacaaaaaaaatttttaagattatctttttatttgtggtttctgtttttgtcttgctgaaaatggattttaccaccctaagattataaaatacactaagatacctttttctaatattttgtttttattttttgactttagctctttaattcatctcagatttatttttctgtgtggtgtgaaattctatagctaattataagctatagaaataatcatttctcaattaatttgaaatgaaaactttatcctaaatggttctgttttttgagttttctgtacagttgtaatgagctatttgtctattcctaaccagtgttgaattatgtaaaatattttggctttatagtacattttgattttcatagtgcaaggcctccctcttcaattttttttagtttttaatttttgtattctatagtatcaatttttaaaatatctattaaatgtatgttgttaggtgaactttagaaccactttattaagttcaaaaattaaagcttacttagtaattgaaattgtaatgtgcttataaattaacttgggaagataatatcttctttgcaacagtatcgagtcttctcctccagaaacataaaaagttcatttagtcaagtcttttacgtcattcaggaaagttttattgttttcttcctttggctcatgcacattttttgttaaattatttctatatttttggtttagttttgataatattttggttgagtcctttcttctctattccctaatttaattggaatatagaaaaattcttgtttttccatatttatctcctatttggtcaccttctgaactcatattatttctaaaagtttttcatttggctattttttctaagtgaataatgatatttttatctttgtctcttcctttacagcatttataccttatttttgtttgtttctttttgttacattacattggctagaagctccagaaaatgttgaatagtgttaatgatggcaaggatattcatttttttttttaacattattgctatatttcaccattaaatttgatgattgcttttgtttttggaggatactctttatcaaattaagtaagttttcttgtttgattaaaagatgcttttatcttttgtatatacgtgactgtgtgtgcatgggtatgaattttacttttgtttttttaaatcaggagtagcagttgatttttttatgacttttcatcattttagaaagtttttttgttgttattgttaattcttcttcatcctttctgttcttttccacatctcacactatacagatgttgaatattctagatcatgtccttgattgctattgcagtcttctctaatttccatcattttgtcttagggttttacattcaacgagaatgttacaagggtttttccattttgcaaatattttttagtaatatccattctactgctttttccagtgtagtttttgtttcagtaatgtttttgtccccaagaaccccatttttctctgagcttttttttttttatagcactttgctcttgtgtattattgcaacattccttcgcttatcactgactatactaactggaactatcccagctgtgaaatctaattccccatttgctcagattgctgtcttttgtcttcacttttgagctgtaaactttatgtttttgcctatttgtagaaacagagactagatttgatcaatctactctcagtaattgtatatgttttttctatttcttgtgaggccttcctttccaaaattcatgaggtgtctgtggtccaaaggcagacctcatttctaagctgagatcaaagaagcaggtacctcccttgagcagggtatggctctagtggcccttgggctgtgtagccccttatcattcaccatgttgtcaacacaaaccaaagtcaagcttggggtgaatgctgtacactttttatatattctacactgaggaagatcttcacacttgttgatttgttctcactctcccaacccttgccagggaatcttaagctggcatcattcagtaatggctttaattggaaataattaagtagaaagagagtaggagcctagaaccttagttggttttccttctgtgtttattgcagcattcccagttagctgagatgctgctctctcctttcctggcctacttgttatgttaggagacctactaaacaaataatctactttaattagcaggcagtgatcaaatacagtctagatgatcatggctgtggtcagctctattgatagacattggcatggttccccaagctctttgatttgcatcttccctcttacctcatagcaccttgccattctaggctttgaagtcttttagaacccaagtggtaaaacaatcatatctctcaggttggcctattctttgcatgtgttcagtcataggcaataaattaaataggttttcctttgatttcaacctactttctaggattcctcaaagtttatgatccagtgatatgctccttagtttatcagcatcattaaaagtacatctcttgtttattttttttttgtaatttcagtgggatttgtcaaaggagaaagtaaattggtaggctcaattcaccaccttgaaagtagaagtttgcatctatgtttaaaggataattagaggagaaaacatgagacagttaataatactaactgtattaagtgcttcctgtatatctcaaatgattttatgtgcttgtatttattcatttactcttccctcaaacactgggatgtttaggtactattactatcccctctttacaaatgagaaaattgaaataatgagtgattattccttttgaagaagtgataaagtgaagatttcaagccacgggggtgtggcttcaaagtctaaaaagaaaatcaggaaatgttttcagtttctttgagaaatttcttgagatggaaaggaggaaagtaatatcaaataatattgagtattcatttgagagatttaataaaaagagggaagaaaatgaacacgagctgaggtgtagcaagaggtgaaggaagattttgtgtgtgtgtgtgaaaatatttgaatgtttattggataatggggaagatccagttgtgtgcacaaaattgaaaaaggaatgttaaaatacttagtggaggaagatactgttgaaggcaggaagagatgtatttttgtggtgctgcaagagacagggagcctgtgttaaattacctgatttttagctaagtagtaggtggaagtcatttgttaaggggaggtggggagagaatcataggaagagatgtaattgggtgcagagagaaaacgttttggaataagtactctggggaatgagataggaactcagtttctaataatcattgttagtttttttctgagtctttccacaatctttacatatgtaaattctttttttaaaaaaaattttttgtagcaatggtgtctcactatgttgcccaggctggtcttgagctcctgacctcaagtgatcctcccaccttggcctgccagagtgctggaattataggcatgagccaccgtgcctggcctatgcattttctacatatgtaatatataaaagctatagtggtatttagcacatcaaacattagcatattgaagctccaaaagtcctcttaagaaagcgtctgttttcagtgtaacagttttcataatgtattttattactgaatatatttttcatgttatacttattaatgcaaaacttgcttcggaattatccagtttttttgacctctcaggttcaagtgattctcctgcctcagcctcccgagtagctgggattataggcacccgccaccgtgcccagcttatttttgtatttttagtagagacgaggtttcaccatgttggccaggctagtctcgaactcctgacctcgtgatccacccgcctcggcctcccaaagtgctgggattacaggtgtgagccactgcacccagcctatccagtttaatctattccagggtgttctaatttggagaggagaaagcaacttctgggtaggggaaccagaagctgctactcctttcatattactcaagtcactcaaaagttggagacatgttatcaattagtaacaaaattagtaataactaccacttattgagtaccagttttattctttatgtcttgtatgtgtgttttggtggttcctcatagacctcattatttctgttactcatgaagaaacccaggcaaagaaatatgaaataatttaccccattaactggtgaagacatgattgaaacacaggtctttaatatttcagaatctatgttccttatagtacagcatgtgtctctcgtactatcttatagttttctttcaattggtagcatggaagagtttcattatacctagattagttctggaacttggtattattttcattatctctgtttgttctaccagaagtcacttgtttctgtttatattaattacaagtatgattactcaaagtgacctagtgaaaaattttcagtggtgtaggtcattatttccctggctgtgttccaaagaacataaattgttagagatattcataggaattctaaaaacgggaagggggcttatggtacaataaattttggaaacacaacatactgtatatccttggagagttttgtacatattagcaacttaaaggctacaataaagaaacctatttcccagcatttcctgaactaatttgacaatgagatattttttcgaggaatttgtcttcacatctcaagtcattagcattcatcaaaacccagttcagtaaatgctaatatagactaaaagtaagcttctgttttggcacatcctggttagcctttcatcagctaagtgtgtttcattgccagagcaacttaaggattgtatttggaagtatgccagatgcatacttatttagtagtaagtatgctaacctttaaatggtgccaatacatattttacttcacattgctttcctgccactgtttcattttaaatactctgtgctttttaaatacacttcggttaagtcagatatatttgcatggtttttattcttatcattttagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggtataaatggaggggtggggagggggagaaatcctgttaatcttacaaatttataggctaccaccaccttgtcatgagtattttcagctgatgatgctgcctgatttttatttagtttggggaaataagaaacttggggttttttttccttcatttatataaattacagcgattttttccccttcatattttgatagttacatttccaactttaaggtaggtctcatctatgtttacatcttctccacacccatctaccaattgaattaacatttaataagaacattcttattacatattcacaagataattctggtatgggctgaatatttctaatctgaaattcaaaatgctccaaatccaaaactttttgagtgccaagatgacgctcagaggtcatacacaaaggaaatgctcattggagaattccacattttggattttgggattaggatgctcattcggtataatgcagacagtccaaaatccaaaaaaatctgaaacccaaaacacttctggtcccaagcatttcaggtaactcaacctgtgttgtagggtgagaaaacttttagaaatttagggagcttcaccttaacctttgttcagggctgcaaagaaatcagtaccatggtaatgacaggttcttttcctccttcctaccctatattttgtgtgtaaaagatctgcctttttaggtaaaggagttctccactaagtgtcccatatttaggagtacatttttttttggcttggttgaccttcagtttatatttgcccagagtgagagaaaaaataaaataggataaaagcataaaataaaacagtcagtgacaggtagtagggagtataatttaggtctttggataggatcttgtcaggcatgatatatcagttttttgtcagtaatagtatgagctgggtaaattttaagagtttatttggtttattaataaggaatatttttaaagtgcatttttaaaggtatttattgttgggtgtggtccgtggagtataaaagaaaaacaacgtggcagattccctcatctggttccccttccaacagtgggggaatctccacctgttagtgaattgaatgaaatacagtagaaggctgaagcgattttacactggcaaatatctctaaaattttcatggtatgttaacttgtttaggaatctggaaattcttcaggaccttcacctggtgctaagttttcccacattttacaaaaggatgcctttctagtattcaggtcattgtgtaaactgtcaatgaaaccactgtcagatggaccaccagatccaaagtaagttattaactgttttgcctgacaaatagaggtttttaggcttgaaacttactgttaaggtaatgtttggattttcttttgttctttttgtcctatagaaccataaaaaaaaattgggtggaggggaggtattttacgtttaagaaaaaagtattgaaaaacaattcaaaactgctggagtagataacttacactatttcctaaagggtatgtgacttatactattttctaaaaacaaaaagtttcagcattgctggaatagataacttatgctatttcctaaagggtatgacagcattctagaatagtgtctggtgcataggaggggctcaataagtattaccaaatgaatgaattaatgaattcttatttccatataagtaactttggagctaatgtaaccctgtatcccagccctaggtttctaaaaactgccagtcaaaaggtactaaaacctaaaagaaatcttaaaagttgtaatgaaagataatgcatattcattaaggtctgacaaaatgccctaggatgatgtctttgtctattgggatcaggaagaactttgagttaggagccacttgtctaattttcatgaaatatattagattaaaccctaggaaagtgccatttttgtaagtcataaatggtcaagtatctctcgtgattcaaatgtaactaattacttttgagactgagtttggaagttatatgagtcgcccacctctctaatattgcagcatgatgtattgcaatatgacaattttagaactttctggagaaagaaaccttggagcagaccataactttaagaaagggatattgaaatagagatgtaaggaaacggtacttcaatttaaaaaaattctatagagtgtttcagtttctgagtgccagctgagcagaccagagacagttgctgtgaaaacttcatacatatgtggaaactacatttgttatatttgtttaattttgtcagattgtaccagttcagggagaaacatcctttagtcccagaagcctaaaatcataaaatctttttagacccaaaccctaagtcagaaatcaacattcaaaaatctcattaaaaaatcgacagttttgaattttaaaaagtctcattcaaaaatcaccagttttaacatctcattctgaatcaatgaagacctactttgagaaagagataagaatttggtattattgctgaagggcatttttgccatgctttaaaaatgttattgaccattaaagcctcagatgcttttttccaaatcaaatgtaaaaattgtgatttgaaagaatgctagaaacagaaaagaagaaattctttaaaatgctgagaatgaaaaggacacaaaggaaaataatatgaattttgaggagtatgttcatttattcctgaaaaaaagagtgatctggttttgaaaagatgctatctttaatgttacaaaggatttttatgaggaatgatgtaaattaacaagccttatacttagtgggtttaaaccaaatattaggaaattttgtttgaagaccttcttgacttgactgtcagggtcattaaacaatggaattgaatactgaatacacccttagaagctattatttttccaaaagaatatgtagttttctgtttttaatgattttttttttttttgccaaaagtcaagctttcgtagttacatcattttcttttttttgtctttgcttccccttatattttctggtcttgctaaaatgatgatccaggaaatgttcttgaagcctgaatcataatttgaaactaccccatgaaaaactgcagacctgaaatttccagcctcttttgcctatcaaaagtataacttattgtgtcataagacagttgtctaatcatttcttcattcattattgccttgtacacagtaggtatttaataaatggatgaatacaagaataagtccattaattttttttagcatgtacagtgtacaagatattttgttaaatgttgggaatacaaatataaaacatacttagaacaaacactcattgttatagaatggtaagctgcaggatttaattacaataggaattgagcataataggtgataaatgtgagctagaataggaagtagtgtgtaagccttggaagactagaacaggaggggaggtggtgggttaatttgtagttccctgtagctatttgaagtcttagttcttgctgtctctacttgatttatctaagcattttttttggtaattatctatttgctgcatatattcttagattcaaaggaagactcagcacaatggccatcttagaaacatgactgtgtaataatgagccataatattattggctccagttttatttcagagaaagtagtatttttttgtgatacccatttacgtgaaattaacaattccttattagatttacgtagcttcttgaattacttgacacttataaccataaaatttttcaggtggaaatcaagggcaattaagtttactatatagtgtaaatgtgactgaaagcagcatttgggctacttttttttttttttttttttttttttgggaaaaaaaaaaaaaccaactgctagagcattttggtgtgttccgcatttgaaatgttgcctgggttcaatgtccttggtctgttgggcttaagagatcagtttcaatgggaggaaaattgtgtttgcaaaatcaaataattaaaacactagatagtgatcagaagcatgccatagtatattgattgggaaaaaatttaaaaattttaagccaaaaactactttttcagcttttcattacagaattatttagaataagttgctaagctatttaagtttgtatttttattttattttattttattattttttggacacggagtctcactctgtcacccaggctggagtgcagtggtgcaatctcagctcactgcaacctccacctcccaggttcaagtgattctcctgcctcagcctcccgagtagctggggttacaggtgcccaccaccacactcggataattttgtatttttagtacagacagggtttcaccatgttggccaggctggactcaaattcctgacctcaagtgatcgacctgcctcagcctctcaaagtgctgggattacaggcatgagccaccacgcctggccttaaagtttttaattgttctgaatacctctatatttatttcaaaagaaaaaaaaatctttaaatggttaccgaaaaagtaagcttgaattagtgctgtcacttgttaatgcaaccaaaacttttttattattgtttaggatttttgagtagcataaccagaaaaaagtccattggaactgttgtgtattaatactaaatatggcatttaatctgacaagttgatgatgatttgtaagaagtatggttgtgaaagaaaggaacacaacatatatcttcacactatttttttcttttccagtgaaacaatacgttgatgttaaatatttgtgaatttttttttctttttaaaaagtttgtgggccaggcgcggtggctcatgcctgtaatcccagcactttgggaggccgaggtgggtggatcacgaggtcaggagatcaagaccatcttgactaacaccgtgaaaccccatctctactaaaaatacaaaaaattagctgggcgtggtggtgggtgcctgtagtcccagctacttgggaggctgagacaggagaatcgcttgaacccgggaggcagaggtttcagtgagctgagatcgctgcactccagccttggtgacagagcaagactctgtctcaaaataataaatttaaaaagtttgtgaaattataaatatatggttcaggggaacatcagtgaaagcacctgttgttagtgcctaagttgttcatgtactgtactttttttatgttatagaattttctcttcctctccatttacaaagtttatgaaattatgattatgtgtatctggaaatatttttggaacaacctgttattactataatgccaaccttgttcatatactatgccttcttttttacattttaggtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtacgttttgcatttaggcataatgttactattggatatttcatttgtttcatgttaaattatatttgaatacactgcaaagttctccagaatgaaataatatttgtatattgccatgcacttattttttttcattcacctgttcaactaatatgtgccaacgaagtactaggcactggataagcactaagaatgcaaaatgaaataagatggagccactgtcctcaaggaacttatactagttgaataaatggttcttgctctcttgaattaatttggtcctcataatagctttgccattgtctgtgtggtatattcgaatacatttgtttatcttaaaagaaagttccaaatatatattgcatctccattattttaaaccatttgtaagtattaggcattttaaaagatgtgattgaggggcattatattttggggttctattttggatatttgaaaaaattaatatttgctttgtactttttttttaatgtatatattcctaaagttttcttccaggatctttggaaatagaatagcaatcatgtggtcctaaaatattgtcagagatttagtagaactaaattagggatgttttcaatcgtgtctgcatgtgttgtgcaagtgtaccagtttctttttttttttttctttttccttttttttttttttttttggagatggagtttccctcttattgcccaggctggagtgtaatggtgcgattccgactcagcacaacctccgcctgctgggttcaagcgattctcctgccttagcttcccgagtagctgggattataggcatgtgccaccacgcctggctaattttgtatttttagtagagacagggtttctccatgttggtcaggttggtctcaaactcccgacctcaggtgatctgtccgcgtccgcctcccaaagtgctgggagcataggtgtgagccactgcgcccagctttatgtggttttttttttttttttttttaaggtgtaccagtttctgattttttgttttcatcttcaaataaaacttaaaaatagtactttatgttttaccaatttaatgaatgcttttttcaatttgttatttgttgaaatgttgttttggttgtgatgttgtatggttttgaaatactcatttttatgttgtcagtttttaccttcatattatgtttgatatacaggttatattttaatttttgttaattttatatttaatcctaactcaagactcataattcactagcttgttagaaaggataaattatttttccagaatttcgaaatggctaaaatagtcatattatcctttaatgttaatgttctgtaatagctatcaagattgatttagagcattgttatgagaatgaaacagaattaggccttggtattttaagtgaaaagctttttaatttgggccatatttttggacaggaaaccatttttggtgcctatatgatgtatgatgtcaagttttaagagtttgccatatgtctgttaagataatacaaggcgtttaactaggaagagttgccgtttttagatagtttttccccattatctgtaggaactataaataaaagacagttaaaaaaacttttagaacttttgcttttgtaaaaaaccagaagtctttcatctgatgatgagacatttaagttggcattagaaaattttgtaatactttatgtaaccaattacagatttttttggacactgagattctgcttctgtaggtactgtttaccgacagtaaaatataaattcttagatctagatatcaaaaattatttaagttgagattactatttttgcacagcaaattcaactttgcaaaaatgaatttgaaaggaaaaactttaagaaatttcttgtcaatttgtagatgtcagattctcattacaaaattattataatattctaatttttaaaaattaggtttatttcactccttattgtccctcagggggcgataatgagggtaaaatgagataaatatagatatactttcaaaaatgttatacacactcaaattataaatgagttgagcaccgggcacagtggctcacacctgtaatcccagcactttgggaggccgaggcgggtggatcacctgaggtcaggagttcgagactagcctgaccaacatggagaaaccccatctctactaaaaatacaaaattagccgggtgtggtggtgcatgcctgtaatcccagctacttgggagcagaggcaggacaatcgcttgaacctgggaggccgaggttgcagtgagctaagatcgcgccattgcactccagcctggtcaacaagagcgaaactccatctcaaaaaaaaaaaaaaaaaaagctgaacgtggagaaagcccagctatgaaaacctaaatttgcaaaacaaaattaagattgtttttacatgaagattcattttatgagaatattcacttcagagtttctgtgatgtgattttttcatgggtcttaaattatatatctattccagaagatacagtttatgtacaacttttcaggagaacatatgtgaagacagcatacttaagatatagctgttgttccacatacatacattataggtcctcgataaattattaaaaggttgatttttttagagcccctattatgataggcataatatcttatattacagcaatagacttttgcttattagtgcaatttgataaaccattgatagtagctaaaattttttcttccctctctcttccagtctatattatttattttgtcaatcagaggatcccaaaagtttttgattcacaagtctgacttttcatgaaagttgcactttggccagaggaatacctccagttctatgttctatttattaagcaggcagggccaaacaacttaatggatatttgtcttcacagcctactatgtatttcaaagacaatagtatgcataaagtaaaagaaaaataatgtttttattttattctttaccgcaattacttaccactgggatgcgtgtgcctattagaaactgcacacagcttcttagatcttggaattgaatactgtccccctcattcctgtacttcattgattttcattcagtacttggttttttatcatagcaactaccaaaacccagctttgcggagataattatgtcattgaagggaatgtagtgtgatttatttgaaaccatgagcaatcttttgaggtatccaacagatgtatctccctctgaattttgcctcagaattttttcagggcaccctcatgagtttgctacagcattctggggtactttgatgcagtttttgggaattgtggccatgttgccataagtatttattgaacacctactatgtgccctgcaatatggacgtgatctttatcaagaaagacctggtcattactgtcttcaagcttacagtctataggagatactgatattaaacaagtaaatagaaatatgctgagttttgtgaaagaaaatcacattacaggggtacctaatccagttagggggagatactataaatgtgattttctgggttcataatgcatatgtttcataaatgttaatatgttggttgtttcagtcattccttcttaaagtcacttttatagaatacatttaaatctgaaaattcttatctgttaaattgaaatttatctcattaggttgattaactcactgcttgattatttggtgtaaagagtagtgagaaatagttcatatgtagttttcaaacagtagagattttcacttttgtgagtaattagaaaaataaaaccgtatgagacttagattgtttttattgtgttgattagagtatcagttacatttaaatctacgaacagttaggcctctcagtactagaacgtctctgaaaaatataactgatgaacagaagtataaattacgcttttggagggggattaaaaaagcgtaagttatattctgtaaaaatgttaaagaaattatcacctagaggaactctaaatctttgcatatttcttttgtagcagctgtgttgagaacaaaacacatcaatgtgaattgcagtactgataactagaagggcaagtttaagtcacttacccaagatattttagtcctgaggattcagagatggaactcaaaaggagttgaactccataagagcctgggtcctaatacctgctctatagctctgggatgtttaaaaagtgatcacacatatgaattctaaacaatattttaaacagaagttttctcctaatcacaggtgttctttaaagaaattttcttatacattttggaaacttctaccagctcatttgatcacaaatggatggttattcagacactgacgaggatttgtgcaggtattttaaattatcctttttattatctctttcttattattagatatttaaaaggccaaatgtactcatatcctagatgtactttgttgaaattaatgttatattgttacagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggtaagaactataaaaacattttcaaatttaaactttaccaggaaagagtcatgtgttttccttaaaagacctttaaaaaaaattttgtttttgaattactttgtaggaattgagcctgaggaaaaaaggtttagaatgcttagtgtcgattttgaagtgtatggttgaatggagtaaggatcagtatgtgaatcccaactcccagacaactcttggtaaggtgatattttgagctgtaattctttgtcattttaagtgaataatactttggaggatagttgcagctgctgttaaaccaatttcatgacatatttattcatttaactgatgaggaaacattctctgtgagttaaatgtctagctttaaaattgtgagatttttaacttagttatccaaactatttttttctaaatcttcttagaaatattttgattatgtaaaatgaagcatatttatgcaactttcttgtattataattatagaggaaacatataaaaggcagtatgttttaagaaggttgaattgttcatctgtgtttgatgtttaccctcactcagagaaaaactcatagctgcagggctacactggtattatcgaaaacaattcctcatgaggagtgagctgagagcagaaatccagtggatactcagcactgcaactgcaaaaagaactcctcctaatggtgcagactatacacgtacaaattacagtgtgttttaatatcaaagtatgttgtttactatgttacctaatagttattttgtattaaatagatatctaagcaacattgaaacgccttgccttattcaagaatttgtttgcccttacacttttttttttctttgatagaataatgtactctatcaatttttcttctttcaggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttgtaagtgtcatagcttaaggagaaatgttattgaatatctctctgccagtatagtgccacccctgccgtgggtttatcaccttataatgagtaaaatggaggatagttctcatggatctaattcacgaggctcctattcagccccccttgttcattgcagtctagcccaactagattcctgtaatgcccaaccactcttgtcatataaattaatttgtcaccatattataagtgctgttgatgggtatcatctgtgcaattttgcactgtttagctcatgacatccccccattatattttctaatcatgtgacaactcaaaacatttaaaatatgaaacttctaatagctatcagtactcctttataggtcttacattttttccagctggcttacaaatgtactattcttgttattgatttcatttttatatgttgatgaggtgatcacctctcttccagcctggctagtgtaccggatcctaatcttgtgaagtcagttttcccactaagctttgtgatacctgcctgctcctggactatttcctttgtgaatgtcaccatgctgccttcctttctcttgttgcccatctctttttttcaaagagatgccataaggaaaaatgaaattgtttgccgtctccatgaatctaactattataaacttaaaaattcccctgtgtgcttacttggtttgctacttctgtaaagcatttcttcctgatacttaagcagtgccttttagtgaatgttcaggtgtcttttttctccagtgttaatatgaaaaacagttcaacaaaaatgtacacatattctattttaaaattacaaaatcttaccaaattgcctcaggaaatagctgtcactactgcattaattctaattgttcagtcaatatttattaaagtctcatctttccagatattatgcaagatcctggggaaactagatacatggaaaagcccttccttctgagaggctcttggtctagtgtgtgtaaacaaatatgcatattgaaattctgctggtcacccagtaaacacatatttggtacttgggactattgccaagcaccatgaaggcattggtccttgtattcaagattgcattctaaacatgagcaatttttaaaaatagtactgtgtaaatgtttataaaagagtgtcgtacagagtaagtactgccaaggtacttattttgaagtacttgagaaatgagaaggagtagtcagagggcttcgaagtggaagtctcccagtccttctctcagcagctagacttgctttctacttaatacagccattgatgagaatgctttcatggaactgtattcctagtatacttgtctacaactgtttcatgacaccagtctatcctgtttctctcctacctttttgactatgccgtctcagtcttgtgggctgttttttctttcttcctgcgtgcatcttagcattgccagcgttctgttcctcagcccttttccaacatcagccccttagttctcctacccaaaacaaaagacaaatagagaagcctgttatttttgtatttcttatttatggtagtaaccccagcatgctactaaatttataagctaaaatcctgggagttagcttagattttcccctcaaaggattagattctcgaatctaatctgtcactaagacttgttgattatacttcctaatatccctgcaatctgtactcttttctcgatctcccaccactattcttgcaaatcaaatcatgattatttatttcctcaactagtataatctttcaattggcttacctttttctttggttttgttcattcttcagtcttttcccatgcttaactagagtaacctttcttgaatgaaagtctattttttccctctcttagagaataaaaccaaagctgctttgaaggtatgataataccttcatgatttggatctgctggactctaagcttcatttcctgccacttttctgtctcacctcactttccaacaatgcagaactatttattatataatactgtcttgtgcttttgtgttttagtatggcttcttcctctcttgcatgttttttcttattgtttataaaagatataattgttcttcaaaatagttccagagtcacctttcccaggaaatatattatgaccatctaagttagttacttctactgtgttattttcttaccttgtgaatacatctatttgtcacagttttagtattataattctttaaaattgtgtttcttccattacagtgagagcttctaggggtagggggattatgtttagcttagtgaaaagtgtttcattttatgaatgttaagtggttatggttggatgagaacttgacaagggaacctttaggaagagcatcccagactaagagaatggcatgtgcagcagcagaggaaagggaggacatctgagcacttgttcagcatggcaggctagagtggagggggaataacaggaggtaagattagagcattgggttggatctaaattacagaaggccttattctccatgtaaaggactttttgttgtcttgttcctcttggcgctagcgtgctagtgaaggactttaagcagaggagtagcatcatcagatttctgttttgtaataggactttgctggcagcctgaagggtgcattagaatatgggcaacatgagctagagggagaccatttaagaactcttgcaatagcccaaatgacaggtgttggagcaccaaagtaacaaaagtaggaagtaaatgatctgtaaacagagaggtaacatttgaattggatctttaagcctgagggagactcccctgtgaatggagcaggtaaaagacatgcagaggaaatagactctaaaaatagatttagggaatgggatatgatatatgggagcagaggaaggagaagggagtgagagagaatctggagctgtattgagaaaggttttgtgtggtctaattaatttggacaaatgagccaagattacttgaagattaagtagaatgtatattcggagtaccttagggatattgtgggttcagttccataccacagcagtgaagtaaatattgcaatatagtgagtcacaccatttttttgatttctcagtgcattaaagttatgtttatactgtaccatagtctattaacctataacccccttatgtctaaaaaacaatgtacacacattaatttaaaaatactttattgctgaaaaatactagtaaccatctgagctttcaatgagttgtaatctttttgctgtagagtgtcttacctgagtgttgatggctgctgactgatcagggtggtgattgctgaaagctggagtagctgtggtaatttcttaaaataagacagcagtaaacttttttgccttgattgtctcttccattcacgaaagatttctctgtagcatgtaatgctgtttgatagtatttacctacagtaatatgtctttcaaaattggagtctgtcgtctcaaactttgctgcaattttataaactaaatttatggaatattctaaatctcttattttctttccaccagtgttcacagcatcttaaccagtagtagattgcatttcaagaaaccactgttttcacttgtctataagaagcagctactcatatgttaaagtttgatcatgaggttacagcaattcagtgtcatcttcacactttacttctaagtctcttgttacttttaccacatctgcagttacttcctcccctgatgtcttggactcctgaaaatcgtccataagggttagaatcagcttcttcccaactcctattgatgttggtatttttacccctcccatgagtcacaaatgttcttaatggcatctagaacagtgaatcctttccagaaggttttcaacttactttgcccagattcaacagaagtatctctctacatggcaactataaggcagctctctacatggcagcttttaagtagtatctcttttaagtagtatctctacatggcagcttttaagtagtatctctctacatggcagcttttacgacttgaaagttagcctggcatggtagcttatgcctgtaatcccagctactcatgaggcctgagaccaggagttcaagatcagcgtcggcaatgtagcaattccccatttctttaaaaaaaaaaaaaaaaaaaaaagacttgaaattcagagttacttctgaggaaagggcacggtggctcatgcctgtaatcccagctttgggaagccaaggtgggaggatcatttgagcccaggagtttgagatcaacctggacagcatagtgagactgcatttctgcaaaaacaaaatcactctttcatccaagggctgcagaatggatattgtgttagcaggcatgaaaacaacactaatctcatcgcacatctccatcagagctctaaggtgatcaggtgcattgtcaatgagcagtaatcttttgaaaggaatcttctctttgaagcagtagatctcaacagtgggcttcaaatattcagtcatctatgttgtaaacagctggtgctgtcatccaggctttgttgttccatttctagagtgcaggcagagtagatttagcatgtaattcttaaggaccctgggatctttggaatggtaaatgagcattggcttcaagttaatatcatcagctacattagcccctaagagagccagtctgtcctttgaagctttgaagccaggcattaacttctcctcccttgctatgaaagtcctagatggcatcttcttccagtagaagaaagactgttttatctacatggaaaatctgttgtttagtataaccaccttcataaatgatcgtagctacatcttctggataacttgctgcagcttctccatcagcacttgccatcagaccttgcacttttatgttgggagactgcttctttccttaaatctcatgatccaacctctgctagcttccagattttcttctgcagcttcattacctttcttagcctcatagacttgaagagagttggggccttttttgggattaggctttgccttaaggtaatgttgtgactggtttgatcttcttttcacacgtgaaaaccttctccatatcagcagttaggctgttttgctttcctactggtgtattcactggagtagcacttttaacttccttcaagaacttttcctttgcattcacaacttggtttggctcaagagacctagctttcagcctgtcttggcttttgacatgccttcctcactaagctcaattatttctagttttttatttaaagtgagagatgtgcgagtcttccttccacttgaacacttattgtagggttcttaactggcctaatttcagtatttttttgtctcagaatagggaagcccaaggaaaggaagagagatgagccagtcagtggagcagtcagaacacacacaagtattgattaagtttaccatcttatatggacgtggtttgtgtcaccccaaaacaattacaatagcaacatcaaaggtcactgatcacaggtcacagtatcagatataatagtgaaaaagtgtgaactattgtgagaattaccaaaatgtgacacagatacaaagagagcatatggttttggaaaaatggtactgatagaccctcaatgcagggttgccacaaaccatgaacctgtaaaaaacacgtatctgtgaagtgcaataaaatgaagtatgcctgtatgaaatatttagtattactcaaagttcgtctactacatggcattctctctaatagtctctcatagtctaatttcccactgtggatatggataaaaaaatacttcatactgtaaaaaagtaagtaaacaagtcagtgaaatgatagtaataaagatggccttccatatgagacttatttctaaaaagaaaagaataaagaaaacttggcacaatgtaattattttgtacattcatgtactgatgtgtattaaataagctactattttctgggtgctattagaaaatttactgtggtttaagatcttttcagggactacgaatggttttctatttttaatgttcttatttaacatcatctagatttaataagaaaccaaagagaggaatacagtacctccaagaacaagggatgcttggcaccacacctgaagatattgcccaattcttacatcaagaggaaagattagactctgtaagaataccattttcattctaaccttttctgtaaaattcttgggatttttttttctttttattagagacagggtctcgctatattgcccaggctagttttgaactcctgggctcaggcaatcctcctgcctcagcctcccaaagtgctgggattacaggcgtgagccaccacgcctggccccgtttctgtaaaattcttttttaagttaataatacatattgtgactcctttaaaatgctttcctaaatatagaggtaagtaaaacgtaaagaataaccttggttggccgggcacagtggctcacatgtgtaattccagcgctttgggaggctgaagcgggtagatcacctgaggtcaggagttcgagaccagcctggccaatgtggcaaaacctcgtctctaataaaaatacaaaaaattagctgggcgtggtggtgggctcctgtaatcccagctactcaggaggctgaggcaggagaaacacttgaacccaggaggtggaggttgcagtgagccaagattgcaccactgcactccagcgtgggctacagagtgagagtctgtctcaaaaacaaacagaaagatgtcttggttataatataatcatctctaattggtcctccgtagccatgagttctgtatccatggattctacatctgtggattcaaccaaccacaaattgaaaatattcaggggaaataatgggtaattgcatctgtactgaacatgtacgaactttttttcttgtagttatttcctaagcaatacagaaaacctatttacattgtattacctattataagtaatctagatatgggagtagagtatatgggaggacgtgtgtaggttatatgcaaatactgtgccattttttataaggaacttgagcatccatggattttggtgtccatgcagggtcctggaaccaatcccccactgatactgagtgatgactggtgtgtgtgtgtgtgtgtgtgtgtgtgtgtgtgtgtaaaatctgctttttaaattttctaaactgaaaagaatatcctgatatatttatgaaggcatttagtgtgtttaacttttagctttgtgtttgaaattgttaactctataatcaaaagtctgcggatcttaacaaaattttctgctttttaagtggctgtgtggtgaatgtaaacatctcatgaaaatctcaatttctggccgggcacagtggctcatgcctgtaatcccagcactttgggaggctgaggcgggtagattacctgaggtcaggagaccagcctggccaagatggtgaaaccctgtctctattgaaaatacaaaaaaaattagctgggcgcagtagcaggcgcctttaatcccagctactcgggaggccgaggcaggagaatcgcttgaacctgggggcagaggttgcagtgagccgagatcgtgccactgcaccccagcctgggcaacagagcaagactctgtctcaaaaaaaaaaaaaagaaagaaaatatcaatttctatctctgtttttactttagactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaagggtaaataaggttcaaatgctcattgattgtctgttatatccaaaccactgtgctaggtagcatccagggatttacagataataggacctaatcccctgtttagagaatttagattgtctacaatctggaagtcgtaaaacaaatccataaaaaattgtaatgtgagatacttagagaaataaaagtgctatgggatttgaggtgacttatttaaatgaaactatataaaacagtagaagtttataacatgatacatttatttttccagacaaactctctttgctagtgcggatacagcttatgttttggcttattcaattatcatgttgaccacagaccttcacagtccacaggtatgttttcttttaagtcagttttacaataagcggtacaaaataagtacattattctgaattcagtaagtaatagttgaaattttagttttattcagttaaaccagtcaccatatttgggtatttaatttgggatggtgaacattttacaaaggcaacttctggtagtaattaaaattagacttttaggtatctataaaatgtttctgtatttgtcgttcatgattgacaactgtataaagcttaagataaattttaatctaacaagacatttataggtcttatgtcagtttgtcacaacatggaaaaacgctgtgtataaaccatccttctaaaaaatataatgtttcaggccaggcgtggtacctaacgcctgtaatcccagcacttttgagtggccgagacaggcggatcacatgagtccaggagttaagaccagcctgggcaacatgatgaaaccctgtctctacaaaatatgcataaattagctgggcatggtggcatgtgcctgtggtcccaactacttggagggctaaggtgggacgatcgcttgagcctgggaggcacaagtcatacagtgagctgagatcgtgtcactgcactccatcctgggtgacagagggcagaccccgtctcaaaaaaaaaaaatgtttcaaacttcaccagtagagggattagcgtaatgaactctaatgtacccattacctgccttccacagttatcaacttatggccggtcttgttctatctatatctctttcctcccctagataattttgaagcagatctcagatatcataccatttcatctgcatttatctcagtgtgtttctctaaaagagaagtactctagttaaacataaccataccagcatacctaaaaagttaacaataatttaaaaatacctgatatctagaaatgttcttttgcctcatgaaattcatatttacttcttaaatattgaagaactgtcacttgatttctgatacctacttaaaaagtttgatttaaagttttagtattttttgcttagtttctaaaaacacacattgacatccttgggtaaaattacatttataaattatttgcaaggatttcttagtacttctaggggtaggtatctgatgatatttgttatgcttaggttgtaaaataaattacctactttctaatctgagatgtattggaaaaattaaaattcatttgaattttgagattaacctttgcagtatagggattttttgtgtctgttttgagatgtttaaagcagagtagataaggaaagtatataccaaacctaaagtaagaatatatacgattatatacatatgtatatacatatgattatatgtgaagttactcctgttttaaacacaatattgagcaactatgcatttaccacaaatttacttgattttatataggactttaaaaatttattaaagaatttaataattcaagatttgcctctggcatatttttggcagtatagtcaaagcagctcaccttcagggcttttattatcgagcatgatgacttctattctacggctttataaggtagttcacagttgggatttgtttagatatttttacaccagaattttcagtctaattttttcatttgatttttcaatctacactagagtattttgacctgggtttacatatgtttggttttaaaaagctatgctttaaaagacatttggttctctaaatgaataagcaatattatatgcacctgtgcaatgtcttcctatacatatgtacatactcatgttattttgaagaaatattaaaaattccttttatgtcttttcataagtacctagactgtgaaaagtttctaaggacataccagttagggagtattaccttcacaacagtgtcccgtctttagcataacagtgcctgtttgcagaacatgtgcttggagtcctagtctagcggtggcaactgcttgttgtccaactgttccttatcagcttgctgcctggtgtcatgtgctgctatgcagcctgcagctgtagaacagcttgtgagtttctatgaagctaagtaatctgttagaaaattgtacccgtgatcttggcctcagttgatttagataactataacaaatgacaacattttaaaatacaaataactttaaaggaatttcttaaaactaattctcattcttagttcttttcaaacttaaaaaataggtggattttaacaagctgtttatgttcccttttcacccagaatatttatagttaggctactttttatgtagtgtgtggtgagtcagtgattaaaaaaaaattttaggcatatttagaacacaatttttgtgtatacaataatcatcagtagtaacaactggctttaagtgatttaaacactaaataaggcacagcttaatacaagcacacgaggataaaagtcaagagtagaatgttccataaaagatggcaggagaagaaaagtaggattttgttttatacagcttcagaatcccactatggcagaagtgttctgtgtgaagcagtgcacttattttggggacctcaaagcaaagtattctgtacgcccacgtatgggatccctaacccagatccacaggcaattaactgctacttcagattttctgtcaagacttttctctgcctctgattggcataatgctaaaacattttgccatgcttaaaatttccaggtgattttaatcttcctttacttcttattggcagcagtgtgtagtcttttattttgttattcctggtgtgttttttaagcattcacctgaactttaggtaaaaaagcttctttctttcattttttttttttagtgccatgacttgagtttttaaagttataagatagtagggttttattccattaaatgatacgttaaacacttgaaaactttcatggtaatatttttacatatttgtagggaaagcactcctgcctccctttctgacatgttagaaaaatctgtttgcagaataatctgaagtaaataagtgtatatatcccagttacattttctgaaagttttggttcctctgtacttttgtttttgtttgagacaggattttgctatgttgcctaggctggacttgaattcctggtcttgtgccatcctccttccccagcctcctgaatagttgggactacgggcacataacaccacactctctatagtttttgcaagcttctgatgacttgcttgattgtttttctgtgtactttcatgtaaatttacaggaattatatcttaagagttaccttaagttctttatggaaggtggtagaaatatatttaattaaataaatacctcttcagagacatcatataagacgtagaaatatatttaattaaataaatgtctcttcagagacatcacataagacttctgggttttatctatctaggtttctggaggtaaagtgtaaacattttggctatgctagttcccaagtttggtaatggggttaccgtcttacagactccaaacttgtattccacagctttatcaaggtgcaaaaggcatttctgtttagggtactcttatacaagacaaaacattccaaggatactttgtacagatcacctgacataattcagttgccacagtgactcagtcagagagattgttaactggttttaaataaatctcaagtattgttactcttatacccactgtatataaagtcagctttaaattcattaacagcacatttatgttcttctaaactaagatttgaatgtttttgatatctttatttccaataattgtcatggcccttttgagagactgcaaaagctcttaaaccttgagcaaaaacaaatattttcattgttcaacttccctcctttctggttgcacattactcatgtccacctcagagcatgaattagtttatgccagaatggatcttttctgtattgccttcattttctgtgatttttttcatttttatctatattttgttgaatactttccagtttctatcctcaaaagtatttacaaaatctcttatgtaaatattcatatccttaaaatacaagtgtaacctttatgttaatttttaggaattataatggtttttcatatctaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagagtaagtatctaaattaattgaattctgattgttcaaggggaaaaatatgggttcctaagagtttttcacttatggtcaggtgtggtggtttgcatttatagtccccagctactcagggaggctgaagcagaaggatcacttgaacccaggagttcgagaccagcatatgcaatatagcaaggttcttgtctctaaaaaagaaaaaactttttaatttaaaagagagtttttcacttgatttagaataaagtaaccttagaaatattgtttagaaccatgttttgatgagaaatattataatagagtttggtgatatgattgtattttttccccacattctgaagaaagataacactgaccagtgattaatggaaaatggtatacattatatgcatgtgtcagtgtgcatttaatatatgctgatccatttagtagttaacctcagcagggatttggaggtcataaagagtagttagacccaatagtcaggcttcaacccttgtcattttttcttcttcctcatcatcttcaagcaatatatttccatttgttcatcttttgttacacataaatggaagctggaagtagggatgattggaggaggtggggaggtttaggatcaggtgagagctcatagagttagaaatttctacctcaaacagaccacaagttacatcactgtagagtccttaggtctaactaacaccaggaggcaactgtgaacccagcccccttctagacactctatacctgtggacagtggtaattaaatttgagctgaaatctgactacaggaatgagatgagggtagtggctcaagaatataacagtaatatagaaagaggattcctgcatttctgagcccttccacttggaactaaaatctcaagtttaaacagagtacagtagtaaaatccaaatggcaggagaaaagaatattatatattgtatcatcctcatattcctctttttctgtcctattttatatatggtggtaggaaataagagaagctggaaatggaaaggagatggtggtgtgccgaaaacgccaaaattaccctggagtgttatggccagttgttttcttgttaactcaggagcagtcattcaagcctatgtggtacaaagatgccattgcctctttttttttttttttttttttttttttgagatggagttttgttgcccaggctggagtgcaatggtgcgatcttggcttggcgccaccttggctcaccacaacctccgtctcctgggttcaagcaattctcctgcctcagcctcccgagtagctgggattacaggcgtgcgccaccacacctgactaatttttttgtatttttagtagagacagggtttctccatgttggtcaggctggtcttgaactcctgacctcaggtgatccgcctgccttggcttcccaaagtgctgggattacaggcatgagccaccacgcccagccagatgccattgcattttacctctcttctgctcttctcccattccatatttgggttgtttccctgataattgtattctgaaagtggtacctactcgtttcccttttcataggtttccacttcctgactcccagtctaggaatttttttttttgaggtgaaattcatagaacataaaattagccatttaaaaatgaacaattcagtggcatttagtacattcataacgttgtgcaactaccacctctaattccaaaagatttcattatcccaaaatgaaactccaaactcatcaagcaattactccttattctgtctccccccagcccctggaaaataccagtctactttctatttctatggattttacctattctggatttttcatataagtgtaatcatataatatgggatctcttgtgtcttgcttcttaggattacttttaattactggtggtgtttattatttgatagtaaaatatcaaaatagaattcttaaatgttttatatttaaaatgctgatagtgtttattgtttcagatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaaggttagaattttcaagtaatgtttgattgcagtgtacatttatatataactacatttataatatttttaagttaaggaagcgatacagtgatataacacattagtgtagacatattgaggtgaaattcatataacatgttatttaggacatagtagatacaaattttctattacttaaagagaacaagaggagttactcactataagtaattaatagttgtgtaatcttaggaattaagcaaagaaaagtattggagaatgatcattaatccttggcctgattttctctaaatgagttatgcttaagcctttggagttaactcacatttcaaatgatcatgaggctcttgttttctttaagtgttttgggcccaggaacttatatcaggcttctgaatatgcctggggcccagaaagtagggtaaggaacagaagacaatattatttgtgtttgtgggttgatttagtgagaatgatacttattctttaaaatttgatttcccattccttcttcattctctatcctttctccaaattccagagtgagtaagcagtgcattactacaagggttgtagcaaagtggagtagtgtctagttaagtttgaaaagaggaagtgggtaaagtatattcctgttcatgagacaatatggcaaggtggtctgtggaggctaaagatcataatccgatgctcactctgattctaactacacgtatgtgtgggtagtaaaagatgactacaggattcttgtgcttccttttagctccaaaattttgtaattactcctacctcttcttcaaggtccatgtgatacactatttctaaacgttgatgaagaatcacgatgatgagagtgagcttttatgatctgttctctggatttgttatagtttatttaaacatcctccaagctagaattaagaatcttttccctcagtgccatttctgctaccattaagctactgcagacaccctcatttctccctcagattactgcggcattctcctaacaggcatcttcatgtctactttttcactcctcttacccgtttatagagaccggagtgatctttttaaaataccaaatgaaatgccagcttcttacttgaagctttttattggctttgcatgataccatgaaacctgacacacccatagtgtctgtagactttctgtgacctggctccacctgcctctccaattccatcgctagatctcttctgtttcttactatgctgcactcacaccagcattcttttggtttctagaacatcttaaattattttctcttcagggcattcatatgaggtatgtcctttgtctagaatgttctttccttctttgcctgagtagtttccagtttaaatatcaccctctcagctaggcacggtggcttacgcctgtattcccagcacttcgggaggccgaggtgggtggattgcttcaggtcaggagttcaagaccaggctgaccaacaaggtgaaaccccatctctactaaaagtacaaaaattagccaggcttggtggcatgcacctgtagtcccaggtacttgaatgctgaggcaggagaattgcttgaacctgggaggcagaggttgcagtgagccaagatcaggccactgcactctagcctgggcgacagagtgagactctgtctgaaaaataaaaataaaaataaaaataaatatcaccctctctgagagttctgcactgtcccctctaatctaaactaggtccctaattcataatattctatgcctttccttcagtatatctgtagatttatctatccgtctgtctatctgtatatctgcctatctgtgtgcagacttgtatgctcctcgacttacgatgggattatgtctcaataaacccgttgtttaagtggaaaatgtatttaatacacctaacctacagaacattatagcttagccttgcctgccttgaacatgcccaggatacttaccttagcctacaggtgggcaaaatcatctaacacaaagcctgttttatgctacagtactgaatatctcatgtaatttattgaatactatactgaaaatgaaaaacaatagttgtatgaatatattgtaaagtcaaaaaatggtaagttgaaccattgtaagttgggaactgtctatatatacattatttatatacatgtacgagataaggaactacatctcttcacttgtcccaacatcaaccatagttcctggcttgtgttaagtactcaatgaataaacattggctgggtggaaggaatgaatgatatattcctggaatgcaatgtataatattaagggatataaactttttaagataaagcaaagacaaaaaaaagtttatcttattagaaacaagatacagtgtcacttatagtcttcaaacattattgcactttgtcataatttgacaaagcattcatgaaacaatctgtagactagtttcaacagacaacacctgtaagcaggcatgaccgtcctaaattgtttactaggtatgaattttacaaacattatttatagtaatggtaatggtggagctggagagtattgcaccttctctgagctgcacaatgagaaccactattctgtgggatgtttcttcactttgttgattgtttcctttgctttgcagaagctttttaacttgatgtgtccatttgtccatttttactttggttacctgtgattgtggggtattctcaagaaatctttgcccagcttaatgtcctagagaatcctcaatgttttcttacggtagtttcatagtttgaggtcttagatgtaagtttttaatccattttgatctgatttttgtatatggcaagataaaggagtctagtttcattcttttgtatatggatatccagttttcccagcactgtttattgaagagactgtcctttctcccaatgtatgttcttggttcctttgtcaaaaatgaattcactagatgtatggattcatttttgggttctctattctgttccagtgatctacatatctcttttgatgccagtactgtgccattttggctactatagctctgtagtataacttgaaggcaggtaatgtgatttcttcagttttgtactttttgctcaggatagctttggctattctgggtcttttttgattccatataaattgtaggattttttttttctatttctctgaagaatgtcatggtattctatagattgctttgggtaatatggacattttagcaatattgattcttctaatccataaacataaaatatctttcaatttttctggtgtcctcttcagtgtctttcatcactgttctgtagttttcattgtagggatctttcacgtctttggttaatttttaaaatttctttctcagattgttcactgttgtcaaatagaaatgctactgaattttgtatgttgatttttgtatcctgcagctttactgaatttatcagttctaatagttctttggtagagcgttcaggcttttccaaatataagatcgtatcacctgcaaatagataatttgacttcttcctttcaagttcggatgtcttttatttctttctcttttctgattcctccagctagttctttcagtactttgttgaataacagtggtgaaagtaggcatccttgttgtgtttcagaccttacaggaagggctttctgtttttcccttttcagtacaatactagctgtggtctgttgtatatggctttcattgtgttgaggaatattccttctatacctacttctttgagagtttttatcaaatgctttttcaatcaattgaaatgatcatatggtattgtctttcattctattgatatggtgtatcacattgattaatttgtgtatgttgaaccatccttgcatccctgggataaatcccacttggtcatgatgaataatcttttaaatgtgttgttgaatttggtttgctggtattttgttgaggatttttgcatcaatattcatcagtgatattggcctgcaattttttttttaatgtgtctttgtctggttgtggtatcagggtaatactggccttgtagaatgaatttggaaatattccttcctactctgtttctcagaatagtttgaataggattcgtattagttctttacatgtttggtagaatttagcagtgaagccatcagatttcacgctttcttttgctgagagactttttgttatggctttgatctcattgcttgttattggtctgttcaggttttgaatttcttcttggttcaatcttcatagattctatgtgtctaggaatttatccatttcctttagattttccagtttaccggcatgtagttgctcagagtagccactaagaatcctttgaatttctgtggtatcagttgtaatgtctcctttttcatctctaattttatttatttgtgtcttcggtctttttttcttagtcttggttaaggtttgtcaagtttatctatcatttcagaaaaccaactttttgttttgttgatgttttgtatttttaaaatttcaatttcattcatttgtgctctgatctttattttcttctactaattttgggtttgatttgctcttgcttttctagttctttaagaaacatcattaggttgtttatttggagtttttcttcttttttgatgtagacactaacagctataaaatttgctcttaggactactttcactatattccataggtttgggtacgttgtgtcttcattatcatttgtttcaataaatttttcaatttccttcttaatttcttcattgacccactggtcattcaggagcatattctttaattttcatgtgtttgtgttgtttctaaaattattcttgttactgatttctagttttattccgttgtaccagaaagaggcttcagattcacttgtttaaagtgttttcagatttgttttgagtcctaacatatggtctatcctctagaatgatccatgtgctgaggaaaagaatgtgtatgctactgccattggatgaaatattctgtaaatatctgttagatccatttgttatgtagtgcagattaaatctgatgtttctttgttgatctgctggaaggtctgtccaatatggaaaatgaggtgttgaagtctccagctgttactgtattggggtctgtctctgtctttagctctaataatatttgctttatatatttgggtgcagtgctgggtgtgcatatctatatatatacacacacacacatccacacacaattgctgtatcctcttgctgaattgacctctttatcattgcatattggctttgtctcttcctagtttttgtcttgaaatatattttttctgatacaagtatagctactcctgctcttttttgctttccatttgcatggaatatctttttccatccctttattttcagtcggtttgtatcattacaggtgaagtgtgtctcatgtacacaacagatcattggggcttgtgtttttgttcattcagccactatgtatctttttattgaagagtttagcctatgtatattcagtgtgactattgataaagacttactcttccaattttgttattttctcgttgttttgtggtcttttcttctttctttccttctttcctgtcttccttttagtgaaggttattgtctctgatggtttgatttaatttcttactttttattttttgtttattcattataggtttttttggtttgaggttaccatgaggcttgcaagtactatcttataacccattattttaagctgataacactgcttgcataaacaaataaacaagcaaaaataaaactaataactctacactttaactttgttcccctgctttttaaccttttgttgtttttgtttataccttattgtactgcctgtgtcttgaaaagctgtgagtcatctttctgtctttctacttaagagtattttacatgtccacagttacacagtgttataatactatatttttctgtgtactttttataaccagtgagttgtgtacttttagatgatttcttcttactcattaatgtcctttttctgattgaagtactccctttagcatttcatgcaggacatgtctggtgttgatgaaatccctcagctttcatttgtctgggaaattatttctctttcatgtttaaaggatagtttcaccagatatgtactattttcaggtaaaagtttttttccataagcactttaaatatgtcataccactgtatcctggcctgtgtggtttccactgaatagtctgctgccagacatattggagcttcattgtatgttatttgtttcttttctcttgttgcttttaggatcctttatctttgacctttgtgagtttaattattaaaaagccttgaggtaattgtctttgggttacatttgtttgatgttctataaccttcttgtactggatactgttatttttatctaggtttggggagttctctgttgttatccctttgaataaactttctacctctatctctttctctgcctctttgaagaccaataacttttagaattgcccttttaaaactattttccagattttataggtgtgcttcattcttttttcttttgtctcctctgactgtatttttttcagatagcctgtcttcacgcttactaattctttcttctgcttgatcagttctgctattaagagacttatggggctgggaaccgtggtttatgcctgtaatcccaacactttaggaggctgaagtgggcagatcacttgagcccaggagtttgagaccagtctaggcaacatggcgaagccccatctctacaaaaattagccaggtatagtggcttgtgcctgtggttccagctactaggaaagctgaggtgggaggattgcttgagcctgggaggtggaggttacagtgagctgtgatgtcacttcactccagcctgagtaacagagtgagatcctcaaaaaaaaaaagaaaacaactaannnnnnnnnnnnnnnnnnnnatcccggctcattgcaacctccgcctcccagttcaagcaattctctctgcctcagcctcctgagtagcttggattccaggcacctgccaccatgtctggctgattttttgtatttttagtagagacagggttttgtcatgttggccaggctggtctcaaaactcctgatctcagatgatccacccacctcggcctcccaaagtgctgggattacaggcgtgagccaccacgcctggcctgcatttttcaactgtggaattttgtttgatttttttttattattttaatccttttaaaaatttatctgatggaattctgaatttcttctgtgttaccttgaatttatttgagtttcctcaaaacagctcttttgaattctctgtcagaaaggtcacatatatctctttctccaggattggtccctggtatttagttcgtttggtgaggtcgtgttttcctggatagtcttgatacttacagatgttcattgatgtctgggctttgagtaattaggtgtttattgtagtcttctcagtctgggcttgtttgtacccatccttcttgggaaggctttctaggtattcaaaaggacttgatgatacggtttggctatatccttaccagtcttgaattgtagctcccataattcccatgtgtcatgagagagacccagtgggaggtaattgaatcatgggggcaggtcttttcccgtgctgttcttgtgatagtgaatgagtctcatgagagccgatggttttataaaggggagttcccccacacaagctctctcttgcctgctgctgtgttgtaagacatgattttgctcctccttgccttccactatgattgtgaggcctctcagccacatggaactgagtccattaagcctgtttttctttataaattacacagtgttgggtatgtctttattagcagcttgagaatggactaatatacttgagtattgtgatccatgccgtatctgctttaggggacaccccaagtccagtaacggtgggttacttgcagactctgtagttcttgcagactcatagaggtatcaccttagtggtcttcaataacattcagaagaattctctggattaccccccaggttccaggcaggtccagagatactatcttggagccagggacatgagtcagaaaccttaggaatctacctggtgttcaattctactgcagctgagctggcactcaaactacaagacacagtgcttcccactcttccctccccttttcacaggcagaagagccttagcccgtggccatcaccaccacaggcccacggagagtactgccaagctactgctgatgttcacaagggccaagggctctctcatgagcttgtcttgaatgctgccaggccgggactcacccttcagggcagtgggcttccctctggcccagggcaggtacagaaatgccatcccagagccaaggcctggaataaggtctccaagagcccacttgttgctctacccttctgtggccaagctggtacctaaagtgcaagacaaaatccctttactttttcctctgcaagaagaaggagtccctccccatagccaccacagctgggaatgtactgagtctcacccgagtcccacagtgtactatctggatatcactctggctattcagggcccaggggctctttagtcagcaaataagggatcctgtgaggactgggccattcccttcaaggcagtgggttcccttctggcctaggatgtgtctagaaatcagagctagggcctggaaaggaggcctcacacctctgcctggtgccctgtcctgctgtggctgagctggttttagagatgcaagacaaagtcctctttattcttccctctcctttccttaagtatgagaagggagtctgttttggagctacaagctatgcttgggggaggggtgatgccagcactcccttagccactctagctggtgtctcagtaggttgtgtatcctccacgtccactgcctccaagcccagcacagctaggccttgcctaggagttgcagtccttgtggcctagactgactttcaggtttatttagggccccagaacattttagtccatgctggtgtggcttgctggaactcaggttcctactgctaggatgggtgatgcctgtctggctgtggctcgtctgaatgcttcctctgtgggtgggcatcagctcagttcagctcagttttgctttctactgtgacaggatggcactgagttcaatgtaaagtctcacagttgctgcactgtccctctcccaagtacacagattttctctctgcagcatagggccgctgatgggagacgggggagggatggcgttgggatttaagactgtctttcctaccccttcaatgtccctttcagtgatatcaagttaaaaccagctactgtgagtgctcacctgtttctcggttcttatgaaggtgttttttttgtgtgtagatagttgttaaatttggtgttcctgcatgggggatgattggtggagctctctttttggccctcttgttcctgcatattatccatttttaagaactttttaatgtattgccaaacggtgttccacaaaggttcgtacagttatgagtgcacagtttaactattgcctggatattatttagttgtaatttgataggaggaatcattgtctttgattcctaaaggagttaaacattttttttttcactgccttaagaaccgtttgtatctcttcttgtataaaatataacacaggcttccaaatagatacactgtttctccacagaatgtgtaagttattgctgtcatatggtactttgtagtttagaagtacggcacttatgtttctctcagcttctctctgtagtggcagttcaaatataatagatgaagaaaagtgaggttcagagagattaaataagtggcggagctgagactagaacctaggttctatgacttatgttttttttgtttagagattataaatgtttacttctcaactttctgaagtttagaaacaaagctctgggtaattgttttccttagtaatgctaaatgctttatagatcttttagaaattcgattgtaatttctatagcgcactgatagaaacatttttcatctttatggctatatggctatatagtttttctttatgatgaccacttaaaagcagttgaatactttcacatgagacatttcaaggttatgtattttattagaattttcagtggccaaaaagtagcgtcttttttgctttatattgtaacttcattcaggattcaaagttttgatagtaaaatttcagtaagtatttgttgtcttccacagtgtataatgaggaagtattttatttaactactttttaaatattgtccaactggaaaccagaaatatcactgatgtctcaatgtaaaatatttaactattttttaaaaattaggctaaatgatgttcagggaatgggcttaaagaaaagataataatgttgtttgttgcaagtaggaaaatgattaacaggatcttactggaaatagtgtgaaatattgcaagagacaaagcttacaaagagagaggagttctgaagtcgggtaaaactaatatttttatgaatattgattatttccatttttaaattgatgtgaataatttataggtacagttcttaaaatatgcctaaggtcctctattgaatgtattattttgctctcccatttattcaagcccaggcagcattatatagttttccccctttgtttaagaaagctttctagataactgccaagaatttcatttctttttttcagaacttgtattgtctaaaagatttgagaaattttaatgtgttatcataatctttaattaaaatacaatttttaatttttgtagttggcttggacgccttttctggctgcattcagtgtgggtctacaagattgtgatgatactgaagtagcctctctttgcctggaaggtataagatgtgcaatcagaattgcatgcattttcagcattcaggtaacagagaattttgtctttgtagccagtttggaacattaattacctatgccattacaatagtttaaattacaataattgtttatgtgtgacattaaaaactaatttcaagtttatgatggaatttaaatgaatcttaatgtttaagcttctgagaagctgttatagaaggggtagttctatactgatctgtctaagtttatcattataactttggttacagttttttttctctattgaagactatacagaaagttttcaagactttgaattcctatgttaatttgaacatcttgtttaaacgaataaaatatcttgttgaatcatagtttatatacaaggttgtatatattttatatgatttcataacttaagcctaagaacaggttatctttaagacatgtaaatattgaatacataattttcatgaaagaagtcctttctagtaatttatatgctttgaggaacttttaaaaaaagaaaaattcattcaacatttaattataaatgctaatggcttgcaaaaagtatagcgtagctgtggagaaaatgagcaaatgtataaatcatgtttttgctaatctagtaatcaaaacaaaagtgcttaatgaattttttttttttactgtgtgaattcattggttatcactaaaaatctcaatttgacaccaccactgcctttggattttagaaatgtatgtcgtttctgcttcatgcatcatcttaaaatgaatgaaaataaaaaacttgtggaattatatgtaattcatgacaagtaaaacttactaaacttacaagttactgaacttacgagtttaggagtggaggtttaataggcaaaagaaagggaaaggagggccaggcatggtggctcaagcctgtaatcccagcactttgggaggtcgaggcgggcagatcacgagatcaggagttcgagaccagcctggccaacatggtgaaaccccgtctctactaaagatacaaaaaattagcttggcatggtagtgggcgcctgtaatcccagctactcgggaggctgaggcagaagaatcatgtgaacctgggaggcggaggtcgcagtgagccgagattgcgccattgaaccccagcctgggcgacagggtgagactctgtctcaaaaattaataaataaattaaaaaaaaaaaaaacaaaatcttactgaacaagtaaacagagtttgttggtggggaattaatcagtctgctctatttagaactgtgtaaacatacttttctcttttttatagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgaggtataagcactttattttcaactttgcaatttggtttataaaatgagctaatgctaaatagtccatcattgacatgcctaaatgttaggggagaaaattagtacatttcgaataagtacgtttagctttttaaaataatctatagtgtagtctgtgtttaagtcctggctgcatatatttaaatctttttgaagatatttttaacatggaatttaacatttttttcctttttgtaattaagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctaggtgagaatttttacaaagtatcaaaaattgtttttaacttcctcattataagtcactttattgtagtaatgaaatataattagaaggagaagataaaatgccttttgtctaaccttatgagaaaaagcaagatgactaaggaactaaatcttttttgcctggtctggtttgcaacattaaatgacccttagtttcaggcttctctctggttgttggagaaggatacagtgtgtagagtttttaaattacttgcttttaaaaataagcaggtaacttgaatgtgtgaaagctggtatcaggtaatagttggggcaactggagaaagcattcacatttaattgttaaagcaatgagcaggcctaaccagcctttctgccagtatgaaacctctccccatggctccccatgcgctcaatatgaccaggaacttccacatttaaaccagtagaacaaaagaaaacattagcaaaaatgggtagagaagaatgaaaagcaatacattttttagtcataaatggaaggagttccaccagggaagaaacagagcttattagactttgaccttaagtatttctgggtttgaattcttctgtattttttccttattatgtgtaagttactttagttcgccgagattcaatttctgcttttgcaaacaaagtaatatctaatcataggattgttaggattaaataagaatatatatgactggacttagcataatggctggtatattcgaagtttctagatattctctgtccatccctccccaaccccccacctccaaccaatctggacgcattacttagagcaggaatcttctatcttttagtgattcctctgttgctgctagcagtgaaaattcttagaaaccccaaaagaatttcaaactttataaaggatccataggaaaagaattaaaaaccaggaccatgatatggcttcaagttggactggggaaaactaattcccagtggtaatcaactgaagcagctagcaatgcagtctgtccctccatgatagcatagatgctatagtattgtaaggtctgggaggtgcaggtgtagacttgataccttggtgatctagcagtaagatttagaactacctgagcacctgcacaatgattagaagcccaactttatacattagaactgtaattactccatggggtaacatgagatgcagatgaaaactattttcaggcaagggaagtgaatgtgcactgattggctcagtaactttgaaaaggcctagagagtgtgggaatgccaaaataatgacaggtgttaattgctgggcctgagttttggcaagtaggactacagaattaggttacactaaaaataaaacaccagtgggatatcttctagaagttttagtcaaacgagaaataatgatacttgctgataatatttactggtatacttgaaaatgaattaaaattaattcatgtactgtgctacttaggttgcaaggatatgagatgaactgtcttctcccttcagaaaaagggaatttacagaaagatacacacattgaggcctagaaatgaaaaacagttcaggcttccagaccattctcaagaccagtaacacttattttatgccttatttaggttttctctgttatgtacttctctttttggtctgcaccattctctgctcagtcctgactccatgctccattttgaatccacatcctagaaggagctagtctgtggacttggcccctgttgggcagagccctccgttgggccgtcccgttggataaccagccaacccatgtggcaaatggctacccttgtccccctgtgcctaccaaggtcagacagcagatgctttctggagcagaatgttgtcatcagaatttaagctagaagaagatgtggtacagtcaagccagtttagtctgcatatacagtggatacatatatatatatatatatatatatatatatatatatatatatcagggtgagctcacaatctctcgtagtcatatgtgagatatctcatctcttaacaacgtctcactctattctcctcgcctgagtccccgtcttgtcttctacccgcgctattcctctctgactcgtgtcacgtaaccccgcgcctctgccgtttccgcactgtgactaatggtctttgccccccctggacctttctccccactactaccacgtgcgcttgctgcgtcagccacgttgccccacgtgcagtctgaactttcgaccgcacctccagcatccgccatctcgacccgaagtgctgcgccctcagttcgacttccgccccacattccgcccatgctgctccaaactccagtcctccccggctcaccccggggggtagctnnnnnnnnnnnnnnnnnnnntaaaaaaaaaaaaagatatatatatatatatatatatttttttttttttttttaactaatatcttttttttttttttttttttttgagtcacagtctcactctgtcacccaggctggagtgcggtggtgcgatctcaactcactgcaacctctgcttcctgggttcaagtgattcccctgcctcagccttttgagtagctgggattacaggggtgtgccaccacacctagctaattttttttgttgtttgtttgtttgtttgtttgttttagtagagacagggtttcaccatgttggccaggttgatcttgaactcctgacctcatgtgatctgcccgccttggcgtcccaaagtgctgggattacaggtgtgagctactgcgcccgcccatatcctcttttattaatggtatctctgccgtgagtattccatgtaaccaagttgaccgggttgagtatatatttatcatactttctgactgatagaaaaaaagtctgtactttcactttttggaaatacgaaactttcagttattaagaatacatagtagataattattagatttgaattatatgcattcttttttttctatttttttaaagacaaggtctcactctgttgttgaggctggagtgcagtggcatggtcataggtcactgcagtcttgaactcttgggctcaacttttttttaaattaaagttactaaagtaaaagcctgtcccaggctttcactatgtttttttcctatttcagtatgttgcccgggctggtttcaaactccgggcttcaggtgatcctctcacctcggcctcccaaaatgctaggactagaggcacgagccatggcacctggactgcatgctggtctttcaagagataccttaacatttaaaaattcaatggctttgtcacataaatgttcagagagtattcatgacacatagtttaaaaaatcttatttaacctaaatatgccctctctattgtgattgcttttctttctgctttcttttctacataaccatccttctaggtctaggttgaattagtatttcatcatacgtgaagcctttcttgagctaacacccctattctcttgtgttgtgtgcttttgagtaaatttgtttgacaaaactggaactctcattaagggatttcacatatttgtgaaatgggttctttggattccaagacattttttatattctttgattcctttaaatattttattattaatgattttaaattatatttaaatataaaggacatattttgacacgtgtgtgtgtgtgtatatatatacacacacacacacacatatatatatatatacacacatacacatattttttccccacagaacatatatatatttcctctgtggaaaggatatcctgttgatacacaaaggaagttatcttatgattggcattgtttttttctcataggtttttctttgtaaaattcctgtaacatgctgtgcgtgtcaagtttgccttgacactatttccctaccaccccaatactgtgtcacttacttcaggctttcattcttgttcacttgtattatagcagtagacttttagtttatctctctgatttcaatattttttcctatttcagtatgttctccagatattatcagtgttgtcttttggaaaatagattagatcatatcaatcttctaaaagacctaacggatccctgttttcgaaagtagtacattaaacctaagggtcaaggctcttcacattcttttttctagtctgtcttttcagctttatctcctactgctgttcttttcccttcttcctggtgtctgccaatccttcattatggctatactaccaagtatgtgaaaacatgatgtacagttgtatgtttccattactttatatagctgcccctctgtctcaattgcttttctttctccttccttttctacatagttacccttctaggtccaggttgaattaatatttcatcatatgtgaagcctttctatgagctaacaccctgttcttgtccctattgaaattagttctatttagcaaacttttattctatgtagttagttcatttcagccatgaagtagtcattacattgcattgaagttcattataaacatatctgtctctcctggtgtaaattattaactctgtgaggacaggggttacatctttttcacatcattcagttcctagaatagaatttgagttcagcaggtttaaatgatatcatctgttatgtttgcattcagaagggcatttattgagtgtttggtcactcaggtcaagtgtttgtagagcacctgctttggacttaattttgagtaaggtaggaaagtacaaaaatgaatattacttgattcctaaccttaggaaactttatctggttgtgaaggcaacattaacacacctgaaataatttatatgcaactgtatgaacgtaattctgatttgagtagtacttagctaagtaaatgcttagttcaaaggcagatgagaacaatggagaggaacttttcattgagaacccaaattgagtcttggtaggtaagttttagatagttgagggatggcacattttggctagactgttgaagggaagtgctttaaatgctagggtaaagagtttatattttatcttgtaagtaacagtaagcagaatgaaggagacgatttaggaaataatctggcagggggatgaaagagagattgaagagggaaataattaatggcagggaaatcactcatgaaatggtttcagtaatctaggactgagattatgagggccagaactaggtaggaatggaaatgaacaggtgatatgaaaaacagatcagaagaaaaatttagtgactagttgaatattgatagtggaagaggggaaggatatcaaaggtgattctgaagttaagaatttgaagactgggaatattgttattctcctctccaacatgtggaaccagtttcaagggaaaagatgaatgattcttttcaataaaagggtgttagaaaatacaggtagaattttcaactgacctttgtaaataggggactagagattaaatgacaagggaagtctaaatttttggagttgggatcatcctcagaaggtatcattggaactgagattagtgctgcatttctttaaacattaagggaaattatatctaatatctataattttgtgatataaattcacagtgcccctactttgtgtgatctttacaaacatagtttgtgacttataaccatgtgttgtatactacttagtaaagttcatttgcacatttggccttgttcatgtcactgatatcaaaagaattgttcacctgaagcattctgttattaggaaagcagttgatttcagaagtatgttttagaacttgttaagtgtattcttctactgaattattttcaaactgaaatgacttttttttatgtgtggtagttggaggaaatgtggactggaaacagatagcaagtattcaggaatccattggagaaaccagttctcagagtgttgttgttgctgtagataggtaaggtattcattttattcccttttcagatgattactatttcagttctttagcatttaggtgttggtaaaaagaaaaatattattgccaaaatcatttttctaaagtaatataaaattatattgtgatatgctgtgatttagatgatgaagtacctataattttgctttttggatcatagaatataagaagatgataaacagtatgaaaatttaagttacaatagatactaatgggcattaaggaaatggtaacctcgatggaaaagaatacaaatgttttattttctcgtagaaaacttattccccttattatccctatttgaaaatgttgtgtagtttatttttctgggtccacaatatagactgcattatggatgaaatgaaaggttttattggcaattcccattataaacttttttggaaaggacttcagaatttatatattatacacatcaccacatattccccatttttagtttgttttctaaaagaaaacccatggtatgctttatttactacagaatatttccaattttaaaatgtccagcacatagaacaatgtctcctattgttacttgaagtttagctttttctagataaatgcccccaaaagtgaaacattttacaataatgttttttctttttcttcctcccaccccctacttgtgatggaaactttcaaaaacataatttgtacaaatctttccttgatagtctggaaactcatgctgatccattattttactttgcttcagataaaactttttgctctaagtacaggtagaactagaatgttcagtggccactgaccctggaagtactccatggaactttttccttgaattcttaatgtctacttgctgttgttttttgtgttttgtttttttttaagaggagagtcatttgcctatttttttgtgaagactgaagaaagattatctcatacctactgtataacaaacatgaaggcttgccacagatgaggcacttgcaaaacgctttacatttaatcctttcagtagcctcatgagatgggtattcttgtcctcaatttacaatgaggaaactgagacagaaaaagattaaataacttgctcattcccacaactaggcttgtgtaataagcatgcatacttaacctctccacctttcagcctgcatgtactactgcagagctatgtaatagcccttctgctaccgggctagctttcttgtcaatgattttcttgccttccagaaaaatcatcttcactgtcattttgagaatctattcaggcatgatttaacattttacctactgtttctgcttttataatgtactttatatgaccacatccagttctaatttatcttcctatccactgtttgttacagagggacatgttactcatttgaaattacctctctgttttaagaatttatgctatttcagaggagatttagcataaattttgttagtactgtgtcatcacaatcttgtcatcgccagatacttctaaaaacataaatccaatatcaaattttatacaaaacctcagtattgcaagtttttgcttatagtgaaaacaccgaaagttatatatttgatctcttataatgttgtattattcttaagtggtacatttcactttcccattaaatgttttttgaatatctgagtttattttcatatcgttatgttcaaactttggtccattacccaactcagtggtagtcaagacagtagtgaaaatagtgtcaggcatcaatctggggagttctgtacttacccagcagacagtcattttcctgtccttaggcctatttttctgcataacctgttattacaagtacaggaactaaagaaaaaaatttttgtatgtttagttctttatagcttctggtttattaaccaacagagaagagaataagattttattacagactttaaggtgataaaattttctaattatctacttttgtattaggaatcttgtattattagaatataggagaagaatattgggcccttcaatctgggaataactgatcctctagcatttgctaggatagaattttttatgtgttgttaaattagaccaatttcataatgaatattactaaactatgcaggagatagactttatccatgaatggtttatttttaatagctaaaaaacaattatttagcatcatagtttttctctttatggtttttttatacataccagatctagctataaactggctcacctcagactttggaatatttcacctatcagaaaatacatacagcttatcccaacttcctttgctcataaatacttttcatttaggcctaagaaataaatgttacctctgatatattcattgtgaaaaaaccttttacaggtataataatataggctgcttgtgtattgcatacagtttaaaaattgatttgatccagaatctgcaaaagttttgcaaaccattttttgtttttgcatctgtattataatgtgattaagcagtaatcttaccaatgtttttttctaatgctttttaaaaagcacatgatttttaatattcacaaacaaggttcttgtgcttctgtcctttgcttttctatggaaaatgtagaaaccatttcataggctgattttatgaaacacagctctgttctcttgccttaatgttaaggcttgactttaaatgcccccacagactgctgtgctctaccatacggcttatctttagtggagcattactagaaatagagtgaccccctcagagactatggcagtgagtaggaattgggatgccctttctcagaatggatgctcccccaaccttccaccatcacaacagtccacaggacctgtcttattgctgatgatagttctctctcctgttgcctttgttctccgttatgtcaacaccttcagaatctattgcttcccttccctgtggttctatctctgcttttgttctttctttacccctctactgtttgccatttgctttcttctcagttaaaaactctttttttctttgtttttgtttgtgtgccttttcttgttctcctatactatttacttttgactgtattcatggtgtggcttgtttacagccattgccttccatgagaatacctctagtttgagaaatcagctgaccaaattcgtagtctggcagttttcatttttgttttgcgagagctctgtagacgttgtatatctttaatttctgggtccagtctaatccctggattaagaggggccatattacttttgatttttccctcagattgtgttttctgccagattttggaattactgcttcattctgctgacgaacgatatagaaaatcttaagacatttctttagcaggacttcacattctgagtcatcatgttacccgtttctaaactgtttttcctatattgttttttactcattgtcaggacacatagacatgcaaggacactagggttaaaaaatcatgatatactcagaacatttagattgtgatagtaggaaaaaagggttgaatataccttttgctcaggtaagtgtgaggcagtatagaaaagtggttaataggatagactgtaatcaccctgtcctggtttgaatcttggctctagcacttactagttctgtgacttagaggaagttattaaatatctttgtgcctcagtttctgtgtttataaaattggggatttaatagtacatgcttcataaggaatttgtgattatcaaatgagtgaatattgatattacactagaaaagaacccatcttgtgattggtagctattactgttactgctatgactactgtgacctgctcctgcctttaaagttttcctttttatcatgcaaatcctattttgtgcattctaagttgaggaatgtcatccttcttgaaagtgacgtcaaactcttggttgcaaacccagaatatgggttaaaatgcagactttaaaaaaggaggactaatgtgtttatgctgaaattttttatgaaactttgaaacaaaaaaagagctcagcaaagaagaatgggcaaagctgggcagtgttagcttaactccaaacatttgaatgccctaaggaaagtggtttggccaattcttgggtaaactgagactatttgcaaggttatattaagtcacttttagtgtaaatgaactttctaatcaaatatactttactggtaaaaatacgtcaaatttttcattttaagaacttgcttaatgctagacaataatcaggaaagaatctgtagtgtgccaattattagttttacaaattaatatttttcttattcttagaatctcatatctatccggggtttgtaaatctgataaaattacagcagtatatacttaccctaataataatattgaatgtaaactggttcacatggagtagaggtggaggggagggagaaacatccagactacacttgttactaaactaaatgatgaaaaatactcatttgaatacccaattttttgttcccttaaaacataaaaatagctagtaccccatgccacatacttttcaattggaataagaacagtaacttataaattttttaaattgtgttttattttccctagaatattcacaggatctacaaggctagatggaaatgccattggtaagtatgggcatttattctacttcggaactggcttggggctaaaataactttaatgttgagctaaaaaaaaaatgtatttatattacagtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggtatttgaataactatggtgtttgtttacatttgtagtatattttttgtttagaatgtccttgtaatcaaattgagcctttttcccttccaagcaattatttattactttttaatattaaattagaaaaccctgtgaatggtgtttttctttttagaaatgattgctctgggctttaagaatttgatttaaaatatctgtttttcttgttgagaaatagttttagcatacttaatgcctttatggaaaatcttaggatttacctatctatgctattctatactttttctaaaacaaaaaataaagaattgtagatttttactgctgatattaattagcatcgtttatttctgtcgccattacaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtactatatttgttgaattgcttaatagaaggaaaatcttgttgttttccacagcagggagaaaaacagaagaaagggggaaaaactgatgagttttatcggtttgcatatccaagcaattatattaatatttttaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcagtgagtattctcttagctgtgttcaagtaaaaggaaaaaaaaaaagcaaccttaacgtgttcagaagatgattcaagtaacaataagattatggcctttaagtttaccaagctttgtctacagaaccagagtaaataaaaacaattaaattactattatagttaacatttattgagtatttaccatatggcaaatactgtgtgcacttttcacgtaatttctttaatcttcacagttaaacattattgtccatcccttttttcaaaatagattaggaaactcagccccagaaaggttaagcagtctatgtaaggtcacagaactagtgatggagatggtcttgagacccatggagtattaaagcaaagcctttatttttgaccagtaagtacattgcacagccttcttcaaggaggagtccccttaagttcaagggggactgactgaaatactaagattataagttaagcctatatggaagatgacaatgatgaccatcaacatcaagaatcatggcatcatcatagctatcatttattgcgtgcttgcttaagtattacactaagcacttcacttatattattttacgtagtgcttacagctatctgtgtatattattattatttccattttatatcaagaaaccgagatacagagaggttaagtaattttgtatattcattcaaccaaagttgaatcagtacctaccgtgtaccagtcactgtattaggtgctatgtttataatgtaaacaaaacagacaagttttactattctcaccactcagggcagtcagttaagtggtaaagatagtcttgaacttcgtatctgttggatgtcagaacctgtaacaacctttaagaggaagtgcattacatctagatgttggtgtatttttggtacagctaagaataattgaaaaattatagtaatatatatttttctctattttagcccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggtatagcgtcatttagtaaacaaaattttgcagagtattctttccaatttgaaatcttaagtttgtttgggaattgagggtatatgaagcatttatttttcagtaatttgaaaaataatctgagcagcctgattccaagttaggatggttagtgattataactaaccattattgaaagtgtcaggtatttttctgagtgtttttcattaacttgtattaacttgtttaatcttctaatggctttatggggtagatagtgttatagccccatacagacaaagaaactgaggcacagagaaattttaaaatgtgcccatagtttcagggctagtaaagtagaactagggtttgagccccagcctgtgtttctaaccattccctacagtgcatcttgtctgtctgtgctgtgtaatactgaagctgactgactatggatgagaataggcttaagctctaaagtaaaaggttgaattgaaaatctagctgccatatttaacttgtatatttgaatctatctttgtaactgtcataagagaaagtgatgtatcgtagatttggtaataagattttattccgtactaccatggaccgatcaggtgcttggtactttttagatacgtcaactcatttcaccttcatacttcaccagtgtggttaatgtggctgtctggtatcataaccatttaagtgataaaaatggaaacctgaattaacctggctaataatgcagaaagctggtgacagttgaaagtgaagctaacttttggattctagtccagagctctttataggcagttatgttttgcctatttcagtggcacatatactaaaattgtaggcagttatagtgtccattttttataaattattttttattaaattgctcactggttatttgtgaagcatttaaattattttttgagaagttagtatactgaatgtatgggtgttatgttttgcctttaataaccctaccttttttcttgaaggctttcaaggaatacacaagcgatgatatgaacgtagcacctgaagacagggtgtgggtgagaggatggttcccaattctctttgagttatcctgtatcatcaatagatgcaaattagatgtaagaaccaggtaacaatctatatttgtaattaaaattttggatttattttgactttaatcaaattaactcttctttataaacacaatctcacagttaaagaccataaaatcaagtgttttgtcaaatatattaattattaggtatattttaaaatatgttaatatgatttaaaaatattaactagagcaaaataaaaatggaaatactacattatttttaaaatatttgattatagcctccatttgattttagcttctaagttaatttaatcctttaaacattccgtcttttcatatatttgtttccaataataagttgaagttagtggcaaaatttattttatttcctgatgaatgatagaagaatttttaactgcacatccttgctgggttttaggtgaagaaccatttctttttgtaacctggtcagtaacatagtttggaataatatagagctattcaaatagaactctttcaaaagtatattgccaataaaagatcattatgaacatatagtcaatctgtaaaggaactattatgggtattatgtaactggccaaatgctaacacactgttcttaggtcacggctcacatgattcccatagtagtttttttaccctgtactttgccacattgaaatggccagcttgtgtgtcctaatatctgtcaacctctaaacccaccgtgagttcaattttatggtaaacaaaatcttttaggaatctttccatcttatttggaagaatcttctgttatttggatgtgtaactttatcgaattttttgaatttctaaaggtagcacagaatgaatctctcttttctcaccttatgccagaaccacccccatcccccaccaaggttaaatttgacttatatcccaagaaatttttcatttttatagtattatttgttacaacagaaattcgtatgaaatagataatcaaaataggacttaacccttagggattttaattatgagagcactatagaaaaacattttattttatatttagacatggtggattgtttatcagtggacctgttaggaacttgttaaaattcaagatagccccatttcagctgtccacctgcctcagtggagcggctgacatatcatgactagcaggtcatgaaaactcagcaccctctcccctcaccctttatttatttgtagaagtctgtttgatggaggatccacctgctttcttagccttctgttgcttggcactgtgataccttatttctcaccatattccatgttcagattatgggtagattccagttgttaaagaggttgtgtgtgttctagttagtaaaggagagagaaaagatcagtaaactttgttcagtgatggcctttgattttcctacctcatcccaggatatgtatgggttgctatttagcttccatcttaaaatgtgggccggatgccatggctcacatctgtaatcccagcactttgggatgtcaaggtgggaggattgtttgaaaccaacctaggcaacatagtgagaccccatctctttgaacaaaaagttaactaggcatggtggtcatgcctctagttcctgctgctcatgaggctgaggcgggattgcctaagcacaggaggttggggctatggtgagccctgatcacaccactgtactccagcctaggcaacaaattgagactctctgtctttaacaacaacaaatagtgcagcactataattggtataacactgtgtagaaagaatttcttgtgtgcattcttacttaattcttccaaaattctctagatttggggataaataccgaaaattaaagtcccaaatatagtcaggcatcatttaatgacaggagtatgttctctgcaatgcattagtaggcaatttcagcattgtgtgaacatcatagcatgtacttacacaaatctagatggcatagcctattgctccttgggtacaacctgcacagcatgttactgtactgtaggcagctgttaatacggtggtgtttgtgtatctaaacatatctaaacaggctgggtgcagtggctcacgcctgtaatctcagcattttgggaggccaaggtgggcagatcacctgatgtcaggagtttgagaccagcctggccaacctggtgaaaccccatctctactaaaaatacaaaaatttggccaggcatggtggccatacctataatcccagcactttgggaggcccaggtgggcggatcatctgaggtcaggagttcaagaccatcctggacaacgtggtgaaaccccttctctactaaaaatacaaaaattagcgaggcgtggtggtgcgcacctgtaatcgcagctacttaggaggctgaggcaggagaatcgcttgaacctgggaggtagaggttgcagtgagctgagagtgccactctactccagcccaggcaacagagtgagactctgtctcaaaataaaaataaaaattaaaaaatacaaatacaaaaattagccgggtgtggtggtgcacacctgtaatcccagctacttgggaaggtgaggcatgagaattgtttgaacccaggaggcggaggttgcagtgagccaagatggcaccactgcactccagccagggtgacagtataagactctgtctcaaaaaaaaaaaaaatacatacatacatacatacatacatacatacatacatacatatacatatatatatatgtgtgtgtatatatatatatatatatatatgtgtatatatatatatatgcatggaaaaggtacagtaaaaacatggcataaaagataaaacctgtaggctgggcatgcatggtggctcacgcctgtaatcccagcactttgggaggccaaggtgggcggatcacgaggaaaggagatcgagaccatcctggctaacacagtgaaaccccgtctctactaaaaataccaaaaattagccgggcgtggtggtgggcacctgtagtcccagctacttgggaggctgaggcaggaaaatggcttgaacctgggaggtggagcttgcagtgagcagagatcatgccactgcactccagcctgggcgacagagcaagactccatctcaaaaaaaaaagaaagaaaaaaaaaagcaacaacaaaaacccatatagggcacttaccatgactggaactcgccggactggaaattgttctgggtgactcagtgagtgagtggtgagtgaatgcaaaggcaaacactgtaaacttaggctactttaaatttatgagaagatatttttctgcagtaaaaaattaaccatagcctactgtaacttttttgctttataatttttaaaattttaaaaaacttgactcttatattaacacttagcttaaaacacattgtacagctatataaaagtattttctttatatccttattctataagcttttttctatttctatttttattttttactttttagacttttttgttaaaaactaagacatagacacacacattaacctaggcctacacagggtcaggatcatcagtgtcactgtcttccatccccacatcttacgccattggaaggtcttcagggggaagtaacacatatggagctgtcatctcctatgataacaatgacttcttcctgaatacctactgaaggacctgcttgaggctgttttccaattaactttttaaaaatttgtaagtataaggagtacactagcaaataatgatgagaggtgcagtatagtaaatacattaattgttaacataattgtttatcattatacgactggcagtgcagtaggtttgtttacaccagtatcaccataaacatgtgagtaaagtgttgccctacaatcagtgaaagcctcaactacaatgtcacaagacaattggaactttatagctctattataatcttaggggaccactgtcttatatgcagttcattgttgactgaaatgtccttacgtggcacatgactgtattatttttccctataccaactacttaagtatggctttaaaaaaaaaaaaaaaagaaaaggaaaaaaagacattttccacagtaaaaatccttggaaacgattgatctttgtgtttactttgggccctggaaaaaacaggattgcccatatccacttactcccagccatgagaggcagcatccagttacttggagtggaagggaatagatacggagctcagcagatggaggacgagggagccttgttccattgcaaggagggaactatgggtttagcatcagtggtggaactctgacaggcgtctcctgtggaagactttctttcccgggagtttctttactatggtttctttaccactgctagtattacacattaggtatcttagggatcaaatagaccaatgtggacttactgttggcctgaagtattgtaatgttattttacccaatcctttaacaaaatcttgttgagaacctactgtgtatgagccatctactacgtttggggatagcatagcagcaaatgagttgagctctgttccagtccttatgagagcctttcaaagaaaattttgttctgttttactctcaaacttttggaaatataagccatttctaaactggaggatgcctgtattttcccagaaaaagcaacaaatagagaaaagattaaaagtgtctaatggttacataaaagtattatttcaagaaacagtaaggaatgaagacggaagttttgagtttcagttttaacacttactcaaaagctagtccatctgatactaagcaatttattcagcaaatatttattgcttgcctcccaggcaataagcactgctgtgtgcctgggatatagcaagaaataaacacagacccctcccctcatggagcttatgccttagtggcttttttttgtaaatccttttgtttagggatgttgcatgaataaggcttctagtattgggtaaaaatccccatttgaaaaagattttccaaaatctaacttttgttttgttcttagactgctgtatatgtattttcttttttggctacagtgccacaaaattaatattcactcaaacggttatccttttcaatttgtaattccatttacagttttttaaatgctgcattggtgaggtaagagtaaaggaaaagtaaaataaaaaagtttacagccaagacctttggagattttttttcccgaatgatgtatcctaaaggaacctgttgttcttacaacttaaattttttaaaacccagtgtcatgtgttaatttcagactagttttaagctttctgtttttaactgctttgtgaactctaaaaactattttaggagaagtatgcttttttgtattacagctttctaattgtgttttgtcattttaggggtttaacagtaatgtttgaaataatgaaaacatatggccacacttatgagaaacactggtggcaggatttatttagaattgttttcagaatctttgacaatatgaaattgccagaacaacagacagaggtaagaggatacacaattttcatttagcttagtcaagttaaaagattctcagtattataatcaatacattttagtgtttcaaattaagtacagaaaagaattcctagaaaatttttctttaaggcatgagaatgtaatactatgtctttataaataagaacactggctgggcgcagtggctcacgcctgtaatcccagcactttgggaggccaaggcgggtggatcatctcaggtcaggggtttgagaccagcctggccaacatggtgaaaccccatctctactaaaaatacaaaaattatccgggtgtggtggcaggtacctgtagtcccagctacttgggaggctgaggcaggagaattgtttgaacccgggaggtggaggttgctgtgagctgagatcgcgccactgcactgcagcctgggcgacgagcaaaactccatctcaaaaaaaaagaacactgtgtgggggatagaactgaattgatgaattgatttttttgttctgttttgttttcagtgtttttctgactttttcgtttcttttcctcattttgatagttacaactataaaacatcagtaactttctttagtattatatagtgacttcttttttatattgagtaaagaatacaaagtaaattttatttatttcaacatattttactatgaaccagttacaatatacattttaggaaatgtgtcaagagagcttcatattttccccttttgttccatacagcagtattaaatgcagacttctgcaattattttttatgggcttgaaaaaaataaattacacttacgttgtatagccctttttttatggtgttttcagataaccatacttcaggaaagtcatttttattttaaacctatgctaatcccatttggacaaattcttacctctttatttccctttcatgttctgtcatattctagagcaaggccggcgttgctattcatgcacttcgaaaaatcataatgttagtatcaagatgatacggtgatggttttttttaataatcaaaacaagcagtgccaaaaatggttaaattattgtatacataggtggttatgggataataaggagcaatagatatcagattttaagttgaggtgaatataacgttctagagggaattcaggggtctaaaaggacactgacagccttcatttttatatgaaacattatatataattatataacacaatcgcttaatatattaacgaaggggtggtattgcgcgtcgtcccccgacgttatccacaagcgtatagatatattattgcccgtgtctctagcaccgggaggaaaaatataatagaggcgcgtggtgttttgataaacaccccccccctgggggctagatttgctgttagaaccgctctgttatatagactaggagaaaaggagagttccttcggtgggggtgaaaaaaccccccctgnnnnnnnnnnnnnnnnnnnncttccatttttaatatgaaaacatttatatatatatatatatatatatatatttttttttttttttttaatcatagtagttgattaatggcgtgatgttcattaatgacttttttccccagaaagctgaatggatgacaacaacttgcaatcatgcactttatgcaatctgtgatgtattcactcagtatttagaagtactcagtgatgtacttttggatgacatttttgctcagctctactggtgtgtgcagcaaggtaggtctgtaccagatatgtgacacaaagtgttaaatgtgaccctggtaatatataaatgaattgctcttttctttcctagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgtaagaagattttatacaactttacatttatatttgtatattgaatgagttggagagtgactagtgattaaaagtttgatagtgactactgatttctcataacagaaatccttttaagcttgtcttactcttacatggatttagatttattacaaaccaaactgctataaactataacaaatacataaattaaactatttataaaccaaaacctttagtctggttaccaaaatttgggacataatgaagtgattctgctgacttttataagattttatttattcagatcaaaccaagcagtggttttgaattggaaaaaaaaaaatctcagcctgtttctgttactgatcttttaataatctaaggaaaatgtatttacacatactatatttcgtatttcgtaacagcttgtcatctttctctaagggatgagtgtgaaatggaattatagtgaggtaggtttttttttttttttttgagatggagtttcgttcatgtttaccaggctggagtgcattggcgcaatctcggctcaccacaacctccgcctcttgggttcaagtgattatcctgccttagcctcccaagtagctaggattacaggcatgcaccaccatgcctggctaattttgtatttttagttgagatggggtttctccacgttggtcaggctggtctcaaactcccaacctcgggtgatccgcccaccttggcctcccaaagtgctgggattacaggcgtgagccaccgcgcctggccaattttatgatttttttttttttttgagaagcctcttactttggaaaatatttgatattaatacttagggaaaggaggtctgaaatctttaaaacttatcagaaagtgttcttttaatgcaaaactggtgaccatattacccttttaattatattaaatgccacttaatttttttctaaaagtacatattttaaactttttactagatgttttttaggaaattgctaaaattagcagtggtcaaagatggactgtttagttggtatgttcttgttactttcttgggcccatttcaaaatatgctggatgtggcatgtggcacagccccctagtgattgacgtggttttggtatcttaaaggctgttgacctggcgacccaattctggagaaactgcccccccacctccatctcctgtaagtgaaaagccattggtaagttttaatcagtaaagtatattgaaattagttatttgtgatgagtaattttattatgggtcaaattcttacatgtaattgtcttaatccattcctgctattaaaaaaatatctgagactggattacttataaatagacattttttttttacaattacgaaggctgggaattgtatgatcaagtgtctggtgagagctgctctctgcttccaagatggcaccacgttgctgcattctcacgtggtggaaggaggagggacagaaaggggcctagctagttccctccagtccttttttaaggcactaattctcatggcctactcacctcctaaaatctctacctcttgatactgttgcattggggattaagttttattatgaatttaggagggaatgcaaacattcatatcattgcaatgcgtttgactcttttaagaagatggtataaatttactgtccagaattgtgaagttaattctttggtcaatgtcacagacaattaatatgtgtctttgttaagtgccatgaagggagtattttaaattatttttaaatataggacatagaacaaaatgattttttaagggttgtgagagaaaggtaccagattacgtagctgtctccatgcaaagctgaagatattgttggatagtatttaaactttttatttttatataatttcaccttatagaaaagtaacacaaaacagtacaaagaattctaacattcacttcacccagtgtattggtttcctagttctaccataaaaaattaccacaaacttggtggcttaaaactatagaaacctactatctcatggttctaaagaccatgggtcctaaatcaaggagttagcagggccacattccctccaaaggctctaagggagaatccttactagcttcgtccagcttctggcggctgttgacaacctttggcattatttggcttgttcacatatcactccaatctctgccaccatctatccatagtctccctcactgtgtgtgaattaaatctctccctctcctttttgttttatgaagacattagtcattggatttagggtttacctgaaatccaggatgatctcatctcaagatcgttaattacatctgaaaagaccttatttccaagtaaggtaacatttgcaggtatcaggggtcaggacttgaacatactttttaggggacaatattcatgccactatggtctacccactgacacctaaaaattcatgtccatcccatcggcaaaagatggtcaccccattctaaggtccccaaaagtctaaactcattacagcatcaacactatgtccaaaatcccttataaatataatcaaaagtccctaatctgatcatccgcatctgcattaaggatggatgacactcttgagtatgctctattctggggcagaattcgtctccatctgtggacctgtgaacctagaaaacaggtttgtaacttttaaaatacagtagtgggacaagcataagatatacgatctcattgcaaaaaggagaaattggaaggaacaaaggatcaccagtcctaagcaaggttgaaacttagcagggacaattccgttgagttttaaggcctgagaataatgctgtgtggcttgatattctgccctctggggctatggctggcttcttcgggcctgagccctacactctcagttgttcttctttttcttaaaggttagcacgtttgtagctctgttgacccattttctgcctgtagaatcctagaattcagcctcccttcctcttattgtttctgtccctttcattctaggctggccatatgtctgctggtatatcattctcaaaatccttgtgggtcttctgtatgtgttaagagaaaccatgccattaaacaagagtgtgatccacacatctttctggatagtcctgttatgttcctggcttctgctgagatgatcgattggctccactagatatatacctaatctctttggcaaaaagttgtccagctattatagccttggccttctctccaaagcatgctttcctaacaattcatttcctaattgtagcatcgttttcaatctcgataggcacaagatcctctcacatcatcaactggcagtttctttttgcttaacagttctttcatcaatatatcttcttcttgcattgtactataaacagcaaggataaaccaggccacaccttcagcactttgcttggaaatctcaactacatatcatcacttagaattctgctttccacccaacaattcagccaagctttctgccactttacaacaaggatcacctatcagtatctaatatcatgttcttgatttccttctaagacctcaccagaagcaccttttaacattcatatttgtaccaataatctgtttcatggccatacatgtcttctctaagatggtagatgctttctctcacacattgcacttccttgtggatcctcaccagaactacatttgacatccatatttctaccaacagtctcttcagggcaatgtaggtgtttccctatcatgtgtctcagaactcttccagcttctaccattgcccagttccaaagccacttctacatttttaggtgtttgttacagccacattccatttcatggtatcaaaatctttatcagggccagcaaaacaaaaccagcaggagagatttgtatagatagatttaaggaactggcttacgtgattgtggaggctggcaggtttgaaattttgtagggcaggcaggcaggctggaaagccttgggctgctgctgaagctgcagttcacaggcgggatttcttccccaggaaaacctgttttgctcagttttgaaggctttcaactgattggataaggaccatctagattattgaagataatttccttaaaaagtgagctgactatagatgttaaccacatgtataaaataccttcagctgaacacctggaatagtgtttaattgaattaattgttactccttcgacttaagtatctggcttaagtacataggatattggtattgtgtcctagccaaattgacacaaaagtaatcattacaccaggtttctccaaatgttgtcattttacatttgtttttaccaaccccagctgtcctccctctttttatcttgctaccctgcctcccacacacacaattttctgaattctttggaagtaatttgtaaacacaatgcccacttatccctaacaatcaaaaaattatccttgaaacaatactcttatttaatctacaggtcttttcaaatttgtactgttctcccaataatacctttgaattttaaagccaggaggctgtaaagtagcaaactaacgccaactgaccagatttgttccccacaacttttaactttcttaacaaattgtcaacggttaaaacttagatttcacagaaaagtatcattctgaattgcccttgagaactgtgacatctatgctgggcccgtgttgctccatgactctgttgtgctgacgtccattcagaatagaacccactattacttaggacatcccaaaaattatcctcatttacattggttagtgagaaaaattgagaaaacaatatacctaacatccaaaaattcctctaatacagagcaaggtttttaaatccctaattttttgacctagtttttgtgtaggtttagttttctggagagaacattttagaaatcatcagactgttcaagagggcccgtgaccaaaaatatttaaaaaccagtgctttcatttatcttcagtaagataatacatttttaattctgagaactgagtaatttcttccttaaaatacacttaagtccaagctaacgtattgttttgattattactatttctggtaacacaggcccatcttcctttcacacagcaggtaaggttgctcaggctgggactgttacgtcagaataacaaaagctaagcactcctcctgaaaccaggttctctcatgtcttgagtgtgctgtgcctttataatgaaagaaagctcgaggaggagtagggtcagctgccatttattgcccaacactgtgctgctagtgttttggatttattatatctagttcttaacaacctgcaaggaaagtatatcatttctttttagatcagaaaacctcacctcaggaaattaatcatttttccaaggttacactcttaataatactggaacctgtggctgggcgtggtggctcacgcctgtaatcccagcactttgggaggccgaggcaggcagatcacctgaggtcgggagttggagaccagcatgaccaacacggtgaaaaccccctctctactaaaaatacaaaatgagccgggcatggtggtgcatgcctataatcccagctgctggggaggctgaggcaggagaatcgcttgaacccaggaggtagaggtcacggtgagccgagatcgcgccattgcactccagcctgggcaacaagagcaaaactccatctcaaaaaagtaaataaataaataatactggagcctaattcttgtgtaggtctgttggactccagggtccagcatctcttcatgatacgacactcctagatagtcaccttcacattgacctttctagtccctgggtccatgggtgacagaagatccttttctaaattcacccctgcaaaaggtgtctgtttagatttcatgaacacttgtgggtattgctgaccagtttctctacactttgaagtttcgcatttttatctgttgctgttggatggtttcagacctgagcccagtgagggtcagaaagtcaacttttctctatgtacaggtaattttaaataattttctgattgtgttataactgtaatgtgtaaaacatcattttcatagggacataatataattttttaaaatagcgttttagaaaatattttcacccataaactttattaaccatacttacagtgattttttttttatttattaggatacaatatcacagaagtctgtagatattcatgattctattcaaccaaggtctgtggataacagaccacaagcaccactggtttctgcgtctgctgttaatgaagaagtcagcaaaattaaatctacagcaagtgagttatttctctaaataaaaataaatttgtgttttatgtaggaaagggttaacatttttggttttacttttattattaacaagcatatactataattgattgtgtcatcacttcttttttttttttttttttttgagacggagtttcactctgtcgcccagtctggagtacagtggcacgccatcgtagctcactgcaacctccgcctcccgggttcaagcaattcttctgcctcagcctcccgggtagctgggactacaagtgtgtaccaccatgcccggctaatttttgtatttttagtcgagacggggtttcaccatattggccaggctggtcttgaactcctgaccttgtgatctgcccgcctcagcctcccaaagtgctgggattacagtgtgagccactatgcccggccacttttgttttttttttttttgagacggagtctcaccctgtcgcctacgctggagtgcagtgatgctcactgcaacctccacctcccaggttcaaatgattctcctgcctcagcctcccgagtagctgggattacaggtgcccaccatcacctccagctgatttttgtagttttagtagagacagggtttcaccatgttggccaggctggtctcaaactcctgaccttatgatccgcccgcctcagcctcccaaagtgctgggattacaggcgtgagccactgcgcctggccatgtcatcacttctttactgtgtttatcctaatttggacatcctctggtagatagatgccctcttgcagaaggtcaagaactctgctgatcctgaaatgtcagctttttccgccaacgagcacctgagtcttctttctccacccccttctgcatgccaaccaaccccatgttctgtctgcaaaagtagggcctagcatgccttcctctacccatctgcaacgggaagtagtgaaggaccgttgctttctaagcaggagcaccccacttgtttttgttgttgtttttggttttggttttttttgagacagagtctcactctgtcacccaggctggagtgtgatctcggctcactgcagcctcaacctccaggctcaagcgatcttcccaccttagcctcccgagtagctgggactacaggcacacctcatcacgcccagctaattttttatatttttttgtagggacagggttttgccatgttgcccaggctgatcttgaactcctgagctcaggccatccacccacctcagcttcccaacatgcttggattacaggcttgtgccacgacgtctgtccaggagcaccctattgtttttcttttttttttttttttttttgagacggagtcttgctctgtcacccaggctggagtatagtggtgtgatcttggctcacggcaagctccacctcccgggttcacgccattctcctgcctcagcctcccgagtagctgggactacaggtgcctgccaccatacccaattaattttttttttattctttagtagagaccgggtttcaccacggtagtcagggtggtctcgatctcctgacctcgtgatccacccggcttggcctcccaaagtgctgggattacaggcatgagccaccgtgcccggcaggagcaccctactttttaaggagcaacccttttctccacactgcaccccaaccttagtcggcctgtgcccatttccctcactgctgcccacacccctgtctccatacagggatccacaggtcacctgtattcctcccctcaccttttcacaaaaaagaggaaccctttacttttttactggatcaattcagttccatttgctgaaggaaaattacaacacctagaaaagaccacagcctccttagaggagaacaggacagctttgagaactttttaaaacctgaggtgaaatttacataacagaaataacaatatgcaagtgaataataattcagtggcatttagtacattcacagccaccacctctatctagatccaaagcattttcatcactcctaaagggagccccccagccccataactgttatacagccacttcttcttctcctcttccccagcccctggcagccactaattagctgtgtttgtgaattgcctattctgcatatttcatataaatggaatcatacaaaatacaaccttttgtgtctgtcttctctcacagtgttttcaagacgcatcatgttgtagcataatcagtaattcattcctttttattactaatagtccactgaatgtatagaccacattttgtttatccatttgtctgatgatggacgtttgtatttgtttcacctgtagttgtcatgaatagttctgctacaaactgttgtgtacaaatatcatttgaatacctgttttcagttcttttgcattatctacctaggagtggaattgctagctcatagggtaattctatgtttaacttcttgaggaaccaccaagcaattttctatagccagtggctgcaccattttacattcccaccagcaattccagtttttccacatctttgccagcgccttttttgttgttgttaaatgataaccattctagtgggtgagaagtttacctcattgtggttttgactggcacttccataatgattagtgttgttaaccatcttttcatatgcttgttgaccatttgtatatcttatttggagaaatttgtgttcatgtcctttgcctgtttttaaattttgatgaagtccaatttttctgtttccttttgttagtcatgcctttggtgtcattgtcaaaatccaaggtcatgagcatttcccccaatgttgtcttctatgaagtgttttttttgttggtttttttttttttttttttgagatggagtctcactctgtcgctcaggctggagtgcagtggtgtgatctcggctcactgcaacttccacctcctgggttcaagcgattctcctgcctcagcctcctgagtggctgggattacaggcacatgccactacacctggctaatttttggatttttagtagagatggggtttcgccatgttggccaggctcgtctcaaactctgggcctcaagtgatccacctgcctggcctcccaaagtgctgggattaaaggcgtgagccactgtgcctggcctatgaagttttattcttctagctctttgatttaggtcgttgatccattttgatttaatttttttcagggaattttttaatcctagatgcttacagttcttcatatcctacttgaaaggaccttctatcttcagtcactgtattttgctaatttcttaaagaggaaataggtggtagtgagtggccgagtttcatttttcatttctgttctccaaagaacagaatggttcatgtaggaatcctttgcagcttcagtctgcaccaagaaaggccaagaggaaagaatagcgagtggcttttctcactctcagcctcaagactgaatttaaacacacttagctttgtgagggcaggacttggtcttcacatagtggaaagtgtgcacttggctactttttcctggggcaagggctctgctttcctgccactgtgagctgtggggtcagactgcatccttaagccagacattccactctcgctcccctggaagacttttaggcgaggttcatcctggaactgttgactcagaacaggtagagctggaggaagaacaagcggccaccctgctcccatgagccctcttccttggtggataggttgtggttctcctgtttgatggggaggccgctgcatctgactctccaactcagtgaaaagaatcacagcacagaccagcctcaattctttctgcaccactgctctgtcgagttgattcagtacctgtagtcccacatagttaaaatctgcttagctttgctctctgttgtgtggacaatgaaatggttgactaatataaccctggcagtgtcagaccttgtcatgactgaaatttgtccaaatagatattgtcatcaaatgtgcttctggtccttgctagtgagactgtagttaggatccctgtccaggtctcaaagggcacgagaaactatgaagaggcttggcatccctgttcagagtacagcctcatctgccaaattcttggggtcactagaactgtttgggtccctgctggaagctcttaacacccctgagcaactcacgttggaactgatgaaaataggtctcctaagacctccatctactgctaagtccattctggagtccaggtgctactaggagtcttttgcccctgggactgagatgtttttctgacttgaatgagggagtgaatggatgactgcccatgccgctgtcactgtaataaaggactaagaagacaagatttaagaggaagagataaccgtaggacttacaggtttctttgttttgtttttttaacttgtgatctagtactaagaactaaacgttaaatagaatagcatttatgaacagtatctggaaaggagccttcattaatgatctcaataagaataaatgaaagtaagttatttttctgccccccaaaatccctaaaacatgaatttgtcttccacacattagtgccagaaaagggaatttgtagtaaaatgtttttcatagtagaaagaaacagggattgtaagtcgcccagcattgaagccattgccccaagactgtctagtaggcagctccctttgggcagttgtctgcctcctggaaagcttcctgccaaagctgcccctgagaatctgagatggaggcgtggccgtgtggtctgggtcccctgggctgcgtggcagcagcatctcaggagttgagtcctcttttctaaccttgcgctgctgcattggcttagctacttagctggcatggtcagacaaggggagcacgcccgtgagtgtgtccacatgggccggcggactatcagaaacgccctgttgaacaaatgtgttcaggatagagggatgtgactgtgtatagctgatgaggggaacatgggtggcacttttgttactttgcagtttggttacttttgaagtaatgtgttcagcttaacttttttttttttttttttttttttaaagataaaatctggctctgttgcccaggctggagtgcagtggtgtcatctcagctcactgcaacctccgcctcccgggatcaagccattcttctgcctcagcctcccgagtagctgggactacaggcacacgccaccacacccggctaatttttgtatttttagtagagatggggtttcaccatgtgggccaacctggtctcgaactcctgacctcaggcaatccacctgccttggcctcccaaagtgctgggattacaggcatgagccattgcacccggccccggcttaactttttatagacttctttgctgatggatgtctttgaaaataagaggtaatttcagtcacaactacgaatctggatccaaataaaacatgtgctgtggccaaaccacagtattgcataggttaatccggagtcttggctgccctcacttcctgtctcacatggatctgttctgttattttcttatgtcataggttttcatataacctatttttttattttaattttatttatttatttatttatttatttatttatttttttgagacggagtctctctctcttgcccaggctggagtgcagtggtgtgatcttggttcactgtaacctctgcctcctgggttccagcaattctcttgcttcagcctccagagtagctgggattacaagtgtgcgcaaccatgcctggcacatttttttgtagctttgtaaagatggggtttcatcatgttgagcaggctggtcttgaactcctgacctcaggtgattcaactgcctcggcttcccagagtgctgggattacaggcatgagccaccgtgcccagcccctttattccctgttttcagaggtcagacttgggtttacagttgatacttcagttttaggtttttatccatttgttacatttttatccatttgttgaattaaaaaatttgtagcgggaacatcttgaatatattattgttctaaatcaggggtgtccagtcttttggcttccctgagccacattggaagaagaattgtcttggaccactcataaaatacactaacatgtatagtcccaggggacccagaccacatggccacacctccatcccagattctcagggcagctttggcaggaagctttccaggaggcagacaattgcccaaagggagctgcctactaggcagtcttggggcagtggctccaatgctgggcgacttacaatccctgtttctttctactatgaaaaatagtgagctaagaaaaaaaaaatctcataatgttttaagaaagtttatgaatttgtgttgggctgcattcaaagctgtcctgggccacatacaggctgtgggttggacaagcttgttctaaattatgtagggcacttttattttaaaaattacttttccgaggcttttctaaatatcagttaaacttttactgagtagtgcctgtgtgcaaaagcagtatgtccttctcagtgtgatatgtgaatacatattgatgtttccttagcattgtaatatcatggaaattataaaggattcaaaataattttttgtttgcatgtgcattggggggggtttcctcacagaatttccagaacaaaaattgtttgctgccctgttgattaaatgtgttgtgcagctggaactcatccagactatcgacaacattgtcttcttcccagccacaagtaagaaagaagatgcagaaaacttagctgcagcacaggtaaggagataggaggacagctgctttttttgtgtaagtaggaagttaggtatagcagtctgggctgtagagttaggctagagaattagtttgtggggccttcatcatacagatgtccttttaaaccatgagactggatcccatcacaaggtaataaggttagctagagcagggaggagggtcagcaactgattactagggacctcatcctctacagctcctggagatgaggcagctagcagagactgaagacgagaatccatgaggcatggggaggcacggggaagcaggtgtcagttgtcggggaagtcagatgaagaaaatgttttaagaagaagcatgtgatcagtcgcttgttaaatgctctggataggtcaagtgatattacacctgagaattgccctctaactgtttggacgactttggaaccttaacagtgtgttaaatgttaaattgaggacaaaagcataattataatggggagagagagagagaagagagaatgtggactcagccagtactctgttaagaagttttgctgtaaaggcacagagaaatgtgatagctggattgtgaggggttcaagagaggggtttgctatgttttgttctccagattggtgatatggcagcgtgttcactggtaagagctttccagtagggagagaaaaactgactgtaggcaagagaggggcaatttctagggccatgtttttgagtgagtggagatagtacctcatacagagtgggaatcacctggggtagaagcccagacagttcccatgtggcggcagggggagggctgggggatgggttgtggatgcaggaagtctggtacgtttggggtaggagcttgtgagagacctcctctgccagcttctggtttctcactgagatgggaagaaaagtcatctaccatgtgagatttggaagaatgttttagctacttgagaagtgaaaacttgagctggttggccaggagtgtggcctaggccaaggtctgccaagggctgggctagcaccgagcccgctggtttagagagaaaccagtctgctttctccagtcacacatgatgacatggccattttgccagccagttactaaaaagaagaggaggggttgtgaaagagaataattaaaatgatgcatggactccatagcagttgagaagagaagggaggacttgaggggctgaggaacgcagggccagggagttgggagtccaggagggtctggactaatgggaggtggtgcttggggacgaggatgcgtactggaaggtggaccttcccttactttctgttaggttagatcaagctgagtatctgtggctttcttgtaaaactggtctttggggagcattgagttgtaaatcaagtaaaattattgtgactgtgtgtatatgctggggtggtttgttttccaaagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggtaagctgcacacgcctcacatttaatgtttactgttgatggatgtgggacaggtacatacaggtctcagaactcattgactgtctgctataggtctgtgcatgtcactatatgtactctgaccttaacagtaataaagtaacctcacaacgaggcccttttctggtctacagtaagccagataactgcttgggtggattttttcccccttggtctattatttgacttacattgttctttcatcttgtttacccaacctggaccttcttgttgatactcattggcatgacaaaagctgtcttttcattaggaaataaatatgtgtaaaagtcgcacacacaaaacctggcatgtgtatttgaatggcttctctgtttactgggagtggccagagctcagagtgaaggtgaatttattgggatgtgaggtatatttgttctagaacaagttagacattttaaacaaaaaataagcttttattataaaccaaagtgacattgttaattttttaatttaaaaaatagagccagctgtggtgactcacacctgtagttccggctactcgggtggctgaggcaggatgattgcttggggccagaagttcgaaaccaccctggccaacatagcaagaccctgtctctacaagaaattaaaaattagcggggcatggtgtcgcatacctgtaatcccagctactcgggaggctgaagtgggaggatcacttgagcccaggagtttgaggctgcagtgagccatgatcacactactcccctccagcctgggcaacacagtgagaccccatctcttaaaaaaagaaaagaaaaaagaaagaaatataattatgagttgcaaaacagtgctgggaggatgaggggctgcagaataaggcagagaaaaagaaggggctgatacttatcaaactgtatcaaaagggtttggtgcttaatgtttgcttatttgaaacagctgtgccattctctttcctttacaacctaacttctggaaagagtagtctgtacttatttttcccctttttttctacccaagtttttgccaccattccactgggcctcttcctgctgagctgatagagcctccttgtgtccacacacaccggacccatcagacctctgacagagcagttctcacctcctgggggttgcccctgtttatctgaggcccctggcgcaggcagagcacatggccccttccacagctttggggattcaagtgcagtttcatgtgaagggttccaccttcccaggccacaagtttttttatatctcatatccccagcttgaatagggagggaattctggacatggaaatcaccttcacatcaggctgctgtggctccgttttgtaagcagcagatgctgatggctgagcacaaacaaaatgtgcctccatacgggctgtttcacctttacataagatgccttcccaaactaatcccagaaacttcccttttctgcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaagtaagacttttgactgatttccatctctgaccaggtagccacgtggtgccgggcaggaaagaggcaccggcgggaccatgctgacagctgaggctttggggcctggatgcccctattccacagagcagttgtaaaaattaaattcagtcttagagatgagtgtgctttagtgacatgtggccaaatcatgtctaacatgcaggacaaaggaggttttctgttttaaaactgtgaactatgatatcatttataggcctttttaatgtcataagatagtcccatttttacagatcatttgtataagtgaaaacttgcctgcctgcatttacttcgaaaaaaatatttggagtttttcttagcgttactttttttactcttttactttaagccaactaacgtgtaaactcaggctaagaatgaaacatgccattcagaaagaatacggtcatctgcattgtattatcatatctacttacggaatagatgttctgaggccaattaaatacattttagaattttaagggatcacctagtctctgttatcccatttgattgacaagactgattgattaaggccccacagggccttgtgatctagggcctcacaagggtcagtgaagagaggagtcgcctcagattccagtccaggtctcttgaaactaagctttgcatgtgccacctgccacacggcagctttgcattgaaagaaacttagaaaattaggaaaatgtgggtttcctggtaagttacaatggcttcttttaacatgtttggttttcttcccaatttgaaaagcatgtttatgttgacactccagctaatgtaaacagatgggatctaacatgttcttgaatagttcatattcactactatgttcatgattgctctttctcggtgaatatggggaccagtagatacgcaagtaacattaaaggaaaccttttcttttgcagtgtctgcagtgaagcactaagttacttcctcactctaacatcagaaagtcatcgagaagcctggactaacttactgcttttgtttctaactaaagttctaaagataagtgataatagggtaagtatgaggcttcgaatccagccccacatttctagcccaattcgcattgggatgcggggtcccagagccgccgtgcaagagctctcagagatgaatcaagcagtgcccaggctgcactgctgcttgtgcaaagccaccagtggccttgctgtatcttcctcagtccttgcttttctccccccttacccagctttgttcactaattagcagttctctaggggattcagtaggcgagggatcagaatcccttgggataccttgacaagttcccattatgaccccaggaatctccccctttgccccattttgaaaactgctgtccaaccacctcatggccttgtactctgcctactactcaagactacatctggttcctgggcctgtgctctgggctgcagctgttcctttggcatatttagtggttccaggtaacccagagtccctagtgaatgggcctcatctaagaattttaaaccagtagaaataaagataaaatacacatatatgactgtaaatataagtgcatatttaaggttttcaaaaatgtacactctattcttagaaaaaaaaatagcaacttacagctcacacatacaggctgctttgctgtgaccctagaataggtttaaaaatgcctagtgatgtggcccactacttgaaaggccaagggctctaaatcccagcctctgttactccacagctggcttttttttttttggtcataatatgtctcactgcttccctggatctggaggggtacagaaggggtaggaaaggaggctgcagactagagttcagagatgaaggaactactgtgaagatacagccaaagtatagcaattgaactgtacatgtgaaacgtatgtagctttgcctgaagaactgtttagattttatattgcagtgttgggtagaattttccccaaaacttaaaatttttatgtaacaaaagataaaatttcagtaacccatagcttataaaatctcaactctagtttgtactcacttgcctgctgcttattacccaggaaaaacagtgctaaattactaaaagtttgtcaaagatatacagacaaatgtttttcaaaataaggatatgtaagtgaatagtgtttgtatgaagtgagtttttctaacacttctgtctctcagttccacaaaccagagtcactgcctgctgtggaccctgctttcctggctcctgtgatggagccccagagtagtttgactctaggcagtttaaggctctgcagtttgcaatcactactaatggagaaattcattttccctgcagtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatcaaaacctgtataacccacccccatgtttcattgattctggtctattaaggctgaacaactatggaaaagacattttcagccagaactacaaattcaatattgtttggttctggtattttctttccagcttctagcattagatcctccttacactgtacttaccataggatacttatttttaaggcaatttttaaaatttttatttatcttttagagaccggatctcactctgttgtccaggctggagtgcagtggtatgagcacagctcactgtagcctcaaactgggctcacgattctcacactccaccctccccagtagtgaggactgtaggcacacaccactacacttgcctaattaaaaaaaaattttttttttttagagatgggatctcactatattgcccaggctggtctcaaactcttggacctgaagtgatcctcccaactcagcctcacaaagtgctgggattataggcatgagccaccatatccagcccaaaaatcttttaatattttttgcatattaataacctagcatcaggctacactacttgaatgctgaaaagagctaaagttctcttcagcacagtttgcaatattgtgtgttcgaggagtcagttgaagttgtgtggtacatggcattaaacaaaaagggaacgtgtcaatatcatctaacatggttgtgttaaagaggaaaagtattcagtctttgctttcacacctctcttagataatgaacagttactgaacaatgcatttgtaagtaagtgtgctgtatttgttacacccaagacagctctagctgtgttcaagcccagctggatgctagaactgcgagccactgtgaccttgccgtgtgagggtaagtgctccacacaacctggcagttgattattttaatgttgtagtatcaggactcttcccctagaagagtcagaggctttcttcttactttcagatgacaacagaacaaatttttacgagtaaagcaaacaaacaatggtccgattagaaaatcaaataaaaatttacaagtagccaaaactcaaaatatcagtaatttaattgtggcaaatttgtctgatattgtctaccaaccgttaattacatcagaggaagtattattagagagagaagcagtgcctggggatgttctcagctgtcatggttctgagattctaatctgagtcagaatgtcacaattatttgaatgactctttccttttttagaagtatcacttactgagtgattagaaaactcacatggactcacttatccaaggttccatggtggaagaagaagactccagtctctctgtccttgactcccgggtgtccccacctctattcaacctctagaaaactagtctagaaagctccatagtagttaaaaagattttagtaattaaaataaaaatttatttatatcaagaagtagttacatcatgtaattagtaacaagacaaatgccttcattggcataaaaatagaagcagaaagatgatgtaacaaacatttaacgtatggcttacaaaaatacaagtaattacagttcccttcatttctgctgtatcagtagctacaaatgacatgaaataataattaattaataggacatttgattgcatcacacagaaactggaataatcacagctacaatagatgtacctactaaatgaattcttttgcatcgaggtaacaatggaaaatgtgcatgtaacaaaggggagtccggttttacaggacgtttaagacacttattcaccttatcttaatgacaagcagaattcaatataatgcacatatagtagttcaatccagttcattaccaccctaatttatgacaaaactgtgcaaaaataatctatacaattctattatataaatcaataatcatggccttttatttatgtacataatatacatcatgataaaaataattttatatacagatgatggaaaaaaagtaactttcaggt

SEQ ID NO: 15380 - DNA, 24839 bp, Human
  misc_feature (1)...(24839): n = A,T,C or G
tcgtgccattgcactctagcctgggcgggtcaggagttcgagatcagcctggccaacatggagaaaccccatctctactaaaagtacaaaaattaaggctgggcgcggaggctcacgcctgtaagcccagcactttgggaggatgaggtgggtggctcatgagatcaggaattcaagaccagcctggccaagatggtgaaaccctgtctctactaaaaatacaaaaattagctgggtgtggtggcaggcacctgtaatcccagctacctgggaggctgaggcaggagaattgcttgaacctggctgcagtgagccgagatcgcaccactgcactccagcctgggcaacagagtgagaccccatctcaaaaaaaaaaaaaaaaagagttgaggtctccttccaccacttgtgtgaagaccccagaaaacttgctttacctctttaaacttcagttttcttatcttccaactgccatgaggtttttgtgaggaacaaatgagctgacatggatgtttctgtagttaacaaaataaagggtcttacaaaataggcaataataataataatcacttattattattacatgaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggtaagaaaccctgaagacaggggagtgctttgtggcaggctctgcatataagaattcagcctggccaacatggcgaaacccagtctctactaaaaatacgaaaattagccaggctttgtggcaggcacctgtaatcccagctatttgggaggctgaggcaggagaatcgcttgaacctgggaggcagaggttgcagtgagccgagatctcaccattgcactccagcccgggtgacaagagcaagactcgatctcaaaaaaaaaaaaagttcagttcagttggtaagaactcatcaaaagtgtccatctagactttgggtgccgtagaatgactcagagtctgaatcaacatgaaatcgagaaaacgtcctttgcaagggtttcagggaacacctgaaatcctgaagaactgtttgtatccatcctgaagaatgggtgttaataagagacagccttttcttggtacctgttttccatctctaacccaaccccaactcacacccttctattttatctggtctctctcattcctcttgctcctccccacttggctcccgttttccccaagtccattctctattttgttctataagatctgatcatattaggatgctcttgtagctcataagaagatgactgggtgttcacacgcatatgagatgtgcctccctcaaaccttgttaagacatgggcacatacccatctgatgttaactcacggggaaaaaaatctgatcatgccattcccgtgcccaaattcccatatatccctactgcctcaggatagaggctggaccccttagacacacaagaccctgtatccatgatctgtcactcccacaggcaccctctactcccatctacttggcagtttcccacaacctccctgggttctcgtggttccctgtcattgcaaacgtcgcttctcctaggatgtcctgcccccctagacttaacttggaaagctgttcttaagccccggactgagtcagatgcccctctgggtatccctgtcatagcgttgtgtggttgttgatagtctgatttttcaaccttctccatgccctcttgagggtagggaagatgagtatcttttttctccgtacagaccctaccgcacaagattttcctaaacagaccgaactcaaggagtctttctggttgttagtccacgtgtcccgatttggggtttccaaaatacacgcccactggaaccgggccaggggagccagcctggccaagggctcccccagcccggccaagggctcccccagcccgggagcgcgccacatgcagatcctgggatggccgccaggggccgccgggctctttgttttcctttctcacccgggtcggggccagaggcctgcagagcgcatgctctggggcagttcgcggcccggcggggagcgccggagttccttgtggccgacgtgcaccaaggtaggtctcgcctgggacgcgcggagggtccgggcagagggcggtaagcggagcgggccacagccggagcacgggccggtccacgcgggcctaagtcgctgcccgctctcgcccgtgtcgcgcggcgccggccccacgtgaagcccggaggcaggaaggcgcggtgcgggctcgcgattccccggccccgcggggcgctccagcggcggctggcgccgcctcgctcggagctagggccgcgcggccctgcgcgcgcgctctcacggcgccgcgcacgcgccgcagcgacgattcaaactgcgcgagcgcgcgggccgggttgcgcgcggccgcccgggcgggggatgggtctctgccgcgaggaggatggttttgtccggcatgcgcttggagaaggcggtttgcagatcggggagggagcccttgcccgggaagagggtgggtcgtaggagctcgagggtctcccgctgtgcacctttgggagccgtgtgtcttgaactaccgcagcagctcagtctgtcagcagattatttgctggccatttattgcgtccctctcttgcggggctgggggacagtagtgagaagagcaggcccgtgtcattagcgaactatgcccttgaacccaggcgacggacgctactggcaagtcattcatacgtcacatattgacctaacttcgaccacgtgtgacttgtgtgccctagcagaagttgagtgtgtggggtgttacggggagccctcagggggatcccccaccctgcccaggaggctcagggatggctttccaggtgaagtgactcttgaatggggttttgaaggaacagagtttttcaggcagtctgagggtagtgggattagggtgatacaggcagagggattgcacgtgcaacggcatgaaggtataggtattgtggtcagggataccacaggtcttgaggtgactggaggaggagagtaacaagatgatacagcaggggctgggtcacgaagcgtcttgtgtgcaagactaaggaactctgcggggtggaggaggcagggaagatttcccccaagaagggtatcagagtgaaacctggacagatgaattaggagttcacgaggctcctgtttcaaagacatcccaagagcaggaatcctgttctgttcatcgttacaactttctcatcagatgcccttgggcaacccacccagtcccccagagcattggtttccttatctgtaaagcaatggtagggggcatgtggtgaggatataatttttttttttttgagacggagtttccactcttattacccaggctggagtgcagtggcgcgatctcagctcactgcaacctccacctcctaggttcaagcaattctgcctcagcctgctgagcagctgagactacaggaacacaccaccaggcccagctaatttttgtatttttttttttttagtagagacggggtttcaccatgttggccaggctggtcttgaactcctgacctcaggtgatccacctgcctcagcctcccaaagtgctggaattacaggtgtgagccaccgcacccggccaattttttttttttttctgatacagaatcttggtctatcgcccaggctgtagtatagtgtcgtgctctcagtcgctgcagcctccacctcccgggttcaagcgattctcctgtctcagcctcccgaatagtaatatcctataattttcataaagcagtgaagttgtgtgtcccttcccccaggaaaaatgaacacataggcccaggcacaggttgtatagaacggggatcccaggtgagaaactcctagtgtgaaatataccacctgtgtgcctggcataacagcagctcaccaaatgtatattgttgacacatgagccctctcctcccttccctcctggggaccttacacacagagatttttcagccttagtctggcaggcaagttcttcctcctggtgtgggggacggagggcacagctgcagtggcctgggagggctctgtctccttttacagaaatcgaggctgtggtgaggtcactggaggtcagggcaggagcaccaggctccgggcagactgtctagactggcgtgcctacccactttcttcaataaataaggaaggtgaggtgggggtagggcagctccagctctggtggagcatggtcatgagactgggatttcattccacctctctgtgacctgggtcacctttccctgagcctcatcttccccttagctgtaaaactgggatgagtctgctcacctcaaagggcagctgtgggcattcaggagtgcctgatggtggaagctgactctgtagccgacttatctgtgactgtctcactcttctcccagagactgtatgctccttgaagatggaagctgtgttgtgtggggcggggtggggaagcatgatgccaaaagccaactccttattcccagcccagacactcactgcctggttaagaaaacagccagagaggccgggctcggtggctcacgactgtaaccccagcaatttgggaggccaaggtgggcagatcacctgaggtcaggagttcaagaccagcctggccgacatggtgaaaccccgtctttactaaaaataccaagcagcttagccaggcgtggtggcttgtcgcctgtagtcccagcactagggaggctgaggcgggagaatcgcttgaacctgggaggcggaggttgcagtgagctgagatcgtgagtctgaactccagcttgggcaacagagtgaggctccatctcaaaaagaagaaaagaaaagcaaataaaggaaaacacacccagagcagtgagagaagtctgtatacaagacccatttgtgcagtagaggctgtgcaggcaggtaccgggaacagggctccaccttttagaaggtggtcctctggccgggagcagtggctcacgcctgtaatcccagcactttgggaggccgaggtgggtggatcatgaggtcaggagatcgagaccatcctggctaacacggtgaaaccccgtctctactaaaaatacaaaaaattagctgggtgtggtggcaggcgcctgtagtcccagctactcgggaggctgaggcaggagaatggcgtgaacctgggaggcggagcttgcagtgagccgatatcgcgccattgcctccagactgggcgacagagcgagactccacctcagaaaaaaaaaaaaaaaaaaaaaaagaaggtggccctccatcccctgcccttccctggcgattgccagcccagtgcagggcctcaagtcttccattttggagaggaagcctctgggactcaaagagcactcaggtgccgtctccaccgcagcagggagttgtcgccactgtccttccccacatctgtgggtggatctgtcaccacccaccccaccttccctcaggctctagctgcctcattgtctcctctctggtctcaccatcctctcctcagctggcttctgctctctgcttcttggacttggccaagtgcataggggatactggggaggcctgcccagactgccttagcccctgcctggaccaaggtctgccttcagaatcagtcagataggcctgggttgcttttctaggctgccctttacttgctctgtgaacttaggccgataaagttatctttctgagcctcagttccttaactgtgaaataggagtgacagtgctgccttcttcagcttcctgtgaggaataaaagggttttgcatatggaagatacagtgagttagccggtgcccccaggggctcatattttaggaagttgattggtatggtggacaggcatgtaaattaaagtgattgtgatccaaaagtctgtcccagtttctcagagagaatgactagttcaggatggaggagggatcagaggaggtgactttgagacaccagtagatgttcttccagtgggataagggatgggaaggcgttccaggtaaagagatgcaaatagtatggagaggacagttagcattctggcctggtgggtctggcaaggagattgtgtgggaagagaagggaggatgtgatagataggaaatgaagctaaaggttctgtcagtacccgatgttggagacctctaatacccagctaagaaatgtgggctttatcttccaggaaaaggggaccactaaggagtccaagcaggccagcagcttgcttcaggtttgaggtttggaaagatcatgaatgaggccgggcatggtacctcacgcctataatcccagtactttgggaggtcgaggtgggaggatcacttgagcccgggagtttgagaccagcctgggcaacatagtgagaccttgtctctacaagaaaaaaaaaaattacaaattagccaagcgtggtggtacatgcctgtagtcccagctactctggaggctgaggcaggagggtcgcttgagcctaggaggtggaggttgcagtgagctgtgtacgtgctgctgcacctacagcctgggcaacagagtgagaccctgtctcaaaaaaaaataaatatatatatgtatatatatacacacacacatatttattgatcacgaatgacttggagaatgagaggaggggatgagggtggggaccggaagaccagtgaaaagttgctgtctttcctagggaaaggaggaggagacacagttccaggcaagctgagagactactagggagcatggggaggaaggaggcagaagaaatttcttttttttttttttttttttttgagacggagtcttgctctgtcacccaggctggagtgcagtggcgtgatctcgactcactgcaagctctgcctcccgggttcacgccattttcctgcctcagcctcccgagtagctaggactacaagcgcccgccaccacgcctgtctaattttttgtatttttagtagagacggggtttcaccgtggtctcgatctcctgacctcatgatccgcccgcctcggcctcccaaagtgctgggattacaggcgtgagccaccgcgcccggccagaagaaatttctaataacactcaaggacgccagctctggagtctgactaacttggttcagatcttggccttctcttccaatcttgagtgagatacttcacctttctgagcctcagttttcttctctgtagagtgggatcattgtggccagcttgtagtgaaacgctccagaatattagccaaacacaactaaggagatgttgactgggtttgttccatccatgataacagattttttggttaatgccccatgacaccaacacttcatatagcccttatgtgtctgactccattccgggctgtgctcatggcagcccagccatcagcaccaactgtgctgacataattgtttcctgctttttctcctgacttcttattgtgagtacttttcatgctaatacagtctccctcccaggcacagcagactgctacagattattctgatgaactgatgagatgtttgccttggcatacagctgtctatctaaaacaagggtgcctctttttttggtggagggacagagtttcactcttgttgcccaggctggagtgcaatggtgcaaactcggcttaccacaacctccacttcctgggttcaagcgattctcctgcctcagcctcccgagtagctgggattacagcacgcgtcaccacgcctggctaattttgtatttttagtagagatggggttcctccacgttggtcaggctggtctcgaactcctgacctcaggtgatccacccgccttggcctcccaatctgctgggattacaggcgtgagccaccgtgcccggccacaaagatgcctcttatatcccacatccctaccccatctaactttgcctgcctgacatcctttctgggatggctcccaagcacttcagattgaatgaaaacacctagcaacatggagcttcacgtctcttctctcctgtttgttcaacagtgttctctatctcactacatggaagtctaccatctacctggtcatttaagcccaagcctgggagtctttgtgtttggccaagctcatagggggatcttgggcaggcctgccaagaatcctctggacttttttaggatgaacaaatcaagccaagtgctgtggcacgtgcccatgatcccaggctcttgggaagctgaggtgggaagatcgcttgagtccatgagttcgaggctgcaataagctaattgcaccactgcactccagcctaggtgacagagtgagaccccctctcttaaaaaaataaaataaaaggccaggcatggtggcttacacctataatcccagcactttgggagtccaaggctagagaatcgcttgagcccaggagttcgggaccagcctgggcaacatggcaagacgttgtttctgcaaaatatacaaaaattagccgggcgtggtggtgcacacctgtagtcccagctatccaggatggctcaagcccgggtggttgaggctgcagtgagccatgaccatgccactgcactcaagtctgggcaggaccctgtctcaaaaataaatacaaaggatgaacaaattatgagagtaaaaaagggttagtctcctttatccttgctacacctcctcacccaaagccaagcagtagtgtagcaggataagccgcagacaaaaccccccagacaccgagttaaagaaggaagggctttattcagctgggagctttggcaagattcacgtctccaaaaactgagctccccgagtgagcagttcctgtcccttttaagggcttacaactctaagggggtctgcatgaagaggtcgtgattgattgagcaagcaggggatatgtgactgggggctgcatgcactggttatcagaacggaacagaacaggacagggattttcacagtgcttttccatacgatgtctggaatctatagataacataaccggttaggtcaggggtcgatctttaaccagacacaggtcgcggcgccaggctgtctgcctgtggatttcatttctgccttttagtttttacttctttggaggcagaaattgggcataagacaatatgaggggtggtctcctcccttagtagtaaagcactataaatatttgtggatttacaaccatttcattcagtcttgatgacagccctgagaagtagtcattgcatccccttttatagatgaggatacagttcagagaggttaaggcaactggccagccacaagctctggaaggtgaacccagttccctctaatcccaaagaatgtgcactttttagtgtgggacaaggggtctcaaaagacaggtgggaggattctcagccctgggagaataaaagttgggtgaagttcagaactgccacctcatcagtcagaactgggccagtgacaacctgcagaagctcagcctgcaaaggcttatcaggattctagacctttggttactttcccatctttagtatttagttctccttccccaggataatcagcagaaaagtgcctggccttgtgtccatataccatggaggggagagctagagaggcgaggttctcgggaaccactagaaggaaggaatgagggggctgctggttaggcccagagctgagaccgagaagggctcttggagttctccttcccttcgtaacattaggtagaggcttagacaacttgattgtttttcatgaccttaaagactgtggctccggccgggcatggtggctcacagctgttgtaatcccagcactttgggaggctgaggcgggtagatcgcttgagcccaggagttctagaccagcctgggcaacttggcaaaaccctgtctctacaaaatatataaaaattagctggacactgtgatgcgcacttgtagtcccagctattctagaggctgaggtgggaggatcacctgagctcaagaggtcaaacctgcaatgagccgtgattgtgccactgcacttgagcctgggcaacagagagtgagatgctgtctcaaaaaaacaaacaaacaaacaaacaaaaacaagtacttgatgactccattggggtcaattatgaagagacctcttagtgcaagaccaggaccttctaacagcacaccgaagtctcgagaaattcgcttagttaaatctgacaagggtgcgatgtttatgtggcccaaagcaccattctttcttggtgtatttatccaggcaagacggctaaagtgggaatccactgagactgcaacaacttcaaagttcacatcgtgaaattccttagctttgtcactagaagcaacaatttctgtaggacacacaaaggtgaaatccaaaggatagggctgggcgcggtggctcacacctgtaatcccagcactttgggaggctgaggtgggtggatcacctgagttcaggagttcaagaccagcctcaccaacatggtgaaatcccatctctactaaaaatacaaaaattagccaggcgtcgtggcaggcgcctgtaattccaggtactcaggaggctgaggcaggagaattggcttgaacccaggagggggaggttgcagtgagccgagatcgtgccactgcactccagcctgggtgacacagcaagactccgtctcggaaaaaaaaaaaaaaagaaagaaatccaaaggatagaagaaaagcaccaaatatttcccctcaaagtcatcaaggcttaggtctttgaactctccattgaccacggctgtacccttaaaatagggcgcatgctgggtgacatcaggtgcatggtatgaggaactggtaccagaattttgcttgaccggaaccagaccacaatatgtttgtcaaacttgttcttccagaagcagcaggcctgagggctgcagtggcagaaatgcccccaaggaatggcactcacatgccgggcaactgatgctcagagtaaccttcccacagcagccgcgatcttcagtgcatgtgtgtttttgtttttttgagacagtgtctgtctctttcgcccaggctaaagtacagtggcacaatctcagctcaatttagcctcagcctcccaggctcacgccatcctcccacctcagcctcctgagtagccaggacttcaggcgtgcaccaccatgcccggctaatttttgtaattttttggatagaaatggggtttcgccatgttgcccacgctggtcttgaactcctgggctcaagcgatcctcctgcctcgacttcccaaagtgctaggattacaggtgtggtggcaccttgtctctaaaaaaaatcaatcaattaaataagaaaagaaaatagctcttctccccctctgattataacaacacattaccaaagttactggtgcttacatggggttgaatggagttatgatggatatttcatttaatgttgttccttcaatgttttaattttttacaacagacttaaaaattttttaaatacatgtggccaggcacgatggctcacgcctgtaatcccgcactttgggaggccaaggtgggtggatcatctgaggtcaggagttcaagaccagcgggaccaacatggagaaaccccatctctactaaaaatacaaaataagccgggcgtggtggcacatgcctgtaatcctagctactccagaggctgaggcaggagaatcacttgaacctgggaggtagaggttgtggtgagccgagattgcgccatggcactccagcctgggcaataagaacaaaactctgcttcaaaaaaaaaaaaaaaaaaacatgtaatcggctgtacgcagtggctcacgcctgtaatcccaggacttcgggaggctgaggcaggtggattacttgagattaggagtttgggaccagcctggccaacatggtgaaaccccgtctctactaaaaatacaaaatttgggctgggcacagtggctcacgcctataattccagcactttgggaggccaaggcggggtggatcactgagatcaggagttcgagaccagcctggccaaactggtgaaacctcgtctctactaaaaatacaaaaattagctgggtgtggtggtgggtgcctgtaatcccagctactcgagaggctgaggcaggagaatcacttgaacccaggaggcagaggttgcatgagccgagatcgcaccattgcactctagcctgggtgacagaacgagactccatttcaaaaaaacaaaaacaaaacaaaacttagcagggcatggtgatgcacacctgtaatctcagctactcggaaggctgaggcacaagaattgcttcaacccgggaggtggaggttgcagtgagctgagatcatgcctgtgcgctccagcctggcgacagagtgagactccgtctcaaaaaacagaaaaatacatgtaatgctccttgttaaacatcttagataatataggaagataaaacgaaacaagtaatgattatctataataccattttccgaggttaccattgttaatatgggatatattttccttccccacatttttctcacatattttttgtgtatgcattttttttccaaaaaaaaaaaaaatggatgataggctgtttttcttcctttttttttttttttttttttggttggggggtggagtttcactactctttctcccaggctggagtgctgagtgcaatggcatgatcttggcctcacctcaacctccacctcctaggttcaagcaattctcctgcctcagcctcccaagtagctgggattacagtcgcacaccaccatgcctggctaatttttgtatttttttttttttttttggtggcgacggggtttcaccatgttggccaggctggtctcgaactcctgacctcaagtgatccacccaccttggcctccgaaagtgccaaagtactgggattacaggcgtgagccaccgcgcccaggctttttttttttttttttttttgagacagtctggctctgttgcccaggctggagtgcagtggctcgatcttggctcaccacaacctccacctcgcgggttcaagcgattctcctgcctcagcctcctgagtagctgggattacaggtgcccatcactgtgcctggctaatttttgtatttttagtagagacggggttttgccatgttggccaggctggtttggaactcctgatctcaggtaatccgcccgccccggcctcccacagtgttgggattacagatgtgagccaccacacctggccgtctgtttttcattctgcttgttttacttggcaatggggaacatctttctattcaatagattgatctctgaaaacatcacttttgatggcttcatactgttctatcatgaatataccacatatttagttcactactattgaacattcgggttctgtttttgttgtttttaaaatgttatgaaggatacagtagagaatatttgtgtaattaatctgtgggtgcatccattattctgttcttgggatacattttgagaagtggaattgttgggcaattcctcttaacgtatttctagagtgtttgataaatattgtctgattggcccaggaaaatgtttgccatttctcatatgtagtatttgactgactttcaggacaggaagatgtcacccaagcgcatagctaaaagaaggtcccccccagcagatgccatccccaaaagcaagaaggtgaagggtaagttggccttggcctctttgtgggtacaggtggccccttgaaaccctaagaacccgggactgggctcctttcttcctgaggcttgaagctgaagggtgtggatgtgcagagaccccacccagctggaaggtttcctgtagctcattgaatcctaccctctgggaatcacaaagtgggcagaaactcctctcaaagcactcaggcagcactggcacaaaaaaaaaaaaaaaaaaactagaccctagggcttcaccccaggcagtgatgcattatggttaggaccactgactttccgacatgggttcaagtccttgctctgccactttctagctgctgggcaagtcacttaatcccgcagtttggattatcaacttcttaaaatggcggcagccagagcagcgtcaccctctctgggctgtgtgaggatgagatgagataatggcctggcagcatttgagggaggtggctgtggtttcctctgtcctgggaccccggagggggacagggaggagagaaaagccagcaccaaactgggaggggaagtgtggacccacgctcagacagtgtctgtcttttgcagacacgagggccgctgcctcccgccgcgttcctggcgcccgctcctgccaaggtgcctgcgggccgagccctcctgaccagaaaacccgaccaggtggctccgcgccgggccctctgtgctgccagcgcggctcctcagcgtggccacatcctcggggagggctggcgcattggctgcccggggctgcgggttggggcgctttggcccacagagagccccgggcgcgcacctcccgcaaatgcgcctgtccgctcttcctcccgcccctcctgcctctccactgatgtgaggaagagtccgtttctgcagtgatttgcccgggagctgaacttattcactggcggacggcttgggcatggaggagggcttggatggagactggggagtgttctctgacccacgtagtctcccttgcttcgtgcagattctgctattataattagctttctgcggggcaaggcgtcacgcctgtcagaagatcgagacatcctggctaacacggtgaaaccccgtctctactaaaatacaaaaaattagccttgcggtggcgcgcgcctgtagtcccagctactcaggaggctgaggcagaggaatcgcttgaacccgggaggcagaggttgcaattagccaagatccaccactgcactccagactggcgacaaaggaactccgtctcaaaataacaataacaataattagctttcttttcttttttttttttttttttttttgagatcaagtatcactctgtcgcccagactggaggcggcagtggcacgatcttggctcactgccacctccgcctcccaggttcaagtgattctcctgcctcagcctcctgagtagctgagattacaggctactgttggcaaggctggtctcttaactcctgacctcaagtgatccgcccgccttggcctcccacagtgctaggattacaggtgtgagccaccgcacccagcccttcttgccctctccaccaagattcatttcacagtatccagtgtctccttgtttccctttctcccctttcacgtgaataatgtgctcagttcttaatctccacaaaaatcctgtgagagaggtacttttgttgtccccatttcacagatgacaaaacttagaaagttcatactaacagtctgtggcagagcaggggcttctgcacaggtttgtctgatcccagagcctgtgacctctcctcgctgtcgtcatcctctacactcagggtctatcttcttcacccttcagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtaggtgttggggactggcacagggttggacaaggcctggggttgggtggcttggggcagggcttttgaaccacgcatgttcactgtggaaatggagctggctagtcaagtggggagtggcctacatgagaatggactgcgaggccagacgttgcattaatgagggcatcctgggcacaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggtaaggctgggtctgaaagtctgcatggtccctgaaagacagaattaattggcggggccccaaagataatccacttccatgcccccatggtacttactggtggggagatgaaagcccacaggtagagctgaggcccagacccaggactctagcttcctcatgtgggcctgtccacgccactggctgcttccttgaatccgatgtcatcaagtgtctgtcctgggaagtgagtgggtcaaggatgtccctgggttgaggctgatccaggaggcctgctgtcttcacccatctccctgacttctgtctccccctcaccttgccagcactgcctcttccacacttcccagaggcttggatggggcaaggaggtgtggaggcagggattgtcgcatctcagagtttccaaggtacagaggagtgtagttgaaaaaacagattgtgggtttttgttgttgttgttgttgttgtttttgtattgttttgagatggagtttcactcttgttgcccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctccttccgggtaaggctgggtctgaagtctgcatggtccctgaagacagaattaattggcggggccccaaatataatccacttccatgcccccatggtacttactggtggggagatgaaagcccacaggtagagctgaggcccagacccaggactctagcttcctcatgtgggcctgtccacgccactggctgcttccttgaatccgatgtcatcaagtgtctggtcctgggaagtgagtgggtcaaggatgtccctgggttgaggctgatccaggaggcctgctgtcttcacccatctccctgacttctgtctccccctcaccttgccagcactgcctcttccacacttcccagaggcttggatggggcaaggaggtgtggaggcagggattgtcgcatctcagagtttccaaggtacagaggagtgtagttgaaaaaacagattgtgggtttttgttgttgttgttgttgttgtttttgtattgttttgagatggagtttcactcttgttgcccaggctggagtgcaatagcgcaatcttggctcactgcaagctctgcctccctgattcacgccattctcctgcctctgtctcccgagtagctgggactacaggcgcccgctacaacgcccagctaattttttgtattttttggtagagacggcatttcaccgtgttagccggaatggtctcgatctcctgacctcgtgatcgcccgccttggcctcccaaagtgctgggattacaggcatgagccaccgcgcccggcctcttttcttttttaattagagacgagatcctgctctgtcacccaggccagagtgcaatggcatcgtcttagctcattacagcctcaacttcctgggctcaggtgatttcttccacctcagcctcgcaagtagctggtactagaggcttgtgccaccacgcccagctaatttttgtattttttgtagggacggggtttcaccgtgttgcccaagctggtcctgagctcaagcgatctgcccacctgggcctaccaaagtgctaggattactggcatgaattaccatgcctggcccagaatagtatattgagtgcccatttacttgccacacagtttcaatgattatcagcttgtggccagacttgtttatctctatttgcatccgctctctgactccttgattattttaatgcaagtcgcagaccataaatgatttcattcataagtatttgagtatgtggcctggctcctgcccacttctccatccccatctggtgccactgcccttctggatttcactggcacggggcaggcaggactggctgataagtgccctgtccctcccttctaggacaataacggtgtgattggactgttggagcccatgaagaagagcatggtgcctgtgcaggtgcagctggatgtgcctgtggtaaaggtggcctcaggtgggtctgggggcacttgctcagggcaggagttggaggaccttgttctggggctggcctagccttgggccttacagttgtggcctgcatcccttaccttttcatccttaggaaacgaccacttggtgatgctgacagctgatggtgacctctacaccttgggctgcggggaacagggccagctaggccgtgtgcctgagttatttgccaaccgtggtggccggcaaggcctcggtaagtggccttggtacctccagcagggcaaattggcaggccacccccacagtgaaggccaaaggcaggaaggatttgctgtggtcaggcttgcatcagatgggcttgtggtgttggttaggactttggagacagactgctctggtagttttgccacctactgtctatgggactctgaacatagtttcttcatcactaagtctacctacctgtaaacctacttcattaggttgctgtgaagttaaatgagttaatgagaagaatatcaggcagatggtaagttccacgtaaatgatacccgtaatgactgtgggaatctgagcaaggcacttgtattctcttgatctcagtttccttttctataaaatagggataagagtccctacttagcctctcaagggcttttataatggaggagaattaaactcggggcagagagaagccatgtgtgtctgtctgtcactgaccgtggctttccctttgcctgcagaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggtgagccccgagcccagcttcaggcatgacccagtggcctgcgttcctgtcctggctctgccactcattcattgtgcatcctttgcggggtcgtctaacccctccaagccagttttgtcatctgtaaagtgagaatgtccatatcctgatgggaggtggcctcactgtgggaggagattgagaagggcagctctcagaacaccttcacccctgatggctccggcctttcccccaggaactccgggcacagaatcttgcttcataccccagaacctaacatccttcaagaattccaccaagtcctgggtgggcttctctggtggccagcaccatacagtctgcatggattcggaaggtagggcctttacgtccttctctagtttgggggtggagtgttccctggcctaggcctagccagattcctgagaccatggtccttggagcctgggtctgttccatgggttgtaccatacatgggtccatgagagtcactctcatcctcctagagtcctggtgttcttccaagtgtgagttcaatgggggcccatgtagattctcctaggcctcctccaaaactgggaagagacactgcagatctccttctgatcgctctgggagcagggacacactcccatggacaggtggactcacctagcctgccacccattttgcctgtagcacgccctctgctattgctcatctctctccctcctcccataggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtgagtggggctgcctacactctgtctagttgggacctgggggtcatggttcttacccaattccccaataggctgtgatgtccactctcgggggagccgaggtacagagagcagtgtttgtgatggcactttgttcctgcttctcagaagctctggcattgatgaatatgaaatgagtacacaaattattttagtaaaggtgacttattatgcagaggagagaaatagcaaagagtgagatatcactgaggcctaaggaggcaatgggactggaacccaagtctccagactcctaacccaggctgctctctcccctcagggtgaccccttcatatatcaccttgtatgttcccgctttccagggacttttacttagaatctaaatcaagaaaaaaaaaggcttagtagtcagagttgtagcaactatagcagaggagggtgtgaacaagtgaccaccaaagcctgagtgggtgagggggatagccatggaggtcctgtagaagcctggagctggcagaggtgcttgacctgaggttatctgggaagacttcctcaggaagtggggcttgcactgtaccttgaaggttccattccttgtgaaaagcaaagaatgccattccaggcagaggaacatcagggcagtctcaaaggtggctggtcctgggaacagagggtggggtaggaccttgaatgccacgcctaggagcagcctttggcagtgtgtagggactgtgctctctggtttacagagttcttttttatccatcatctccttgggttctcccaacttccctgaactcccagagtctggtaccttgccaagctgctattggccaaggccacagtccacgcccatgtcccaggtttctcctgctacagaaaggtgggctggggatcctggagacagctgtacccatttctctctcttgcaggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgtcctgaggtgccaaccagctgtcagtgtgactgtaacaaaggcttcaaatctgtcaagaagtaaggaaaagttttgtttgaattttgtttgggtatttctgttttgggagtcactggattatttttaaatgctgcatagtacaatagaggcagggtggatcttttaataccaaaccaaaaaaaattttttttttttgagacagagtttttctcgtggcccaggctagagtgcaatggcgcaatcttggctcactgtatcctccgcctcccaggttcaagcaattcttctgcctcagcctcccaagtagctgggattacaggcatgcatcaccatgcctggctaaatttttttgtgtttttagtagagacagggtcttgccccgttggtcaggctggtcccgaacacctgaccgcagatgatctgcccgcctcggcctcccaaagtgctgggattataggcgtgagccaccgcgcctggccgatttttttttttttttttttgagacagtcgctttctttgcccaggctggagtgcaatggtgtgatctcggctcgctgcaacctccacctcccgggttcaagtgattcttctgcttcagcgtctgaagtagctggaattacaggcacacaccaccgagcccagctaatttctaaaattatttatttatttattgaggcggagtctcgctctgttgcccaggctggagtgcagtggcatgatctcggctcactgcaacctccgcctcccaagttcaagcgattctcctgcctcagtctcccgagtagctgggactacaggcgcgtgccaccatgcctggctaatttttttgtatttttagtagagacggggtttcactatgttggccagactggtctccaactcctgacctcctgatccgcccacctcagcctcccaaagtgctgagattacaggcatgagccaccgcacccagcaatttatttatttagagactgagtttcgctcttgttacccaggctggagtgcagtggtgtgatctcagctcactgcaacctccgcttcccaggctcaagtgattctcctgcctcagtaatcccgagtagctgggattacaggcgtgcgccaccacgcctagctaattttttgtatttttagtagagatggggttttactctattggccaggttggtctcaaatgcctgacctcgtgatccacccgcctcagcctcccaaggtgctgggattacaggcgtccaagccacgcctggcctatgtgatcatagtttctattctctgttccaggcaagccccaccaggcctgctgggtgagggtcaggagcacgaggtggctgaggatggcactggcctttgctgctgggtctcctggcctgttcctctcttccgaatgt

SEQ ID NO: 15381 - DNA, 43333 bp, Human
ggtctcccaaagtgccaaggttacaggcttgagccactgcacctggccagtttttgtgttttgatcttatatcctgcaaccctgaaactcgtctacttgctctgatgggttttttgtggattctgtgggatttttttctatatgagatcatgttatttgcaaacagagatagttttcttcctttctattctgaatgtttttattctttttctttcctaattgccctggctagaacccctagtgcaatgttgaggtagagagaatggacatcctcatcttattcttaaccttagaaggaaagcttttagtcttttaccgctaagtatactgtatagctgtgagtattttatagagaccctttatcagattgagaactttccttttatatctcgtttattgagtgtttttttcatgaaatgttgttagattttgtcaaatgctttttcgccatcaattgaaataattatgtggcttctgtcctttattcctttaatgcaatgtatagaactgtttgattttcatatttgaacaagcttgctttcctgggatgaaccccagttattcgtggtgtataatcctttatataccactggatttggtttgctagagttttgtagaggattgtttgtgtttctattcataagagatattggtctgtagttttcttttcctgtgatgtctttggtttcagtatcaggtaatattggcctcacagaattgggaagtgttttcttctaattttaggaagagttttttgtgaagtgttcacaatatactttttttttttttttttttttttttttttggagacaaagtttcactcttgttgcccagggtggagtacaatagcatgatcttggctcactgcaacctccgcctcccgggttcaagcgattctcctgcctcagcctccctagtagctgggattacaggcacgggccaccatgcctggctaattttgtatttttagtagagacagggttttaccatgttggtcaggcttgtctctaactcctgacctcaagtgatccacccacctcggcctcccaaagtgctgggattacaggcgtgagctaccgccgccgacccacaatacacttttttttttttctgtcacccaggctggagtgcagtggcacaatctccgcttactgcagcctccacctccctggttcaagcgattctcctgcctcagccacacgagtagctgggattacaggtgcgcaccatcgtgcctggctaatttttttttttttttttaatgtagagatggagttttaccattttggccagctggtctcgaactcctgacctcaagtgatctgcccaccttggcctcccgaatgctgggattataggtgtgagccagcacacccagccacaatacactttctatcaagaaaaaatatatctgcctgcttcagatacccaggtgaccactcagcaccttgtaccttgcctttgggataggtattgactaaatttcagaccctgtggtcctgacaggcttttcccagctccatcccattggggctgagaaattaccaggacgcttttataagtactaatcccagtaggtttcagtgtaatgttggttttgtttgtcatcccctgctgtgttgtgagagcctttctcgggaaaccatattaaaggaatgttttacaggtggctttggagacagggataacattcaaagatcatctttaaaatgttgttttggtaggtttttactttattaaagtgtgcagagcacaactgcaaattcctttggtttcttcttacattttcaacatttgaaacagctgttttaagattgtattttcctggggggcatcctgtagcaacatctcattgattgctttgtcatcatccttctgggtccatacctcagaaccatacaagttcatcactccaggccacagtgaaagcaagaggcgtggtcttcaggccacctctgggcatcattctgaacccccttgtgatccagcccacttctcacccacaggtaacacgtacacagacctctcggccggaatctccagggatgaccagcccctccccacgcatccagataatctccaccgactctgctgtagcctcacctcagcgcattcaggtacctgcaacctgccaatggcaaccctgcctttccagaagaactctttccaaaaacaaaccttcctaagggtttcactaaagagttgtgccttttgggcatgaaatacagtacaacttcatcaattctttaaaaaaaataaagaaaaaatgcttacatttatttaaccaacttacatttaaagcaaaagcctaaactgttgtttcaaaccattgagataaagtaccattttattacttatttgcttctaaattgagaggcagtatgtcttagtactgtaattaagagcaagggcccctacttgaagtcaaatccagtgccccacttagctttgttgaccttggtcaattaactttttaatgcctcactttcttcatttggaaaatagacataatagtagtatttgcctcacgaagttattatgaagaatcaaagggatattgcttataaagtgcttagaatggtacctggcacataataatgttcaatatttactaattatataataacttattactaatattgttattaactaatcgatattcacttatgggaagttgtcttccctagggctctgaacctgcctctggcccattgagtgttttcacatctttgaacaaagagaaggtaggtgtatcaagcttgaaggcaaaaagctgggaggaagggataatatattgatgacaaagatttattgttatctcaacaagctgaatcaaaaagccaattataacggttgatttctctgtttttcttcttgcagttttatcagtttttttggctcactttgatgctctgttgttagttgcatatatgttttatattgttatgtctttttggagaattaaccctttcttgatcttagccaaaaggtcgagaagcgatggagaattaacccctttcttgcttgctttcttggttgcttgctttctttttatttatttatttttgagacagagtcttgctatgttgcccaggctggtcttgaactcctgacctcaagtgatactcctgcctcagcttcccaaagtgctgggattacaggcatgagccaccatgcccagccacccctttcttattatgtaccatttccctttatgtttattttccttgttctgaagtctgctttgtctgaaattactatagttttctttttattagtgttagttgctagcatggtataactttctctatgttttgacattttttcttttttttgagacagggtcttgctctgtcacccaggctggagtgcaatggcgtgaacacagctcactgcagcctctacctcagaggctcaagccatcctcccatctacgcctcccaagtagctgggactacaggtgcataccaccatgcctggatacacacacgcataatgctttttttttttttttttttttttttataaatagggatggggtttcaccatgttgccaaggtgggtctcaaactcctgagctcaagcaatccacctgcctcagcctcccaaagtgctgggactacaggtgtgagccagcgtgcgtggccaacttttttttttttttttttttaggagaatcttgctctgttgcccaggctggagtgcatttactattcacagacaggatcatagggcactacaacctcaaactcctgagcccaagctgtccttttgcctcagcctcccaagtagttgggactacaaatgtgcaccactgtcagcttctccatccctttattttgcatctgtctgtgtctttatttataaaatgggtctcctgtaggcaatatgtattggggtcttgattttttcccatttttttcctacttcctacataatttcataagggtcttgtttttttacccagctgacaatctgtcttttcattggtggatgtggatcaattcatatttaaagtgattgttgatatatttggattaatatcctccatttaggctgggtacagtggctcatacttgtaatcccagcacttagggaggctgaagaaggcttattacttgagcccaggagttcgagaccagcctgggcaacaaagtgagattgtatctctacaaaaaaactaaaaaattagccagacatggtgatgcattcctgtagtcctagctacttgggaggctttggtgggaggattgcttgagcccaggaggttgaggctgcagtgagctgtgatcatgccactgcactccagcctgggccacagagagaccctgtctcaaaaaaataaaatagtaattcagaactattcatatgagctaaaatttatacttaagtaaaagatttatttaccattttgcaaaggtcaggatttatttacctttttgcaaaccttttttaaagcaggttctttttaccctttttatttttagtcaataatctttgctattatcttttggtatgctctaatataccctgacctatcttataaactttatatatatgctatatgtaaattctatgtatactataggaaattgtgtatatgtaggtatgtgagtgggcaggtgggtatgtgtgtgtatataaatagtataggaaatctgaagagctggttttgggttgagggacaaacccttgaagggattctcattgtactcagaaagaaatccaaactcgcagcagggccgttccacctccctctctaggttcctgggccatgctggttgtctgtgggcctgatagcagttcccaagaaactgttcctcccagggctttccatataccagaacatttctctttgctgggaacactaaacatttatttggctgctgtctcctcagccttgaatcttttttttttttttttttaaaggcatttcgctcttgtcgcccaggctggagtacagtggcacagtgttggctcactgcaacttctgcctcccaggttcaagcaattcttctgcctcagcctcccaaatagctgggattacagacatgcgccaccacgccaggctaattttgtattttcagtagagacagagtttcaccatgttggccaggctggtctcgaactcctgacctcagctgatcagcctgcctcggcctcccaaagtgctgggattacaggcgcgagccactgtgccacccagcccaaatctcatcttaaatgtcaccttgtcacagaggttttccctgacctctctttttttttttttttttgaggcggagtctcgctctgtcgcccaggctggagtgtagtggcgcgatcttggctcactgcaacctccgcctcccgggttcatgccattctcctgcctcagcctgccgagtagctgggaatacaggtgctcgccaccacacctggctaaatttttatatttttagtagggacggggtttcaccatgttagacaggatggtctcggtctcctgaccttatgatccgcctgcctcggcctcccaaaattctgggattacaggcatgagccaccgtgcccagccccctgacctctctttttaaagttaagtacttttgttattcagggttaccccaacctgatcttttccctcataacatgtaccataaattgaaattgtttactgactggtttgtttccttgtgtattgccagtctcttccattgaactaaaagtttcatgagggcaggagccatcttcatatgccactgtctaacacagtgtctgacagagtagcccctcagtaaatattttaggaatgaatgaaagaatgagtaagccatggtaaaaagtcttgactttttcctcaggagcgatttgataagatgaaagggataagacaagactgagtgaggaaaggagtatgtgagagcttagagggaagaaatactttaccaaggtcctgtcatgttctgggcagtgtaccaaacagtttcacacacatcgtatcatttcactttcctagtcatcctttttcatagatatataaatggagctcaagggcttatgtaactgctccaagttgacacagctgggaagtagaagagcaagcattcctattcatgtctgtagctaccaagccctttctcgggtgtttacagtgaaagaggtggcaaggtggatagggataaactggagaggctacctcatctaaagaggtagccaacccacacccgctccagccacctggcaccatggggagaacttgagcccaggatgacctgagcttccagtttgtcaagagaactataaatttgattttgattatgggaaatactcaatttttagatgttagcaaacagtttttttgtttgtttgtttttttttttaaattagggggctgagtgcagtggctcacacctgtgatcccagcactttggaggccgatgtaggtggatcgcttgatctcaggagttcaagaccagcctgggcaacctagtgagacgtcatctctataaaaaatacaaaaattagccaggcgtgctggcacgagcctgtagtcccagttactcaggagactgagatgggaggatcacttgaggctgagaggtggaggttgtaaagagccaacatcgtgctgctgcactccagcctgggtgacagaataagacctggtctcaagaaaaaaaaaaaacaaaaactttgggtactcaaacaaaagttatccagtggctggtttttgcctgcaggccattcattggcaggctcttctttgcaacagagatgttgaactggctggaacagagtgggtaacatgggggagaatggtggtgtatgagatcattccagggtcctttgggattagaactagagaggaccttagcttagtaaagtcagttctgctataatgtgatgtgtgttcctgaaaattcccacactttgccaaattgtgtgatgaaaaccacaggactgattggaaaaaatgaaattagtgacactcaaaaactttgtcagtaacgtattaaaaaacagatagtgaatctaataaaacctgcaagtggttaaatacatagtgactataataaatatggtacttggtcgggcgcggcggctagtgcctataatcccagcactttgggaggccgaggtggacggatcacctgaggttgggagtttgagaccagcctgaccaacatggagaaatcccatctctactaaaaatacaaaaaattagcggggcatggtgacgcatacctgtaatcccagctactcgggaggctgaggcaggagaatgacttgaacctgggaggcggaggttgcagtgagccaagatcgtgccattgcactccagcctgggcaacaagagcgaaactccgtctcaaaaataaataagtaaatacggcactttacctagaaaaagccttgtagattctttgtggaggtaggtgtagggaggattgcgtctcatgagttactgtgagtggtggacatggggtgacctgaaatcaccagatggattgaatgtgactcataccatgtgcactgagtatccctgcatggatcacttcacctcagtgtttattcatggaagaaaccatgcataaacacaaaatttgcattatactcaaattatttactaacatatcaatcatgttcaaacaaattcatcttttcacaacaagcattatggcagctctgagtgtataggtaggctattgagggccttaaaaatcacagaaaacaacacatatcttcttaacgttacttcattccccccaatttgttatagtttacagacaggaatttaagaacttttgttccaagtaaagaaataaaatttgcctcttgtattagtttcccagggctgtcacaataaattaccacaaacttagtggcttaaaacaatagaaatttattttcccaaccttctggtggccagaagtctgaaatcaaggtgtcagcagggccatgctctcttaaggttctaggagagtgtccttccttgcctcttcctaccttctggtgggtgccagcagtccttggcattcctcgcttgcttgcagctgcatcactccaatctctgcctccattgccacatggtcttcttataaggacaccagtcattgaattagggcccaccctaatgcagtattacctcatcttatcctaattacatttgcaaaggccctacttccaagtaaggtacattaatagatactgggaattatggctggaatgtatcttttcagggggtacagttctatgcacaatacctctcctccacagccgacttaaattttaatgagcttggatatatccttgcaatttgatgtgtcctctaggtcattaaataggaatctatctgtgtttgttaacaaggtcttgcctaatggtcacccttgtgttccaatagggtatttgggagatttttttttctgcctgcatttttagttttttcatgggcgtgatctctctaaatggaggatacggatgtcttaggagggtgaagataaaaaaaaaaaacccaaaattataagtaattcattgaatttttataagcgtgagtctttgagaaaaaaagaaaagaataatctagccaggtgcattggttctcacctgtaaactccttgggaggcgaaggcacgaggatcacttgagcctagatgttcaagaccagcttgggcaaaatagtaagaccccatctctagagaaaaaaaaaaattgccaggcatggtggtgcttacctgtagtcccagctactctggaggctgagatgggaggattgcttgagcctaggaggtcgaggctgcagtgagccaggatcgtgctactgcactccaatgtgggtaacagaacaagaccctgtctcaaaaaaaaaaaaaaaaattctgagccttgaggtatgttatatactgccactaagagctgctgtccttgtctggaaccagtaacttctacttcccaacataccctgacctcatacttgccatacctcaaccacaatgactggagaagagcatacaagaaatgacatgctggttatctgtgtgtgctctggtacagcatgtgtcatccctgaacacaaaagggcaaaggaattactagtgttgccttggttttagttggtaattgaagacccctctcaatcacataactgtcatttcttaacagggaaaacagtttaggaaggaaacaaaaattgatagacatgagctgggcttggtggctcatgcctgaatcctagcactttgggaggccaaggcggcaggatcacttgagcccaggaatttgaggtcacctgggcaacaaaatgatactccatctccacaaaaaaattttctaaaaaattagctgggtgtggtggcacgcgcctgtggtctcagctacacagaaggccaaagcagaaggattgcttgggcccaggaggttgagactgcggtgagccatgctcatgccactgcacgccagcctgggtgacaaagcgagactcttgtctcaaaaaaaagaaaaagaattgatagacatatgactcacagagctcaggttatgagggcttccaaaggccatcttctttatctaaggcaagaatcccttctgtggcagctgagagaagtatgtgtcaaccagcctgtgtctgcaatctttcagttgagctgtgggtaggaaagttttttttaaagataattcttttcacaaggttttctgtctcatgttttatgtttctgggggactccgggcatgccacagattgtaatgatgaaagtttcttcctttcattccctccaaatccattctccttgagccttaaacatcttttgcccctttagttggaaatgatgatatactggggtttgtcccataatcagctgagtattcattcttggatctgtcatcctattctgctgcctctctggtcttgcacttggctgtgccgtgtagcacactttgccgcatttttgcagtttactgttgtgtttgattcaagtctttgttcagtgtcacatactcagagatgtctttcctcctaaagttgcatccctgtctccttcccaatgtcatgctttctctgtttattctgctttttgttttctccagggcatttacactgactgatattatttattcagagttcatggtctgcttcccccaatagaagtttagttctatgatggtgggacctttttttgttcacgtccctattcctagtacctagaacagtgtttgactcgtagtgggtgctcagtaaacatttaagtgattgaatcttttcttgcctatgtcattttattttgagccagccaacattgtcttattttccgtattgcagttagccaagctgttgtgttagactgtgtgagtttgttgtctcaaccttgaagttccatttcttttttttttttggagacggagtttcccttttgtcgctcaggctggagtgcagtggcgcaatctcagctcactgcaaactctgcctctgagttcaagcgattctcgtgtcttggcattccaagtagctgggactacaggcgcccatcaccacgcccagctaatttttgtatttttagtagagacagggtttcgccatgttgaccaggctggtcttgaactcctgacatcaggtgatcctcccacctcggcctcccagagtgttgggattacagacatgagccactgcgtccggctggagttccatttcaaaagtctgtcaagagtggtacagatgctagacctgcccataagtgtactgtgctgtaggaaactgagttccagccagagacatagcatgtttcccctcacccaacacagcagcagcagctcaagagtcttctttgcagtaagggtctgctggtgcctggagggagaggtggcagtgctgctagccaggaacatctggtctagaagagaggcaggacggggattagaacaacttcagagaacttcatgagcaagaataagagagttcattcttgtcatagcagctgtttttgttgtgactgatgcaattagacaaggactgtgtgaagaagtggagtcttgacagcgagactcctgaagagtgagaactcccagaggaataagggtcaagacttctccagagtcagtgcccacttccttcggtgcatcctaggatcttttattgtcgtctctctatgtggcaggccttgtgctggccctggggatatagcagtgaatcagatgtagtctctatccttaaagacctcagagtcaggaagtgggagtgaaggaggtgggtggtcaattagtggtaagttgagtgtgtgtcagcaggggtctccctgtattctctcaacctaaggcaatattatttacaggaccttttagaaagaggctgtctttgaaacagtcattcccaagtttttggcttttgtggatcagtagcatttcaaaagagttaggattgcctacatttgttattaggtgaggacaaggacttttcaaaaagttaaacctactatttattattgccttcatttcataaaagaaagggcattttaattctaaaaacagtaggaaagatatagtcctagactaaaattagctttatgaaaatttgtttctgaaaagctcactattgtgttttatttttctcagttcaccgtggactggtgaaaatgcatgttagacagcattaattcaaggactggtttttggcagtcaccactttgagcaccacctgcaaatgcatgggtcttgtgacactccatgagagcagcctccatgttgtgtcttatagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccaggtaaggcctttggacaggtatttgtttcagcacttctgctattgaacttgttcctgacttgttcttacatctgccttcgaggccaaatccatccctggaaggttccttggggacctgcaaacatggcaggttgctgctttggccaaagtaataaaccagcaatccagtggcaaggcccagaagacagtcaactataacactcagagaggatggaagtagaacctggaagtcagtggccacaggagactgacatgagcaagccggcactgaggctactggagaattgttcttacctaaggccatcaagtggcagcccttgatattttaaaggtaccacctagggctgactacagccaggcgagaaccgacttgtccagatcatcaggtctgtggccccagcttttcattctgtctttacttgccactgtgtactactcgccctgggcccctcaattcttgtctctatctctgccctggttcttcctgctctgttaaggcaggatggggttgaggacagtccacagcaaggaaaagagcagacattgaaggaaagcagggttgttgctagcatgagtctgggaagtatagaatctccaaacccaacaattggagaacagaaactcaaggtcagtatcccatgatggctgagcatggagcatgcttcgtcagggttgtgtttcatttttttttttaatttttgataaaatacacataatataaaacttaacatcttaaccagctttaggtatacagtttagtggcattaagtagatttacattgttgtaccactatctagctctgtgtaactcttttcctcttcctaagctgaaactctgtactcattgaatagtaactctcctctccccctcccccagcccctggtgaccaccattctactttctgtctccatgaatttgactactctaggtacctcatataagtgaaatcagcctttgtgtgactggcttatttcacccatccatgttgtagcatgtgtcagaattccattccttttaaaggctgagtagtattccactctgtatatagaccacattttatctcttcatctgttggtggacatgtaggttgcttccaccttttggctgttgaattaatgctgcttagaatctctgttttgggtggggaggttctactatgaagaaacttaaagaagggaagactttttttgtcttctgattgagctgggatcagaacgccaacatgttcagctttcagaactgttcttttagacaccttacgctacacttactaaatgctgtctcatccttcctttcccggagtacattgtgatcatctgaaatcagaattccttcctcctcctttagagtactccttgtctgtgaaagaatggctgttgattttgttgcatgtttcacaagaggtgattctacttaatgatttctgtatgtgttcccaccatgtataaatcattttaaggcttattgttggctcaagttcaagtacattttaaaataacagctatttttcactttcttatattgatatcagttatagtattctcccagatgaattgctgtcgcctagaaaatcaccacaaatgaggggaagatagcaggtttcaaaggtcatttgttctcgtcatcagctcaccaccagctgcctcagtcggagtcctagttatttaattaataaagtttggttatttctctgccaatacacctctttgcgtacattcaagttgttacgggaagaatcttaaatatcttcattttgaagcctctgtgtgtgattccccacatgggccacaattttgggtggttgtagtagccagatagagtagatcagtggaaaccagcgcctgaccctgggaaaccagccagctgatgagcagtccggatgagtggcagagccattctgggtgtcagattaagttgtcttctggaattttgccagttctgtccagagttctgcttaaaaacccaacattgagaatttgtaattaaacattactttgcttagtgatctgggtttttgcttgtttgtttttgagatggggtctcactctgtcacccagcctggagtgcagtggtgcgatctcggctcactacaacctctgcctcccgggttgaagcaattctcctgcctcagcctccagagtagctggggattacaggcacccaccaccacatttgactaattttgtatttttagtagagacagggtttcaccatgttagtcaggctggtctcgaactcccgacctcaagtgatccacccacctcagcctcccaaagtgctgggattatagacgtgagccaccgtgcccggcagtgatttgatttttaattggcacccctgttcgtttcctgatttctctcagattgtcacggattctgcctctgtggagcgtttactggggaagacggacgtccagcggccccaggtggtagagtactgtgtggtctgtggcgacaaagcctccggtatgtagttccaggttatgctggcacttataatgggccaacagcatgaagtaactgttgtgaggtggggtggtagttaatttagaaggaccattttatgtacgtttgtaggtttcacatgtgaattctacttttcttattggggtaatgatgtaaataagtaaggtagtttgtcagaaattagacatcaaaaggaaaagtcaagaaattatttctgtgatttgtaaatcttggttgagtgtgtagtatttatgtgctgctaagaaagtactcattgtctaatcttgttaacatttgtacagcacttggctattttacaaggtgtataatttgtataatcccccttcatcctaactgtaactatctcttaacatcccctcactataacccactgtaaataactgctgtaatgaagcaggaggaggcatgtgattccagctagtgtcccagggtcaggaaaggccccacagaggcagtcgcacctgggagccttggtaattgtgtacatgttggttggagcaggaggagggcattccagcaagtggagccagggcctagagtttaagatcaatacccatggtatccttgagagagagctcataggcttctgtgattacgattgggtaaagtgagactgaagaagatgtctggcccaaaaattcaagtgctggcctgcttgtactggggatccatagaaggttagtgaggcagacaggaaggaatggagaagtattttacaagaacacagtaccaggaatgccaggggcacaggcctgtgttctgtgatggctgcttggttccactttcttctgtggtcacaaaattcacaggaactttgggcactgtagtcctggtttttgtttgttttgttttttaaaaaggaggttggaccaagcctcttaggaagacagccccaagcaagcatctacagaagatcagaagctccagtttcccttccatgctggtgacaccatttatctgccaatggtgcctgcctctgctcccgccctttgtcctggtaaacccaacccatcctatcccttctctgaagccctcacctaccccagtaggcagatagacagtgctgcttgtgattctgattgccctttcctacagattaatcacttgttgcatactcatataattcactctttacaggcctgtcttccccatcagaatgtcagagcaaaaaccatgtcttaccatctatctctgtattcctgtcttcttgctcagcaaggaaaggctctctacaaacttctgaacaaatgagtgaagcatgaacgtaacaaaagggccatagaatctgcttggcttccccatttgtcagtcttcttctgagcttaaaggaaaggcctagtcacaggctcttggtgccattgtctcctgatattagtgtcactcaaagggatagagaactcaaggaaatatactgcaaagaaaggaaaaacaatattatagaaggcactttaccacaactattcttaaaagaaaaagactgagttattccagatgcacacttgggaaatggttttgcatactagagcttagaacagtgggattctctgtagccaccataaatggtaatcctgtgaaatgtatcctccttggcaatgtagctatgaaattggattatacaaacaagacagaatcagaagagcatgtccatggtcagtctcagctggaaacaagtgggcataatgtatgtgaaagtactttgtgaataagaaagctaaactgaaggaggggccgctttttttttgagatggagtctcactctgtccctcaggttggagtgcagtggtgtgatcttggctcactgcaacctttgcctcccagattcaagcaattctcttgcctcagcctcccaagtagctgggactataggtgtctgccaccacgcctggctaatttttgtatttttagtagagactgggtttcaccatattggccaggctggtctcgaactcctaaccttgtgatctgcctgccttggcctcccaaagtgctgggattacaggcatgagccaccttgcccagccaggggcactttttaatgtcattgataattaaaagttggagataccatgcaaactgtacacctgacaaagggttactacccagaacatatagcgaacttaaacaactcgacagcaaaaaaaacaagtaacccaattttaaaatgggcaaaataccttaatagacatttcgcaaaagaagacattcaaatggccgagttatatgaaaaaatgctcaacatcactaatcttcagggaaatgcaaatcaccacatgaggtatcacctccagttaggatgtctataatcaggctgggtgcagtggctcatgcctataatcccagcactttggcaggccgaggtgggcagatcacatgaggccgggagttcaagaccagcctgaccaacgtggcaaaacctcatctctactgatttttgtatttttatgagatatatattttttggcagggtgcggtgtctcacatctgtaatcccagcactttgggagaccaaggcaggtggatcacctgaggtcaggagttcgagactagcctggccaacatggtaaaaccgtctctactaaaaatacaaaaattagctgggtgtggtagcgggttcctgtaatcccagctacttgggaggctcaggcaggagaattgcttgaacctgggaggcagaggttgcagtaagccaagatcgcaccactgcactccagcctgggtgacaaaagcaagactcttgtcttaaaaaaaaaaaaaaaaaaaaaaagattttatttttataaaatcttataaaaataaaaaaattagcctagtgtggtggtgcacacctataattccagctactcgggaggctgaggcacaagaatcacttgaacccaggaggtggaggttgcagtgagccgaaatcatggccactgcactccagtctgagtgactaagactcttgtctcaaaaaaaaagaaaagaaaaaatgtctacaattaaaaagacgaaaagaagtgctagggaggatgtggagaaaagggaacacttacacattgttggtgggattgtaaactagtacagccactatagaaaactgtatggaggttcttcaaaaaattaaaaatagaactaccacatgatccagcaatctcagtactggatccatatccaaaggaaataaaatcattatgttgaagaaatatctgcactcccacgcttactgcatgactatttacaatggccaagatgtggaatcagcttaagtatccaacagcggatgaatggataaagaaaatgtggtatgtaacacagtggaatacataaaactgaatgaaatcctgcactttgtgacaacatagatgaacatggaggacatcatgttacatgaaataagccagacacagaaagacaaatacgatctcactcatgtggaatccttaaaaaaaaaaattgatatcatagaaacagagagtagaataatggcaccaagactcaggaggggaaaagtgagagatagttgggaaagactgaccaactggtacaaagttacagttaagtagtaggaacaagttctggtgttctattgcactgtagccatagctaacaataaggtattatatattataaaatacctagaagaaagggttttgaatgtccttattaacaaagaaatgataaatgcataaggtgatggtcactctatctgatttgatcattatacaacgtggatatattgaaatatcaaattatgcctcataaatatggacatggacaattacaatgtatcagaaataaaaagagacaccaaagtaaaacaagattagaaaaatggactgtgtttaataaatgcattcctagaactgtgtttctagaaggctttgagtggctagcccaggtggaaccatatggtaatcctcttttgctgtgggcttcggcagtgacagtccccatgcttctccctgtgactatcccgcttccccaggggaggtttcgggcccaggacgtgaatcagagaggggctaaatgcaggagtgagaccctctgtgccaaagccacacatgcacgtgtttgctatgtgccactcgtggcaggacaggggccctgagccgcatcacaagcccagatctccaggaataggacccaggtgtgttcaagtggacagtagagttcagccgtcacctgtgagctcctactgtatgttagaccatttgtatactaagagcactaaggtcatgccatctgccagctgtcatataacctgtctgagtttcagtatttccatcatgaattcataaggctacttgaaagatggtagagaaattacgtgaagggtgtggccagtatgcttaatgctcaggccacgtggctgttggcatctaacagtgtatggcacccatcacttcaatgagacttgcacaggaactgacagatcacctctttggtgaatccacaaatatagtcacaaaatatttgtgtattctttctcctgtttcaggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatgtgagtaacaatatttaaaaaccacatgagttaatgtggagggagacagtaaatgagtccattaaataaggtttctatacctggccttaaaatactttaagaaaaaaatatgcactcaggcttcattttggtttacctcatgggtcagccaggtgattgagagccaacgctgcaggggttggtctcttcctgctgtgtgtgtggaaagccttattacagatgcatcaggaggcagcttagtggagtgggttgaacacaggctttggaggaaagctgataccaaatctacctccaggtgtgccactaagagagagctatgatgcctgaggatacacgtagcctctcagccacagggtcctcatctgtgatctacttaatcaccttacttatatattgctcctgaggattacatgagcctactccctgtcttcttagcccctctactttcttttgggataaggtcctttgccaagcctctgtgtagctgggattctaaagagaaagctattgctcctggatgtgtggggcagccagggaaggtctcaggcccctcctttccactcccatagacagaattttgggggttttcagggaccagtcagcatggaggtcacttccctagctagtggtgaaaacatgaagaccaggactcaagatgggcagcacaaagaaatccaaggagagtggagttaggcttaagccacagtaggaaaatggagcttagcagagcaaggcatgcaacttgcatgcaacttgcatggcaaggctggtggccgaggacccaggactgcaggcttccgctgagtatgctgcatggttctgtcatcttttgcatagttttctaggaactctgaaaaccaatatatttcagtattgctgttgacgtttctgggaacaggaatccacaaaattcactggagaataaatggaaatgtattttttgagaaattagaaatatcaacctaatttctgcctggtgtgatgtttttattttatctaatgatactgctctttgcccaaagtgaataaataaatcactgacttggtgtgggactggcccacattgccaagctgtcctttttctcaatgatgaatatttttactcagagcaatgactgaaatcagttttcttgtgaacacagctgtagctgcaaacacaatattcaactggatagcagtttgattagtagcatatctgaatattagtccctgaccttcatcagttttgtctttaaaaagctttcattttcttcagttgcttctaacatgcatatctgctcttacattagactgctaaaaggagagtttgctagcataatataaaattgacacccattaaacagtttgcagaagctattcagacttgagttggaaattagaagggttcctctacaaattgtggcataggaaatgcattctattaagggcccacttgaaggtgggcatttcttttttctttttctttcttttttttttttttttttttttgaggcagagtcttgctctgttgcccaggttggagtgcagtggtgccgcgtcttggctcactgcagcctccgcctcccaggttcaagcaattctccctgcctcagcctcccaagtagctgggattacaggtgcctgccaccacacctggctaatttttgtgtttttaatagaggccgggttttgccatgttgggcaagtgatccacccatctcggcttcccaaagtgctgggattacagacgtgagccaccacccccggcccaaagatgggcatttttttatccttgaaagagtctattttgttagcagcatgaagtaaaaaccagctgggcacggtggcttatgcctgtaattccagcactttggcaggctggggcgagtggtttgcttgagcccaggatgagtccagactgggcaacataatgaggcttcatctctacaaaaaataataaaataataacataaaataatagcataaaattaataaaatggcccagaaggctcatgggtgcttccataggccacataggtgctgtgctgcagttttttttagcagggaataccacccatcgtgaggtcttttttatgcctctagatttgacatggcatggtttggctttattccttctctctggccgaaaagtccactgtgaaagctgagctagatgaacctagcaccagagtcatcctccctgcagtaatggatttggggttttcccttgtggtttttattgattggaattgtttctctaaacacaaatatttatgttgtgatttaagctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaaggtcagtcccttgttctcactgcaatcagcctttgcagctgatggaggaggcacagacgtgtcccacagcaggcactgttgtggcttcccacccatctgccatagcctccagcgttgtgttgcctaattctgccccttctggagctgctcagtcacacctctggacaggcctgaggatgcctgatttatgaaggggtcagaaattctcctagccttgaattcagattatgtcctgcaatttaggcatcattcatacggaagacaattattttatgattcaagattggggcatttctgcagtacacacaaaaggcccaaggtgagataaggtctcagtgctacagttaatttgtatattctttttaatataatctattgaacttactttaaaaggaacggaaagaggggaaaacaagcaatccaaaatgtatcagagagagagctggagttgaggatgccttgctgattttctgaaaatcaagttaacttttctaggcagaatggccacagtctgcagtcatcctggaaagccctgggggatgcatctgcatttcatcctgtctcaagctgtaaacctgactttatgtatatctcattgcagagagacaggggtgggggttctgcttagtcactaagcggctgagtctacttagagcttttctactattcagacagcttcacaaatgtggaaggacaggtaaatgcagcatgatcatactgtgcataaaatgttggaagctactctgagtttctttatgtcttaaatagacaaacaggtcttcttgatccagggatgcttgtgaacatccagcagcctttgatacgtgaggatggtacagttctcctggccacggattctaaggtgacgttctctactcatgctctctctcatcctttatgttgacattgcaggctgcttctctaactgtgtgcaccactttcttcctggccttcagagaccacatcaaaagcatgacctatgtctcggtctccttattgttgtgatagctatcttgtgatttgttttagagatgctgatggcttctcagatcagagctggctggtcataatcactgtaacatgtcagtctagatgtcaatttggtggacattcagtggttctcttttctgttatagttttctttttctcttatacacattggcaaactactagccaaggaaagaaatacttatcagatggcctttttgcaaaagccccgggttcctttttattagatgatcttcaggaggaagctcagccaggaatctatcagttccaaaactttgctagagcagatcagtcatagggatttaacttgtggacagagatgttcgtcagtccaaaagggggagacttgctggctcctgtgaagataaccaaggagggggattttttccaggccagggaactcactgtttgtctcatcctggtgctcctgatgtaaaccaagtaatgaggaagtagtagcagcaagccacaactctaagagggtgacttggtaattgagaacactggcattgctgcaaccattagaaccagagcaaggcctgcaggcttcctcctcatctgttcacagtctcattcatgggtgtactcagggcattacagggcatcctcttttgggaaagagaagacaaaatttagagcccttgcctgtcatggagagctgccctgcatgccttggtcctcaggctgggccttgcaccttctgtctttgggcaggggccacatgcatgatgggagctgatggatcacgcatcgtgggcttagcttatcagcagcacacattctagaacagtggctctgactgcatggtcaaatgcagagaaagcgtaagcctgaaagtaaggcccagataaccttaaaaacagattaccaagggattcacagcaaccattctattgggccatccacacacagactgggaatgagaaccaagactccagaactggctagaactgggttcagagtctgacagtgctcttcgtagccacatgcttctttcctgcacttgtaaatttcttggtacacagtgagcattcaataaatgttaatggttaggaattagttattgtcactttggaggagaatgaccacaaagctgtatggtatttcaggaatcaagagaaagagcttcagaggcagactgtgtcctaccccattccttcctgtgtacaatggaaacaacaataccccccacagaagtttgatacgaataataaaacatatgcaaagcacccacaggaagctactttcagaaactgttttccaattttactttgaagtaattatacatttaaaataatttactatgaaggaagtacagtgctattacagagctcccacatagccttcgcccaggtcctcccagtggttatgtcatacatacctacggtacagtatcacaacgaggacattggctttggtacaaaccatatgtattgttctgtcttttttatatttcactcttcttcaacttcatttccttcaacatacctttctgttaatgaggatcttacagtagctgcacagtattctatgtgtctgttgtgatttaatcatttctgtttatgaccttttctactgattctagtttttcattttgtaatcaagacataaccttgtgtgtacatatcttggtttgagtatatctctggctttcttttctttttctttttctttttttttttgagacagggtcttgctctgttgcccaggctggagtacagtggtatgatcttggctcattgcaacctgcacctcccaggctcaagcaatcttcttacctcagccttccgagtagctgggactgtaggtgcacagcaccacgcctggctaatttttcgtattttttttgtagagacggtgtttcaccatgttgcccagtctggtcttgaactcctggactcaagcaattcacccaccttagtccctgcagagtgctgagattacaggcgtgagccactacccctggctttcttttttaattgaaatataattcacatgccataaaactcacccttttagtgtataatgtagtggtttttggtatatttacaaggttgtacaaaccatccccactatctagttttagaatattttcgtcacctcagaataaaccccaaaccctattatgtagtcactcctcctttccccctcttctcaaaccctaccaaccactaatctgctttctgactctatggttttgtcaactctgtacatttcatataaaggaaatcatacaatatatggtcttttgtggctggcttctttcacttagcatgatgtttctaagggtcatcatgatatagcatgtatcagtacttcattcctttttattgccaaataatgcacctctgtttttttttaaagacaagagtttcgctcttgtttccttggctagagtgcagtggtgccacctcggctcactgcaacttctgcctgctgagttcaagcaattctcctgcctcagcctcccgagtagctgggattacaggcatgtgccaccatacccagctaattttgtgtgttttgttttgagatggagtctcgctctgtcgcccaggctggagtgcaatcgtgcgatctcggcttactgcagcctccgcctcccgagttcaagcgattctcctgcctcagcctcctgagtagctgggattgcaggtgcgtgccaccacacccagctaatttttgtatttttagtagagatagggtttcaccatgttggtcaggctggtcttaaactcctgacctcacgatccgcccgcctcggcctcccaaagtgctgggattacaggcgtgagccaccgctcctggccaattttgtgtttttagtagagatgaggtttcaccatgttgggcaggctggtctcgaactcctgaccttaggtgatctgcctgcctcggcctcccaaagtgctgggattataggcgtgagccaccacgcccagcctaataatacacctttgtatggctataccacattttatttatccattagtcaattgatggacatttgtgttgtaccactttacattctcaccaactgtgtaggaaggttctcatttctccacatccttaccaacacttgttattatccatctttttgattgtagccatcccagtggatgtgaagtggtatgtcattgtgattttgatttgcatttctcatgatgttgagcatctcttcatatgcttatgggctgtttatatatcttctttggagagaagtctattatctttggggttttgttgtttcattttgttattgagacagggtctcactctgtctgataggctggactgcagtggcacaatcatggctcactgcagccttgacttcctgagctcaagagaccctcccacctcagcttcctaagtagctgggaccacaggcacacaccaccacgcctggctaatttttttactttttgtagagacagggccttgccatgttgcccaggcttgtctcaaactcttgggctcaagggatccttctgctttgccctcccaaagtgctctttttcctttttttttttgacatggaatcttactctgtcacccaggcagtggcacaatctcagctcactgcaacctctgcctcctgggttcaagtgattctccttcttcagcctcccaagtacctggggttacaggcacctgccaccatgcctggctaattttttgcatttttagtagagacagggtttcaccatgtttgccaggctggtcttgaacccctgacctcaggtgatccacctcccttggcctcccaaagtgctgggattacaggcatgagccactgcatccagcctctttttccatttttaaattgggttgtctttttattattgagttgttagcgttccttagacattctggctactaaaccattatcagacatgattcgcaaatattttctctcattctgtgagttgtccttttgttttatgggcttttactttcttgacaatttcttttgaagcacaacagttttaatgaagtctagtttatctgtttttgttctgtcattttgtcacatatctagatttgtgtaaataccaccacaccaagatacagaactgttaaatcactaaaaagatcttcctcgtgttgcccctttgtagtcacacttccctctcctcgaagctgtttttgaaccagcattataacttcattggcctgagagtcatttgcgtatctgtgttcatttttaatgtcagtattttttgtttaataggctgaaacaagccagggagctctgggcacactggcaaatgtagtgacctcccttgccaacctaagtgaatctttgaacaacggtgacacttcagaaatccagccagaggaccagtctgcaagtgagataactcggtacgagcccatgaggatggagtctcccctcctcgcctggacaccctccctctattgtgagggtggaaaacagcattttggtacctgtgctgtatttaactaaggatgataaaattgttacaatgaccctgctcatctgtcttctttcaaattttaactgtgggaacatagacccacctatgttatacagtataaaacaatcaaaacttcttttcattcccaaccatggaaaaggaaattgagtaaatcagtagacataggaggaaaactctagtggacagcggttatttgtattaattactgtttaataatgcgtctgcatattaagagttcattccctttcctacttctattttaacctatttttctcatctatatttttcttttttctttttttttttttttaatagagatggagtctcaccatgttgcctaggctggtctagaactcttgggctcaagtgatcttcccgcctcagcatcccaaagtgctgggtttacaggcgtgcgccaccacccccacccagccctcatgtatattttttctgagtaatgaattcagagcttaaatccaccagggtaactagagtgatagtggctgatagatagtgatagtatgagctaatgccagatgccgataactgctactaaggatgtttcttctctgcagtttggctcttgtgctctgctcctaacatgccagaccagccagatacaaagctggagactatacaagtgttccagtcctttgttcacttgtggtctgataacaaataagatctaggtaccgtggaaagtgggtgggatttgaattaggtagaattctggttctaccacttactatatggatggtcttggaaaagttatttaacaactgtaagctcagcattcacatctgtaaaatggaagataatttttaactttggagggtacttgtgaaaaatagaaattgggcctaggtgcagtggctcacagctataatcccagcacttagagaagctgagacaagaggatcacttgatcccaggggtttgagaccagctgagacccatctctgaaaaagtaaataaataatagatagatagatagatagatagatagatagatagatagatagatagatatagatagaccccatctctgaaagagagaaagaaaaagagaaagagacaaagagaaaaggaaggaaggaaggaaggaaagagagaaaaggaaggaaaagagagaaagaaaagaaaagaaagaaattgtccatgaagttagataatacatagctcagtgcctaagatgatgtgtagataatacatacaagttttcattgtttgccggatgcagtggctcacgtgtgtaatcccagcactttgagaggccaaggcaggtagatcacctgcagtcaatagtttgagaccagcctggccaacatagtgaaaccccatctctacggtagaatttaattatcttttcccactgtagtttttctaaatcatagctagaattctgttccccctaaaagctgtagattcacaacaattacatgcttcatttttgctcacagggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaaggtgagtgaattcagcctaaccatgtgcccccaacctgctgggggataggttctgtaccaaagccgatctgcagttttaaaaatcaaaccttggggccaggcatagtggctcatgcctgtaatcttagcacttcgggaggccaaggcacgtggatcacttcagctcaggagttcaagaccagcctggccaacatggtgaaatcccatctctcctaaaaatacaaaaattagtcgggcatggaggcgcatgcctgtagtctcacctactcaggaggctgaggcatgagaatcacttgaacctgggaggcagaggttgcagtgagccaagatcatgccactgcactccagcctgggcaacgagtgaaactccacctcaaaaataaataaataaataaaaattaaaccttggagtgagctcatcttcaatctggtatttaacattatgacttcaaactggatcttgtattccagaatgatagtcccattatgaagcatcttcacttgtcttttgctcacagtgccatttggttctgaaggtaaccatgaagcaggcgtggcccatcattactaagacaggctgacatagtggtaactgctgagggctgaatgctctgcctctgcctctctgtgactgcctggctgccccatgggctcaggcaggcacttttgtctcttctctgtgtcatagaaaccctcatataaaatctacaacaagcaggcagccagccattgatcctgactgctctgccctctagagccacagaaagtagatcccttgaagagtgctgttaaggcctcatgggtgttccccgtgctgtcattcactggtctcactttttctacaggacactcagagggtacctgaagccctctcagtctctaggtctccagactgctgagtcctccttttcccccagtattttttttttttttaaacaaatacataggctgaagcgtagtgatgtgattgtggctcactgtaacctcaaactcctggtcttgaactcctgggctcaggtgatcctcctgcctcagcctcccaagtagctaggactataggcatgcaccaccatgcccatctaatttttatttttattttttgtagagatggtgtccttgatatgttgcccaagctggtctcaaacacttggcctcaagcaatcctcccacctcagcctcccaaagtgctcctgtcacatgagctgcttagctcttacttactgctaccttaagaccatctcccaaaatgcctgctagtccatgaagttggcccctgttacccagattttttttttttgagactgagtctcactgtcacccatactggagtgcagtggtacaatcttggttcaccacaacctccacctcctgggttcaagcaattctcctgcctcagcctccgaagtagctggaactacaggtgcatgccaccacacctggctaatttttgtatttttaatagagacagggtttcattatgttgcccaggctggtctcgaactcctgacatcaggtgatctgcctgcctcagcctcccaaagtgctgggattacaggcatgagccacccgcacctggcccctgttccccagatttaatttagaccttaacctatggctcaaaatggaattgccatagaacaaataacagtttagctgaggcaagacttgaggagtatgtttttgtgggggtgggctgggaagatccccttaggcttatggaccacattccaaggcccattagaccctagttcactgagcaagaaaacatggggagtccgtgcaagccccccgactgcatgggacttcagaatcagacagcaactctagatgccactgctattgaagcatgacagggatacatgttgacagacaaagccatcccctgtccttccttcacctcctgtgccatgtgcctcctcttttccagctaacaatgcccagtccaatgccagagtacctcaacgtgcactacatctgtgagtctgcatcccgtctgcttttcctctcaatgcactgggctcggtcaatcccagcctttcaggcacttgggtaagtggcctcttgctgtgcatgtatcctcgggcaggagccttcctctccctaggaatgacctggaagaactctgagggcctgtctagtttgactgtttctatgacctcattcaaaggaccctgagttttttattaaatatagttagtggactggtagcaggattaccagttgccagttctgcaatgttcctctaaactttatggagcctcctagatacaccaaggatttggtgctaggagctggggatggagaagaatgtagaaggcaagggtagtccccagcactgtgctatgcacagtgtgactcaacaaactgaagccaggccgggaactgtgcctaggccttaataaggtgaatgtgaatcagctgtttcctcaaacatggatttacaatctcacacaagccacagtgccaattggcacattgagtagtacagaacctggtgtcatctctacaggaaaccccccccccttttcttgctttcttgagtaccacttgtgtatgtttctcctctaaataccagcatcggctctgccagtgtgccaagtgctgtgcagctggtgcagctgccaccgtgccatcaggtggctggcagtctggttgaaagataagtaaccatataaaaatggaaatacaatgagagtcattgcatattgcagagtaaccatccttaggtaatatgtggaaaacactagaatggagggcagggttgtctagtagttgacactattgtctttggggcaaacagacctggttgtcgggccataagaatagtgcttgtcagctgtgtggccttgtgcaagtcactttacctctctgagcctccagtttctcattgtagaatcctcgcgtgggtttcagatctataaagctcttaacccagtgcctggcatgcaagggactcagcagaaggcagtgtggttctgtgggtcaggtggtgtgggatgtgtcctgagtagttgttagaatggtcacctccctccatgattaaaggaaaggcagtcagaattgtcccattctccagggagaattagacaggtagtgactgctaaacaagtattaggagtttcattgttagctctttgggagaatggcctaccccttgctactatctggtaggtggtgtaacctcaggctttttttttttttttttttttttttaaataacaccacagtccacagttaatagtactgataggtacctgagattttttaaatgaggttaaaacattgttacccactgccctgagtgtactttttctagttgggtaatttggaacctcctccacagagtttctcagtccgggctagataaaatgtgctaccacatttaaagtggtttcatttacgtttcatgtactgtttttcataagttagtgttcagggcagtgatcatagtaaaatactagatgtgcatctggggcatttgggaatgacccagtgcagtagccctggttctcactgccttcctgtggctgggccacacttaaggcaactggaagaaacagctttgtcaagacagcccagtttctccggcctcctgaaatcttgagacaggtgagggaatgcaatttaggggtttctgagaataaggatgtattgttttgtgatgtgccaactttgctgactaactgagtagaagttagccagggcaaggctggaagcggccttagctggaccctcatcctccctgcttcagtctcggatccagcacaaagcctgcctcctgccctgcagggttgcagggcatgtttctgcccttcagaatctgtactcatctccgtcttttggtccccgtagcctctcatgaccttggctgcaggacctaagtaactgataccatctcttgggacagtcagtccaggatgctgaggcttttgaaggctgtaggtaatgatggtttggccatacctattaacatttttttattatttaaagaatgttttttaagagaatagttgatcattagaaggattttagttaaaacattcatagacttattcatagacttcatccttttcttgaagaatgatcctggatagcacttcaataaacacttgctgaattcacctgtttgggaaatgctgggacttagtgcctggatgccccacaaccttggagaaatgccaacacacaccacactcagactcctttctatattcctaggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaaggtagggcacagggacttggggctggggtgtgtcttggttcagcctggtggccatggagcagagcccagccccctggttggaggctcatgtcaaagacacctttgttgacccaggctggcaacatagcaaattggatagcctcagtttcccacagcatccataggctgagagaagtttgactgttaaggtatggaacctttgggctgggcatggtggctcacgcctgtaatcctaacactttgttaggccaggcaggaggatcacttgagcccaggagtttgagaccagtctgggcaacataacgagaccttgtctttacaaaaagtacaagaaattagccaggcctggtggcatctgcctgtagtcccagatactcaggaggctgaggcaggaggattgcttgagcccagagtttgaggctgcagtgagctgtgatcattccaggtactccatcctgggtaatagagcaagatcccatctcaatgaatgaatgaatgttaggaggcttatcagtcagaatatgtaaatttctgccagactgccctcttcatacgattaatatgaagaaaaaaatggaaaaggtcaacttcttgataggcatttagtgatgttttcagaataatcacagctgatattttcatcttcattgacaggttacttttctcatgtataatagttcacagatcctcacaaccctataaagtagggactattacctcatttttccctatggaggaactgaggccctgataaggtccctggcttgccccagatgaaacagtaagtacaaaaactagggcacaggctgggtgcagtggctcactcctgtaatcccagcactttgggaggccaagacgggggatcactggaggtcaggacagtccagcttggccaacatggtgaaaccccttctctactaaaaatacaaaacaggaggctgggtgcagtggctcacgcctataatcccagcactttgggaggccaaggcgggtggactgcctgagcttgggcgttcgaaaccagcctgggcaacatggcgaaacctcgtctctactaaaaatacaaaaaattagccaggcgtgatggtgggcatctgtaatcccagctacttgggaagctgaggcgggagaaccacttgaacctgggaggcggaggttgcagtgagccgagatcacgccactgcactgcagcctgggcaacagagcgagactctgtctccaaaaaacaaaaattagccgggcatggtggcgcatgcctgtaattccagctactcgggaggctgaggcatgagaatcacttgaacccaggaggcagaggttgcagtgagccgagactgtgccactgcactgcagcctgggtgacagagcgaaactatttcaaaacaaaaacaaaaaaaaaactagggcacaaacctgcaccatgctgaccccctagtccaggacatacgtacctcacccaggctgctccttaagagtgaacaaacaacttttctagtgagatctgtggcaactatctagtatttggtgttcaaaacaccagcagtgtcaggaataggaggcagccattgtagtctctccatgtgtagcatgtctgcaacactctgaagaccactgtcatgcccaggattcgaagtaacactgaaaatctacacttgtagctgaagtggaagtttttgttgttgttgttttgtttgtttgttttttgatacagtctctctgtgttgccaggctggagtgcagtagcaatcatagctcactacagccttgaacccctgggctcaagtgatcctcctgcctcagcctcccaagtagctgggacttacaggcatgtgccatcacacccagataatttttatattttttaatagagatgaggtttcgctgtgctgcctaggcttggaatttcacttttaattgggcattccaggtgtttgatatctaggaatgtgagtgacatagtcatacatttgtttttctagttatttccttggaatagttacataagggtgaagtttaaaagaccctataacaggctgggtgtggtggcttacgcctgtaatcccagcactttgggaggccgaggcaggtggataacttgaggtcaggagttcaagatcagcctagccaacatggtgaaaccctgtctctactaaaaatacaaaaattagcctgacatggtggtgagtgcctgtaatcccagttacttgctaggctgaggtaggaaaatcgcttgaacctgggaggcggaggctgcagtgagccaagattgtgtcactgcactccagcctgggacagagtgagactcaaaaaaaaaaaaaccccttacaacattttattgaagttaagatttgttcacaaatgagctttagttttgttttttgttgtgttattgttttttgtttttgtgtgtgtgtgtgtgtgtgtgtgtgtgtgtttttgttttttgtagagacagagtctcatgatgttgctcaagctggtctcaaactcctggcctcaagcaggcctcctgccttggcctcccgaaatattgggactagagaggcacgagccaccacaactggccagttttatttttaactgagtataatactaatactgccagtaaaatattgtcatgaggattaaatgaaataacatataaaattgttctgaagccaggcatggtgatgcacacttgtagtcccagctcctcaggatgctaaggtgggaggatcacttgagcttatgaattcaagttcagcctgggcaacatagtaagacacccaactcaaaaaaaattgttttgacaactaaaaattaccagcatttaatgttcaggtgcctgcagagacttaaaaaacctaaccaagtatataagctgtgagtcttcagaataaaggaattattactcaggtacacaataaaagaaattcacaatgtacacctacaggccagctgcctggcagcagggtcagggagaatcactggtctagggatttgttattgaggcagaacccatattggagcagaatttgggtacctcttgtcacttcatctgcagctggaaaatgaagctcttgttcaccttgagattactgatttttcattaaaaagtgaaatggtcccatttctttccatatgtggcccctcaaataagctggttttattgttcttaccagcctttctcaggatctgtgatgttggtttctagataaactttctggtgaccggataaagcaagtcatggagcacatctggaagctgcaggagttctgtaacagcatggcgaagctggatatagatggctatgagtatgcataccttaaagctatagttctctttagccccggtaagatatgcggtggggatgcatgacccctttccacctgtatctactgatgtttctgaacgtgaacatgttgtcatcattggtgtagaaagagccctgcagattgtatgtgacctagtgttcttatgataggtgttttgctagataaatacataaacgcttttaaattcttgcctttacagccccaaagaaatatgctgcagtgcctgatgatgtcacgcactgaatagatttaatctgtgtcctaattaaaccattggccaaacaagactacaccatacaaaagtgtgctgccacccgatgtcctttcttttttttccggccctttgccagtttccaagttttgttagcgcatataatccagtacacattgaagttccacttgtttgcccacagactgtgtatagcactgcagagcatgctaaaaggtatgttcgcaggagatgaagaggcagcaatcacgatgcctgggctggcctcactccccttattaactgttctctcaagtcctctggaaaagtcacttaggctaattgttcacctcacagtaaggggttggacacagcttaacctttttgtcttccttcccagcccttcactcacaaacaacaaaatagctaataaaattgggacaaattatataattatttagaaagtaaatgacaatttgtaattttatgtgatagtttttaaaactatgtgttttctagggtagtaggaagccagatgtccagaaccaatcatgtggggctgttcagactgggatccactcagggtccccgacccgctcccaggaacttcaggcctgggcagaaaacagaggaaaagccagtgttctaataatacccaaactagatcagtctttgagttcaatttgttgtacttaagaagtttgcagaagtttgactaaaagtactaagaagtctacaagtgagacttttcaaatacagagggaactgggggggggtacttttctgttttcagatcatccaggtttgaccagcacaagccagattgaaaaattccaagaaaaggcacagatggagttgcaggactatgttcagaaaacctactcagaagacacctaccggtgaggcattcaggcatatgcgctcttgcttggggctgcaaggagtgtggctgagtctgcagtttctaatataaattatgttaacctttccatttttagcagcctgatagagcctccattggatcacactctaattcttgagttttctttgttttttccaagctcccaagagctagagataattcttgaatgctagaggtggtgtagagtgtagacagtgccagcaggagggccaggactgtggctgattccagttttgctgtgtgactgtgagcgaggcctcagattgctactctttaattggaggagttggaacagatgctgtgtggcctgttctggggctaacactgtacatgaggcttgagttctcatggagattcctttgtccagaatagtttgaaaggtctgctcctctggtcagcatccattgaagaggcagtgctagagtacttgacagaaaagtgcttattgacagaaaattcttattgacagaaatcaaatctgacccctataaaggagtggatgagttatataaagtcattttaccctcagataaactaatggaaaaaagtttgtttgggtgcaaattagtggtattatttgtaattaatgtgcagtaaaaatatgtgtataaaaattaggaccgggcacggtggctcacgcctgtaatcccagcactttgggaggctgaggcgggtggatcaggaggtcacgagttcaagaccagcctggccaagatggtgaaaccccgtctctactaaaaatatttaaaaaaaaattagccaggcacggtggtaggcgcctgtaatcccagctactggggaggctgaggcaggagaatctcttgaacctggtagggtgggcagaggttgcagtgagctgagatcacgccactgcactccagcctgggtgacagagtgagactccttctcaaaaaacaaaaaaaaaaacaacaaaaaaaaaccctttctcgtgcagctttaggcaggaaaattgttcagatctgccaaaggtcagaatgcattggcaggctttccagccaaggatggaagagtgctgctttcctatgacaacttctgacctaccagaagctacatgaatttctgagaccctttcaagtaaagtatttcctgtttccctccccaccatgtccccctaaaataaacattggaacaaaattgacagcctgggaagacacacaggcccaccttcccgacatgtgtcctctgcacagacctcagtctccaggagccccatggaacacagatgcccctgggggctaccccttctggcccagtgcttctcaaatgattttgccccccagcagggtaaccagctcttagtctttcagcactaaaaccaggacagtcccagtcatttctctggtgtgactgggggtgtcttatggctggctggtcctgctggtagacaagagcctgcttctccttttggcgcacttctattgcccagatgtggcttttacaaaagcaagatccattttctactggaatcattgaagacttcatcatgaatctagaataacttcagcctcaatacatagagaatgggactgtcagggaatgcatccacacccagaatttatacatccagccaggtatacagtcaggttgtcctcctaggaggccacaggcctgctcccccacagttcccatggccaaaagatggctggaaatggccctctggggctactggcagagccacagcacactcgagaatcactttgacagcagtgattctgtggccttggaaagtagatacaatgtgtctgaaaacatcatgagtcactcctgtccagtcagggacccagggttgggtagggtgacgacaggttacttggagcccaaaatgataagggaggctttcttatagggctcagaaattcactcgagatagttctcaaagaaaagggcctagagtgttttacatcctgtttgcatattcattttttctttatcttgatatttactgtctggaatatccattttttactcttccccatccttgtgccttttctcatattgattattcctcctgaaatgcctcccatccctccccattctttgtatctctgctgatagaaatcttagccagcccctaaggcccagctgagatggcaggtcccttacaccttcgtgtgccctgcaagattggagcacagcgactcattgtggctgagtgaatggatgctggtgctggaatgctacctgcatagtatgaatacattttcccattttaaaaataagcagtattcactctagaaaaatttagaatgttctagaaaggaaaaaggaaaaagaaaactttttaaaaagcactatccaggggcagggcgtggtgactcacacctgtaattccaacactttgggacactgaggcagcaggattgtttgagcccaggagtttgaaaccaccctgggcaacatagtgagaccccatctctatgacaaaaaaatgaaaaattagtcaggtgcggtggtgtgcacctgtagtcccagttactcagaagtctgaggtgggagactcacttgagcctgggaggttgcggttgcagtgagctgtgatcacatcactccactgcagcctggatgacagagcaagacactatctcaaaaaaacaaaaacaaaaaagcactgtccagatacctactattaacattttgcgtattcacttccagaaattttttatgtattgtaattgggatcataaaataccaaaggttttgtaaccttttttcatgtaatatacaataacaatacgtactcttcttcattttctatggttcctatttccctgctaatgaaaaggtagggtgtttccggtttgggctgtcacacatggcactgcagtagagtcctggcacatgctccacttgctcacctgagatccagtcctggctggggaatggcctggtcacgtgggacacttgagatacacagtgttcagtggccctccagggcagcattgtggtgcaccctccaccccaagtttcttcaaaatgaaagctattttactgctttatttataatgctaaatgaacactggaaattagagcagtacaaaaaataagaaaaaatcacctcaaatcccaatacccagagcccaactgttagcgtggtgaacattttcccaatactttatatacacatctatacttgctgttttataatctccttttaaacttttattgagcaatatgtcatggatgtctttcctggtcagtaaatacaggtttgtattatcgttttttaaatgagtctctagcagttcatcatatgaagactcctactttagtctgtcctctgttgatgaatttccaggttttctcttggtggtgggggtgaggagagttggaataaacaagagtgaagggaacacatctgtacatacattttgtactcatttggttttttctcatgataaatttctataagaggaactgttgaaatcagaaaagagaggtgggtggatggtggatccgtttggtttgattctgtgcaatacagacgggaccccaggagcctttgctgagctgtggttgaagggcatcaaacagtctccttttctaatgacactcccttttatagattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaatagtatgtgtgtatatatatatataaaaaagtccttggaattatagatactaattaccagggtaataatattagcactttctaagcacttatcaatgtgtaacgttagcaacatcttgcctgtgggcagggcaaatggaaaactgtgtatgtcttttgccgaaatgctaatgatttctgtgaaaactcactagggtacaggagacaatcatttatgtttaagaaaagaaggcatcattcctaattgtgtgcacatgttgtggagttgagctgaattctgtgaatggaaacgtggctcatttgcatcatgcagtaagtgggagtgtggtagcacagtcggtggtgacccagttcagaagcttctagccatagagcagacacttgtcaggttccctgactacttggtcctggtctctgatgggcatctgcagactcctctagaacctggggttctcctttgatgactggttatctgaattggattgcaactagtcagacattaactgccaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctccatcataactgtgaggctggattggggctgggcaggagcctgctgccgcctggcgagagtggttagggcctggtaaagctggatggaaggtttcaggacaatttcttcctgttgaccttaaataccagagattttaaaaatgtgtatagactcagcatctctgttggcaagtctgttaatgttaccagcacactgtgcactttggttcccccaggtgtgtgccagccgaccaccccggagcattttaaatgcaggctgcttgctccttaaaaacaaccctcaatttccagggtgatagtctttctcctcataaattgtagcaaccagagtttacagcaagaacagtatgcgcttaaaaggaagttatgtctaacttcaaacacccgtaaattcccacggatgtgaatatatagcaagcttttcctgtttgagaacagtggcatgtggaagacccggtcaattgctttgtcttttgctttttaaatagtccagattaagaaaatacaccctgttgggttaaatttgcctctcttgatttgttaatcagatgatatccaaaaagatccctggacactcccctgactcacaggtgctctgatctggctcaggctggcgccacatgtgctccacaggggtgcagtctggccagctacagacgcccctgtggtgccacattggacagaatggaagctgctgcaggctcaaggcagaacaggatgcttgatcctgaagggttagcagcactttacgcaagtcagtgttagtagggtaagtgggaacagtgtttccaacttctaaattcttgtttggatttaattatatcattttataattcttgccttggcagcaaattttggagagtagtgggagtggccattataaaatgatggaaaggatttaattttgccagcttaaagtaatttttacttttctaaccctgatgtgttttcagtttcaaaattaagacaaaaaaccagctgagacaatggaattagggcaggtttgtttcatttctgcttgtgaaggcttttagtagcaggcatcctgcagctcagtggtgcctctaacacagattgttgcctgc

SEQ ID NO: 15382 - DNA, 37292 bp, Human
  misc_feature (1)...(37292): n = A,T,C or G
ctcacaggcaaacctgctcacgtaatcctgtttttgagatagagtcttgctctgtcatccaggctggagtgcagtggcacaatctcgactcactgcaacgtctaccttccaggtttaagcgattctcctacctcagcctcctgagtagctgtgattacaggcacgtgccaccatgcctggataatttttggtatttttagtagagatgggttttcgccatgttggccaggctggtcttgaactcctgacctcaagtgatccaccggcctcggccacccaaagtgctgggattataggcatgagccacaatgcccggcctaatctcttgggcgttgaaaggcctttggttgtaaatctaccaaggcaagctctccttcagtttatcttcctcccaccagcaccagccactcatccacatcttttgtcctaaggctctgtgcaaccccaggagccttgcacagatcctcaatctgagcccctggaaacttgctatcaaaggcacaatttctgaaagtgcaggtggctggcagacggaaatctctgctaattccatggtgtgatatggcaggtacacaggtcaaagcgccaaccactgaactcattgagaaagccctcagacccagtggagtctagtgatgtcatgggggagtcagaaaggtcaagggcaatatgtgggaatggcccagcccattgcatttttacaacttctaatcagcatcagtgagaaacccttccttgcgtggcctgtgaaccccgcctctgatgctgctggagcactttcatttcacttctcagcatcctgtgggtgtgtcaggtctcagaaagactaagtggccctgcctaggtcacgcagctggtgacgggaggcccagaacttgaaatcagggccgagcccagcccacttcccaattccctgctgtgtcccatgaccagtagcacgcgtcagaggctttcccaaaggcctccatgtcccgcctgttggggaagcccctggctttctctctgtctgggattgactctcagctctgtcctggttggagagaagagatttccaggatggtacccagacagtggtggaggccagagtctggcaaccaacgagccttttggacaattgggtggggagttgggtcattgggttggagaggaggggttcaagaagaggcccaggggtctcaaatctgtgtcctgtgtgtttcatgcccagcatggcagggaatttagtccaacatcatcaccatcaatatttcctcctgccctgtcaataaacactgattcagtaaaaaccgtattgtaccacgtgcgatggctcatacctgtaatcccagcactttgggaggctgaggcaggtggatcacttgagcccagaagttcaagaccagcctgggtaaaatggcaagaccccatctctacaaaacaatacaaaacttagccaggcatggtactgcacacctgtggtcccagctacttgggaggctgaggtgggaggatcacttgagcccgggggttgaggctgcagtgagctgtgagcacaccactgcactccagcctgggtgacagtacaagcctttgtctcaaaaaaaaaaaaaaaaaaagccctaaaaacaaaagacgaaaactgtatcatttggtgggtaagagctttggaatgggggcagaccagctgcagcatgcattagctataggaccttgggcaagtcactgatggcatctaagcatcaaatgccttcaaagaaaatggtgattttatttatttatttattttgagacagagtcttgctctgtcacccatgctggagtgcaatggtgtgatctcggctcactgcaacgttctcctcccgagttcaagtgattctcccacctcagcctcccgagtagctgggattacaggtgtgcaccaccatgcccggctaatttttgtatttttgcagagatggggtttcaccatgttggccaggctggtcttgaactcctgacctcaggtgatccacctggcttggcctcccaatgtgctgggattacagttgtcagctaccgcgcctggccaaaatttttattgccctcctcagagagcaactgcaataactaaacagggtaatgcttagcatatagtcggcactcaggatttttttttaatgcggatgcagcttctggacaaattcctaggatctccccaccaccccttgcttcctgccccaaccagattgagaacctggagctgtcctggcaggacctgtggagatagggaaggggccggtggggtccctcaccccacaccctccctctgccccccagcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggtgggtccctgccccaagggccctggcctgtcaggtgtggccaggcagggcggccagctggggccggtgagtggttctgtgggtccttgtccacctgaaagccagttagagtagaccaaatgcagatgctggaagtgagggcagaggctccccctgagttccacgcagtgctcagggtcagaggaagacccagcacccgccttcctcgagccagggaagtgcaaatcacaatgttccctctcccaagagctcttgtttcacctcgaagacacttaccagagttgttttggatgtttggtgtagctgggagacatttttttttttaaacagggtctcactctatcacccaggagtgcagtggtacaaactcgacttactgcaaccttcgtttcctgaattcaatagatcctcccacctcagcctccctggtagctgggactacaggtgtgcaccaccacgcctggctaatttttgcaattcttgtagagatgaggttttgccatgttgcccaggctggtctcaagctcctgggcccaagtagtcctcccgccttggcctcccaaagtgctgggaatacaggcatgagccactgtgcccagcgtgggagagatattctgagggagcagagattcatatctacaggcaactacccagcttgagaaaagggaagtgtcccacagaaagttccagccagaggggcctccacgataagagaacttatcttgagggtcatggtcatgtgttcagaggccaaaaattccctgtctctatgaactaagtgattcaccctaattaggtcaacaactgctgagataaaatgataacgaaatcacttgatttggccaaaacacgtccaacagtcaggtgggtgtgggtggtttcagtgactcacagttcaaatgaattaggtgcttctctcccaggaccaactgctcccccggggatgagaaggactgtggccatggtgtagccaataagcagaatggccgctatgtgggccacaccctgggggccctcctgtcgtttccagcagctctgccttttccagacttgttttgttttgttttgttttgttttaacctttcctatggtgctgatccagattttaccttttgtgagagctggcttaaaaatggaaaggagatgggagtgacttcatgaggatggggtttccatcctgggtgatgtaagagttttggaactaggtggggttgatggttgcacagcactgtgtataataacgctgctgcagtgtacgctttaaagtggttatgtggtaaattttatgttacatgtattttaccacaatttcttaaaaacaggaagggctgggtgtgctggctcaagcctgtaatcccagtactttgggagaccaaggtgggaggatgcttgaggccacgagtttgagaccagcctgggcaacatagtgagacttcatttctacactttttttttttaattacccagttgtggtggctcgcacctgtggtcccagttacttgggaggtggaggcgggcggattgcttatgccctggagttcacagcagcagtgagctgtgattgcaccactgcactccagcttgggcaacagaatgagaccctgtctctaaaaataaataactaaataactaaataaataatttttaaaaaataaagtgaaaagaaggcagaggcgagaggatcacttccgctcaggagtttgacaccagcctgggcaacatggcgaaacaccgtctctacagaagaaaaacaaaaacaaaaattagccacgtgtggtggtacatgcctgtagtcccagctacttgggagtctgaggctggaggatcccttcagcctgagaagtcaaagctgtactggccgggcgcagtggctcatgcctgtaatcccagcacttccagaggctgaggccagtggatcacctgaggtcaggagttcaaaaccagcctggccaacatggtgaaaccccgtctctactaaaaatacaaaaattagccggccatgatggcgagcacctgtaatcccagctactggggaggctgaagcaggagactcacttgaatccaggaggcgaaggttgcagtgagccgagattccgccattgcattccagcctgggcaacaagagcgaaactccttttcaaaaaaaaaaaaaaaaagctgtagtgagtcaagatcatgccactgcactccagcctgggcaacagagtgagagaccctctcttaaaaaaaaaaaaaaggaaagaagggaaagtggcgacacccacgtgtaaaactgtcctccctgctagagaggataggcaaagcaaatccaaacttggagttttaacgttcaatttttgtgacactgacattgtcagtgatagggtggcattgttaatgatagagtgaagaaaggctattcactttttcttttttctttttctttttttttgagacggagtctcgctctgtcgcccaggctggagtgtagtgctgtgatctcggctcactgcaacctctgcctcccaggttcaagtgattctcctgcctcagcctcccgagtagctgggactacaggcgcccaccaccacgcccggctaatgttttgtatttttagtagagacggggtttcaccgtgttagcgaggacggtctcgatctcctgacctcgtgatctgctcgcctcggcctcccaaagtgctgggattacaggtgtgagccactgcacccggccaattattcaccttttctttggattctcacagagcagatggacaggcttctctggtccattagaattcagataaggtcagaacaggattttcatgaccacagctaccagttgcaaagctgcttagctccacagggttgcgctgttgcagctacctgtgcccacctgatcaccaggaatttccttgcctgcatttgaaaatactgtggctccggccagggcgcctcagcatccagccctgggagcccccgtgggacctggcttgcagaagtggccgagggtttgggagtataccagggtgacgtcttccctcctgcggctctctgtttaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctgtaaggcttcctcctgccccagctgcgagagccccatccatcactgcagctccccaagggatgcactgccccagctgtgcctggccatcgctgtgaggctcgtgtgaatgctggggggaaggggaccagctgctacctcaaggagccttctgtctgggagcaggcagaggtcccaatcacagaccaacagggaaggcagggaggtacaagggctgaccgggcatcaggaggagtctgaccttgggcaaaggtgactcccaaagtgccccacccagcagccaatagggatcattcattcatttgacaaatttggactgaacttcaagcctctgccaggcacagtagaggttgcaaaatgaatctcataattgttctacatacttgccagtgcaaaaaaaaaaaattgttttaaggaaaaagaaatttaaaatttaaattaaaagaaaaagaatctcttatacatcctgtcccaaagagattgcagtccattggaggtcaaagacaaatacagagacatcaccagataacataaaaagaaagaaatgctgaaagagaagcatgacttgtcctttgactccatgaggagggagggtcaatctcctgctgaagggaacagggaaggcttcctggaagaagtggcagggcttggttgtcctttggtggacatttgcaataaaggggagggcattctggatggaggaaccagctgtctgcaaggacaggaagaaggagatgagtgccatatacacacacacacatatatatatatagagagagagagagagagagagagattaataattttatttgggctgggcttggtggctcacacctgtaatcccagcactttgggaggcagaggcaggcagatcactcgagctcaggagtttgagaccagcctggccaacatagcaaaaccccatctctactaaaaatacaaaaattagccaggtgtggtggcacatgcctgtagtcccagctacttaggaggccgaggcaggagaattgcttgaacccgagagacggaagctgcagtgagtccagatcgcacccctgcactctaacctgggcagcagagcaagactgtgtctcaaaataataataataataataataataataataataataataattttgtttgtctagcatggtgttcttcaaccttttcttcattattggccttcatgttttttctaatggccttctgcctccataaaatgtttgttgttgttgagacagagtctcattctgtcacccaggcttgagtgcagtggcgtgatcttgggtctctgcaatctccacctcccgggttcaagcaattctcctgcctcagcctcccaagtagctgggattacaggcggctgccaccatgcccagctaattttcttttgtatttttggtagagatggggttttactatgttggccgggctggtctcaaactcctgacctcaagtgatccacccgcttcggcctcccaaagtgctgggattacaggcgtgagccaccgcacccagcccatcaaatgttaatgctatagacatactgtatatctgttcatgcgctgcatgtatttccatgctttgtacctaaaaagcaatattattttacccccaggaaccaattgaaaattcctccattgaaagcacatggttaggtggatgggaaaagcccctggctatgtcctgtccctcccagactccattgcaggcctgggcaatctgaaaggacctccatttactgcggagaacttccaatgtgtcccccctagatcatggagcactgcatcaagcagaacaatgccattgacatctatgaagagtatttcaatgacgaggaggccatggaagtgatggaggaggacccttcagctaaaaccatcaatgtgttcaggtagcgccatagccaggcaggtgtctggccaccctccgtcacccccatgcatgggcgcctccaaaggcaactccttgccatcgctgcatgccctgggtgcagcactgtctgtgctctgagcttgataagtgacgtggtgataagtcacccagcagagaagtggccctgctctgggggcgggtctggttgatggaaagggagtacagactccagagaaagtgaaattgcccagctgcgtacaggtggggcatgttcctgcagggcagagtaagtacaagtaccaagcatgagcagctagcagcactgtgggcacacaggcccccgccgcggcctgcactcatgcaagtatatccatgaataactccagaggatagaagtttgacaccagggattcatcccacaggttgtgtgtgtgtgtgtgtgtgaaatcaccgcaggcgtggatattcactgcagagggtgtatgccagccaaagactagaacaagctaagtccatccataggggactggttctagcagttctggcacacccacacgacggaatgccatgcacctggtaaagcgagcggggcagtctgggcatggtggctcacgcctgtaatcccagcactttgggaggccaaggcgggtgcatcacctgaggtcaggagttcaagactagcctggccaacatggcaaaaccccgtctctactaaaaatacaaaaattaactgggtgtggtggcacatgcctgtaatcccagctactcaggatgctgaggcaggagaatcacttgaacccgggaggcggaggttgcagtgagccgagatcgcaccactgcactgcagcctgggcaatacagcaagactctgtctcaaaaaaaaaaaaaaagcagtgcaacttcttatgtgctgatatggagtcatttccaggattcagtatgtgaaaaccaaaccaaaacaaagccggtgcagaacagggtgtgcagagtgccactttttgtggcagtccccaacttaaaccattttttgtctttgcaaggctgcaaaagcaatgcaaatccaggagaaaccgtacttcaagtacccatacaaccattctgttttccaccctcagtacagtattcagaaaattacatgagctgttcacctctttattataaaataagctttgtgctaggtgattttgcccaactataggctaatataagtgttctgagcacataggctggactaagatgtgatgctgggtaggttaggtgtattcaatgcattttcagctcctgatatttccaacttactatgggtttatcagatgtagccaacatcattagataaggagcatctgtatatgtgtataaatatatgcatatgtgtatgtgtgtatatatgtgtagatgtatgtttacatgcctgatgtgaggagaacatctgtgattttggacttctggcatccggaactgtgatagaatcaatttctgttgtttgaagccacgcagtttgtgggacctcgttgcagcagccccaggaacagaataccccatcccagagcacctttgtagggtgtacaaaagaagctgataggaaggagagcttgggaacagggatggggagaagcctggggaagaaggactcctcggccttgaagtctggtggaaggagttgcagaaagtgggtggaagtgagaaagaccatgctctgtggcctcggttttgaccatgaagaaaaaagcaaggccgtccaatcagatgagtggagatgagcaggaggctggaatagagcagctggggaaatgcggaggggaagcctgtggacctggggcagaggacagaccttgggtctgggtgatgcaggactaggggtgtgaaaggtgtttgggaaatgacttgcctcagatcccagctctggggaattcatttcactaccacgactgacttaggggcctgggaagtacctagcccagtcccagcacagcaagaaagaactcttttctgaggcagggctgactcatggtgtgcaagcagggccagtggctgtcagcaaggggtgtgcaggagagggcatggcggggcagaggctgcccttcctgttgccctccagccctgctgggctctaacctcgtatatggaccaccagagcaggatgatgcattagaaatcatccgaggggccgggcactgtggctcacgcctataatcttagcactttgggaggcccaggtgggcatatcatctgaggtcacgagtttgagaccagcctaggaaacatggtaaaaacctgtctctactaaaaatacaaaaattagccaggcgtggtggtgtgcgcctgtaatcgtagctactcgggaggctgaggcaggagaattgtttgaacccaggaggcagaggttgcagtgagccgagattatgccactgcctgggggacagagcaagactccatctgacaaaaaaaaaaaaaagggggagaaattggggaacctcacatccagccttctgctctcttccctctcccctgcagggacccccaggaaatcaagagggctgccacacacctctcctggcaccccgatggcaacaggaagttggcagtggcatactcctgcttggattttcagcgggcacctgtgggcatgagcagcgattcatacatctgggacctgggtgagaagcagcggggtcctggtggcctgggagggctgagggctgggaccagcacaagtggaggagcgggagggaggggcaggaggtcaaggacactcacgcggttggtgcctcaagggaagggcccgcagtcgaggaggaacacactcttctccttcctctcttgtctggtttcaggcagagccaagcagagtcaaatcagaagcaggaaacccccaccaattccagattcttagttcgaggcatgaagacctgaccccatgggatctcaattcttagctcctaaggagcatatcaggccgggctcggtggcccatgcctgtaatcccagcactttgggaggccaaggcaggtggatcacctgaagtcaggagttcaagaccagcctggctaacatgataaaaccctgtctctactaaaaatacaaaaattagttgtgcttgatggtgggtgcctgtaatcccagctacttgggagactgaagcaggagaatcgcttgaacccaggagtcagaggttgcagtgagccgagatcatgccactgcactccatcctgggcaacagagtgagactctatctcaacagcaacaacaagacagagtgcccagcagactgagaagggactcaaggggcggcggaatggaacttgtgcctttgtcccatctgtcctgacacttgcctttaattcatggcctgcaggggcagcgtgtccatttattagcacaaaccattgtctacagaagggctggcaagacacaggcagggacagggtggtggtggcttcacgctctccagcttcccttcgttgtcagcattattaaaataaacatgtaggtgccaggcagagagctaacgcccgacattccaacagctcagcgagttctggcagcagccctatggggtggactccgtcattatctgcagtccacagacctggttggaagaaaccggcagagagttgactttgtgtaaaaactttagtatcaaaacctcgtttcacaccaaacctaggaactggactagaaatataattatcacacacatacgcacaccccaatcctgttcaccaaaaataaaaaccatcagcaaagcccctagggtcaagaatgccagattctggccaaggtggaccagggggtgcaggctggggaaagactggaggggcttccaggcttccccctctgccaccatgcccccgctacccacccgcagaaggggtgaaactggttgatcctgtccttttctttccgggcctggtggggataatttttttgtgctttatagaaaaccccaacaagcctgaacttgctctgaagccatcgtctccactcgtgacgttggagttcaaccccaaagattcccacgtactcctgggtggctgctacaatggacagataggtaaggagggacctaggcttttttatttttatttttattttttttagatggaattttgctcttgtttcccaggctggagtgtagtggtgcaattttggctcactgcaacctccgcctcctgggttcaagtgattctcctgcctcagcctcccgagtcgctgagattacaggcacccaccaccacacctggctaatttttttgttatttttagtagagacagggtttcaccatgttggccaggctggtctcgcactcctgacctcaggtgattcacccacctgggcctcccaaagtgctgggattacaggtgtgggccaccacacctggccgggacccagattcatagtcagagccaatcctgctgctatagggcagagcccacatggcagcctgggctcggccacagaagactaagtggggtgagggcctcccatagctgaccaactgcagacacgggtgaggcaggtttggctgacacctcagcagtgtctcctgttactactgtaagtctaaaattagctcaaaataaacagttttaaaaaactatagttcaagtaaaatcagagaatatttgactaggggccgccataaagggatgatgagagcgttggggagccctattttgggagaggtttctgggaaacctacatgctaacggatatgggtaatactggccttatagaatgagttgggaagtgttcccttctggaagtttgtgaagaattgatattaattttttttttttttgagatggagtctcgctctgtcgcccaggccggagtgcagcggtgcagtctcagctcactgcagcctccacctctcggattcaagtgattctcctgcctcagcctcctgagtagctgggactacaggctcatgccaccacgcctggctaattttgtcttttttcagtagagttagggtttcactatgttggccagacttgtctcaaattcctgacctcaagtgatcctccctccttggccttccaaagtactgggattactggcgtgagccaccatgcctggccgctattaattcttgaaatgtttggtagaactcatcagtgaagccatctggtccctggcttttctttattggaagcttaaaagttacaattcagtctgtttatttgttatagatcctcttcacattttctgtttcttctttaattgcttttggtagtttctgtctttctaggaacttttccatttcatcaagttgtctagtttgttgacatttaattgttcacagtattcccttataatcattttctttttctttttttttttttttttttgagacagagttttactctgttgcccaggctggagtgcagtggtgtaatcactgctcattgcagcctcgacctcctgggcccgagcaattcttccaccccagcctcccgagtagctgagcctacaggcatgtgccaccacactcggctaatttttgtagtttttttagtcacaaggtttcatcatgctgcccaggctggtcttaaactcctgggctcaagggatccgcctgccttggctggcctcccaaagtgctgggatgaaccaccacacctggcctgatttcagtcttttaaaatttattgagacttgttttatggcctagcatattgtctatcctggagaatgttccatgagcacttgagaagactatattctgcttattgtccggtgtagttttcctttttttttttttgggacggagtcttgctctttcgcccaggctggagtgcagtggcgcgatcttggcccactgcaagctctgcctcctgggttcacgccattctcctgcctcagccttccgagtagctgggactacaggtgcctgccaccacgctgggctaattttttgtatttttttttagtagagacggggtttcaccgtgttagccaggatggtctcgatctcctgacctcgtgatccgcccgcctcggcctcccaaagtgctgggataacaggcgtgagccaccgtacctggcctgtccagtggagttttctatagttgtctgggaggtcttgtctatagtgttggtcaagacttctatttccttgttgatctttcacgtagtaattatgtctattattgaaagtaggatactgatgtctgccattattattgttgaattgtctatttctccttcaattttgtcaggttttgcttcctgtatgttaaggctatgttattaggtacatgcacatgcttataattgttaagttttcctagtgaattaacccttttatcagtatatgatgtcttcatttgtctctagtagcatttttcatctcaaagtctgtctttgagataagcactccagccctctttggttaccatttgcatggtatatctttccccatccttttacttttaacctgtttgcctctttgaatctaaagtatgtcttgtagccaggtgtggtgacacgcacctgtaatcccagctacttgggaggctaaggcacgagaatcgcttgaacctgggaagctgagattgcagtgagtcgagatcatgccactgaactccagcctgggtgacagagcgagactccatctcaaaaaaataaaaataaaataaaaaaataaagtatgtctcttgtagattacatgtagctggcatacaagtgaatcatagtnnnnnnnnnnnnnnnnnnnnttcaagcgattctcctgcctcagcctcccgagtagcagggattacaggtgcatgccaccacgcccagctaatttttgtagttttggagagatgaggttttaccatgttggccaggctgatctcgaactcctggcctcaagcgatatgcccacctcggcctcccaaagtgctgggattacaggcatgagccaccacgcccagcttggatcgtggttttttccttttaatctattctatctatctctggttttaagtggagagtttaatctatttacattaattactgataaagtttacatctgccattttgcttttttttcctatatgtcttaaatctttttgttctttctccataactgccttcttttgtgccacgtattttctagtgtaccattttaattcccttatcatttcttttttttttttcttttcttttttttttagagacaaggtctcactctgtcacccaagctggagcgcagtgctgtgatcatagctcactgcagcctcaaactcctgggctcaagcaatcctcccacctcagcctcctgagtggttgggacaacaggtgcacgtcaccacactcagctacttttttattttttaatttttgtagagatagggtcttgctatgttgcccaggctggtcttgaactcctggcctcaggcaattctcccaccttggcctcccaaagtgctgggatttcaggcgtgagccaccacactcaacttaagctattgatcttattgatgatcctgtgtatgtgatgagtcatttttctcttgctgctttcaagagtctctgtcttcagctttgattatgatgtttctaggtatggatatctttgagtttatcccacttggaattcattgagtttcttggatgtgtagattatttttttaaaaatcaaatatggaatatttacaaccattatttattcaaatattctttcctaccctttctctctctcctctccttctgtgacttccattatatgtatgttggcatgcttgatggtgtcccataggtctttagactctgtttttctttgttctcttttctttctattcctcagactacataatctcaattgacccatcttcacgttcagtgattcttctgcctgctcaaatatgccatcctgtagcttcgctgctatatttttattttggttaatgactccagaatttctattttgttctttcttttaaaaataatttctgtctcatttggatgtggtggctcgtgcctggaatcctagcactttgggaggctgaggtgggtggattacctgaactcaggagttcaagaccagcatgggcaacatggtcaaaccccatctctacttaaaaaaaaaaaaaaaaaaatcagccaggtgaggtggagtgcacctgcaatctcagctacttgggaggctgaggcaagagaattgcttgaacccaggaggcagaggttgcagtaagttgagattgtgccactgcactccaggctgggcaacaaagcgaaactctgtcttcaaaaataataatgataatgatttttgtctatttgtatcttttatttggtgagagatcatctcatgcttttctttagttctttcgatgtgacttcctttagttctttgaacatgtttagcatagctgatgtgaggcctttgtctagttagtccaatatctgggcttcttggggacaatctctatttattgcttttttattcctgtgtttgggccatacatttgtatttcttggcatgtcttataatttttttttattaaaaactatactttttgtatgatttaatgtggcaactttgcaaatcagattgacatacctcccagagtttgtgttgttgctgtttgttgtagttgttctttgtttcattaatacattttcttagctagttctggaaagtctgtattccctgtcacgtgtgaccacttatagtctctgcttagcttagtgattagttaatgattgaacaaagatttccttaagcatttgtcaccaaaaaatctccccttctctgctaaggggctctgtgtgcgtgtgtgagcatgcctttacactcagccaggcagttgtcaactctgccttagtgtctgtgcagagatgaggtcagccagagagtttagggctttatcggttttcctgagcatgacacagctctgggcgtgcacacagctctatccatgcttgtgaccttctagactcccaggaatatgtcagatcttttcaaagccctgtggacacatcatgcttcagcttttccttttacttatttacttttgttgtttaaatgtaatagaagttgagcacagtggctcacgtctgtaatcctaacactttgagaagctgaggcgggaggatcgcctgcattcaggagtttgaaactagcctgtgcagcatagtgagatcttgcctttaaagagagagagagagagagagaggagagagagagaggagagagagaggaagggggaaggagggagggagggagagagagagagagagagaaagaaagaaaatagggacagggtcttgctatgttgaccaggttggttgtgaactcctggcctcaagcagtcctgcctcagcctcccaaagtacaggcgtgagccactgtactcggcccagcttttccttttaagcttttcggtaggtctattcctttccccacctgttatccactgcctcaggaagctgcaaagttagtcagttgcctgcaattacaccctgatgaaaagacttttcacaccaggcaaaggctgaaccaagtcaattacagccaaccttgcaagaggagccttatcagggaaccaccagaccggtcagataatgacagttctttgggcatgagacttgaaaggagctccagcctcattctgctccctcttgtggcgccaggctgctgtttttcatcaggagtgcagaatgtgaattttcaaggccaccacggaactgcagagtgtgcgatcttaactagggcaagtgaaaatgccactgttcttaccaagattctgctgtttttcttgaataaacattctcccgactgccctaagcctctggctaatttccagagttctgaaaaacttgattctgaccatttttgccagttttctcactgctattatggaggagagaatttttggaggtccttacttcacggattttgctgatggcacacctggaaaactgatttttgtttgtttgtttctttgagacagagtctcgctgtgtcacctaggctggagtgcaatgtcacgatcttggctcactgcaagctccgcctcccaggttcatgccattctcctgcctcagcctcccgagtagctgggactacaggtgcccgccaccacgcccagctaatgttttgtattttttttttttagtagagacggggtttcgctgtgttagccaggatggtcttgatctcttgacctcgtgatctgcctgcctcggcctcccaaagtgctgggattacaggcatgagccaccgtgcccagactttttttttttttttttgagacagggtcttgctctgtcacccaggctggagtacagtggtgtgatctcagctcactgccacctccgcctcctgggttcaagcgatcctcctgcctcagcctccccagaggctggtgcatgccaccacgcctggctaatttttgtatttttaatagaaacagagttttgtcatgttggccaggctgttctcaaactcctggcctcaagtgatccacccaccttgacctcccaaagtgctgggattacaggcgtgagccaccaagcccagcccaaactgcttttttttttttttaatctccagtgagatcagaagtcacctgcctgggttggctctgaatgtccctacctgctctgttcccctgaacctggagtcgccagacacccaacccatgactacacccaggccagtcttgaccctgggcgtaaaaagcattccccactcctctctgctctgtatgttcttatacttttgctgcttcttcgggagtgggagccaggatggctgagaaactcctcctctgaagctgtctgtagtcagctgcttcctaaggccccgatctccctctcagacctgctgcctcctgcccaggggagctttcagattatggaatagacccgggctcccataaacgtccctgccaaactatctgggtgccagagctctaaaagactgaggcagagccactttgccatgattaattcaggagccttgactcagtcattattcataacctctttcagtggtttttcatgccagctcataccagcccagactctggtgctccgctgctccaagaagggcccctctagggccatgtgggacccagtgggacctactcttgagcactgctttgccaaagtagaacaggcttatcttttatttttatttatttttattttttgttttgtttttgagacagccttgctttgttgcccaggctggagtgcaatggcgtgatctcagctcactgcaacatctgcctcccaggtgcgagtgattctcatgcctcagcctcctgagaagctgggattacaggtgcctgccaccacgcccagctaatttttttgtgtttttagtaaagatggggtttcatcatgttggccaggctggtcttgaactcctgaccacaagtgatccacctgcctcagcctcccaaagtgctgggattacaggtgtgagccaccaggcctggcctatttttattttttgagacagggtcttgctctgtcacccaggctggggtgtagtggcacgatcatggctcactgcagcctcaacctcccaggctcaagcaattctcccacctcagcctcccgagtagcaggcagcctcccgagtagcagcctcccgagtagcatgtgccaccatgcccagctaggttttaaattttttgtagagacggggtctcactatgttgcccaagctgctcttggattcctgggctcaagcaatccttttgcctcggcctcctaatgcgctaggattacaagcatgagccactgtgcttggctgagcaggcgtatctaagaaaacatatttctgggccagctgagttcagggaaaatgccttgaacttggagaaatactaagtcaaagcttacgagctaagtacttttgttattttacaaaacggcctttcctagaaacagctctgagtgacagggtgagccctcattgtgcattcatgggaaaatggaaacgaaatctaacaggacaaaggacagataacctttccatctttcttggcaaagcactaataacagatcacagtaaaggctaaagctcctctgtgagtttctttccaacagaggcagcagaggtacaaaggataagaggaaatgggctaatgtagcagagagattcacctaaatggagtctttccacgtgcttttccctacgttagggactcggctctcctctcgcctggctccctccatcctgaggctcatcttccatctcagctacctgtcacttcctccaggaggccttccctgaccaccctcatgtgttcccctgccactatgcctgtcctatccccagaggcttgcccagggccaagtgttgggtagggagtcaatgcctgggaggggctcaaggaactgaatgaagcttgcactctgggagtctctccagagagtctgtagaggctggtaggaaactcaggctgatttgaaccaagccctgattctagaaaaccacatacctgccaaaccagaagcagcagccccctctctcccctgctccctgccctaaggaaggaagcctgtgcccccttccactccttcttcatctccttcctcaccagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtacccaccagccagacactggagagaggagggaagggaggggcagtaactgttccctggttccccatcagaacccctggggacatttcctttaacacattttattttgagatggagtttcactcttgttgcccaggctggagtgcaatggcacgatcttggttcactgcaacctctgcctcccgggttcaagcaattctcctgcctcagcctcccaagtagctgggattacaggcgcctgccactatgcctggttaattttttatttttagtagagatggtgcttcactatgttggccaggctggtctcgaactctgacctcaggtgatccacccgccttggcctcccaaagtggtgggattacaggcatgagccactgcgcccagcctaacactttatttttaagttgagtagtgataatacatgcccacggaacagaatctaaagggtgcaaaaaagaaaatgccttcctctcacctctgcctgcacctcctcccctccctccctctcttatgtctgccttcagagctagtctctgcgtatgcaaggaaacacacctctctcttctttactctttctttttgcacacttcacacactattctgtactcgatgttttccattgtgtgtaccttggagatagtttcatatttcatacaccgctgccccatgcctattaataactgcatcatgtgggtgtaccataatttatatatggattctaatattttgttgctaccccccaaaaaatacagcaaagagcatctttatacacagattgttgcacacatgcggggatatatctacagcagacattgctggcagtgggacttctaggtcggagcacacatgcatttttaacattgccggatattgccttattgtggggagtcttggcatataccgattcttggccttgcacctggaggttttgattcagtaggtcgagggcgaggcctcagcatctgggttgtatgaagcttgccggcgactctgatgatcagccaggtgtgggaactgtggacagaacagcaatcctcaaagtgtatttgctcccacgaattgccgggagctccatcctttgtggcccagtggctgaccccaggacggtggggtgagggcggagaaggcaaaagccaggggaaatacagggcctcgaagtctcactgtcgcccctcctcccaccaggtcatgtggtgggacatccgaaagatgagcgagcccactgaagttgtgatcttggacatcaccaagaaggaacagttggaaaatgccttgggggccatctccctggagttcgaatctactttggtgagtgtcccttgctgtcccttccccgacttgcattgacagggcagccagggctaaagacaggccattgctaggatatcaggtgctcgtggaacccagcaccagcccagggaggccaccctcactgcagccatcctagacgtgtgtggcctttacaacaactttccagcagggggcagcagagcttctcgaagaaggacaccatagtcatcatggcaccaagtcatcttttggccagtggcccagctgaacacagagggcaatcttttgacagaacaattccagaaaagccctgttttgtggggaaggtcacgcccaggaccaacatcgggaggcctggactccaacccaggtcctggccctgcctggcacggggtccctaggctggtcacctgccttcctctggggaaggaagaggtactggagaggaaaatgaggtcaaagcaggctccttggaaaaccagagcacaagcatggtctcggtgttcagtcactgagaatgacaaagaaatatcaaagttcaggtcgggcagggtggctcacgcctgtaatcccagcatttgggaggccaagaatttaagaccagtcctgggtacataatgagaccccccccaccgcccgcccagtctttaccaagaaagaaagaaagaaagagagggagagagagggaaagaaaaggaaagaaggaaggaaagaaggaaggaaggaaggaaggaaggaaggaaggaaggaaggaaggaaagaaggaaggaaggaaggaaggaaggaaggaaggaaggaaggaaggaaggaaggaaagaaggaaggaaggaaggaaggaaggaaggaaggaaggaaggaaggaaagaaggaaggaaagaaggaaggaaggaaggaaggaaggaaggaaggaaggaaggaaagaaggaaggaaggaaggaaggaaggaaaggaaggaaggaaggaaggaaggaaagaaaaagaagaaaaatatcaatgtgaggcaaggcgccgtggctcacacctgtaatcccagcactttgggaggctgaggtggcaggatcacttgagcccagcagttcaagaccagcctggacaacatagcaagacactgtccctacataagaaaagaaaaaaagggccaggcacggtggctcacacctgtaatcccagcactttgggaggccaaggcgggcggatcacctgaggttgggagttcgaggccagcctgaccaatatggagaaaccccatctctactaaaaatacaaaattagctgggcgtggaggcgcacgcctgtaatcccagctactcgggaggctgaggcaggagaattgcttgaacctgggaggcgggggttgcggtgagccaagatcgcatcattgcactccagcctggacgacaagagcgaaactccatctcaaaaaaaaaacaaagaaaagaaaaacaggaaatatcagtttgagcatagtgcaaatgtgttagaggagggaagcttcctagaagcagtaaaggaagacttcctcgctagagtaagaagacaactttcccttgttgttggcttttggtttgggctgagtcttggtttacgtcttagtgcagcccaggcctggttcccccttgggggtgtcacttgtttgcttcggggtcatgggccatcattcctagggctttgggaggccctggcctcgaacatacctgggcaaccctagctcaaggctgagagatgaatgttgatggaaggaggagacaattccactgaccccctccccagaggacaaggcactgggcagggaggttggggtggcgagggctcaggaaaacattctgtcccagaggcaaggctttctaggccaagtgctagacatgcagccacatcactactagggccatctcctccatgcctggcccttgcagggtgcacactgtgtgttggacacttgtggctgcctgatttaataagcttgtgcagtcgcctacaaccatctcgtggggtaatgttattatccgtacttgccagacacacacgatgagtcttcatgagattaggttgtgagtcctagtacctggtaaagctgggactcaaacccagggctccaactctgaggcccagggtgtccacctgcagcccaccatgaagtctgaggctagaggcacgatgggccactcagatctgggtggcctttctctctggctcactgacgggcggcgtgcagtcggcttgaatactttcttctctggacctctcaagcttggtctttccacttgcccttgacgcccaacttgaagcccagatttttgttttgttttgttgagacatcgttttgctctgttgcccatgctggagtgcagttgtgtaatctcagcttactgcaacatccacctcccgggctcaagcctcagcctcttgagcagctgggaccacaggcacatgccaccaagccaggctgattttttttttttttttgagacagagtctcactcttgcccaggctggagtgcagtgacatgatcttggctcgctgcaacctctgcctcccaggttcaagtgattctcgtgcctcaaccaccacacctggccatgttctgggtattttctagagattttatatttatcattttagtaattttctggtagaagaaaactgcataataaaacaatatgttttttaaaaaaataaaaataaaaaagctggggggccaggtgcagtggctcaggtctgtaatcccagcactttgggaagccgatgtgtgcagatcacttgagcttaggagtttgagaccagtctggacaacatagggagactccatctctacaaaaatacaaaaattagctgaccctggtggtgtgtgcttgtggtccctacgtgggaggctgaggtgggagtactgcttgagcccagaaggtcaaggatgcagtgagctgagatcgcactgctgcactccagcctgggcaatggagccagaacctgtctcgagaaataaataaataaactaggagttcttttttcttttcttttcttttttctttttcttttttcttttttttttttttttttttttttttgaggtagggccttgctctgtaggccaggctggagtgcagtggcatgatctcggctcactgcaacctctgcctaaaacctgggagttctataggggcaggttcaccagctgcagaggacatctgagcccgttgacaaaggccctcccctcagtgtgcccctcccctacctcactcagctgttctttccatttggaatgctgaggacacagcaccattgtaggctcaggccctgctggtggaggttgttcagtctagcccagaagttaagacagaacagtaaacaaggaagggcattgcgtgatggagggggtcatgctcagagacgcgaggggagcactggaccaggagtcaggagaccagcctttgtgcattcagtccgcagtgaagtgaataactactaaagctcagttcgtgggcgatggacccatgtcagacaagctcgtgcccctcaaagagctcacccaccagtggtagggggacgagttacatcatcgactgccaggtagcttcctgagtgctggttggtcacctgctctgagttctcagggacaccagcctggacaatgctatgacaaatgtcactgtcttgccagggaaggctctgcccatcccatgagtgatctgggtgggccaccctgcgtcccctccctgggtcttctttactctctctgtaaacaaacattcaggatctttatggccaaatgcatcgaggacacagtggtgctctgcagagggggctagtgacctgacaaccctccaggactggaggagccagggagggcttcattcagcacaggctccttgagcagcttccaaaaagatggggtctgaggagcccgggaagagtggggactgctctccaggaggggccacagcccttgccaaggcttgatctgagggcctttctagcgcctgcagaccccccaagcaagctcctgtccatgcccgctaatcccagaattgatggttcgtggagtcttcccctcctgtgtcactccttccacagcccaccaagttcatggtggggaccgagcagggcatcgtcatctcctgcaaccgcaaggccaagacgtcagctgagaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaagaggcgatgctggggacaggaggggatgcaggagacaggaggggatggagggagcccagctgggccccggagagtcccgagcctccatatgtaaaatggagaaaaacctttccacaaacacccgagctcgtgttagcaagtgacttgctccagccactccacaaagtgataagcttcaaacactcagttactaaaaataatggccatggcttaattttatttccttttttttttttttttttttttgagacagtctcgcttagttccccagactgagtgcagtggcgtgatctcggctcactgcagcctccacctcccaggttcaagagactctcctgcctcagcctcctgagtagctgggactacaagcacctgccaccatgcccaactaatttttgtatttttagtagagatgggattttgccacgttggccaggctggtcttgaactcctgacctcaggtgatccgcccacctcggcctcccaaagcgttgggattacaggtgtgagccaccgcgtctggctggcttaattttcataatcctcaaactatccccaggaggaggcagcattgctcttctcttcatctcatttttcatgttagggaactgggctacagaaaggccaagccacttgctcctgctctcccagctagtgaggagccgagattgggtgtgaaccaaggaagcttggctgggaaatgcgggtgccttggcacgattcagcagtgaggcatagcctgtcttgctcagtgccactcctctgaggagagcaacagacagggagcttgagacagagctatgagcacaatggttagaccagagaagcttagactatcacatccccctccattcttcttagggcccatttaccttgtctaaaagtgccctttctcctcctccccttcatctcctaaattaggtaataagcccgaattctaaccacccccttgagtcattcaccaccgagcactgccatgtgtattgtgcattgcatgtataaataattacttttttctcttgctaaaaaaaacatcctggggttcctttcctgcccacagaaccacagactcctgcaacgtcaaagccaccagcaaccctaatgagcatctttggttccagtgcttcccaaatctggttgcatcagaatatcttgggaggagtttttgtttgtttgttaaaatgcttttgagatggagtcttactctgtcacccaggctgaagtgcaatggcgcgatctcggctcactgcaacctccgcctcccgagttcatgcgattctcctgccttatcctcctgagtagctgggattacaggcgcacgccagcacacccagctaatttttgtatttttagtacagacagagtttccccatgttggccaggctggtctcaaactcctgacctcaggtgattcgcctgcctcagcctcccgaagggctgggattacaggcatgagccaccgtgcctggtggaggagtgatttttttaaaatccagattctcagccccaaccctgggggtactaacatagaatcttgggcttagcccaggaatgggtttgctaaggagcaaccccaggcttgtgactcagccagtccttgctttgggagcagaaacctggttcgatgtcctcattctacaggggtgggaacgctggctgacaagggcagtgcattgttccaggcctcatagcaagtagggggttcccagtagatgtgaagccctttacaggctttaggagccttcccaatgtcttcaggtcctgcaggctgccagggctgtgtgaaaggagcagggtgtcgagcacagcacccataggcctttcgcagggctggttcctagagggacttggtggacctgtgtcatagaacctgggtctcccttgtcctcctcctgcataaggttaaacaaatttagcaaataagaatatttgaccctgggccaggtgcagtgggctaatgcctgtaatcccagcactttgggaggctgaggcgggaggatcacttgaggtcaggagttcaagacgagcctggccaatatggtgaatccccatctctaataaaaatacaaaaaatcagctgggcttggtggctaacgcctgtaatcccagcactttgggaggccgaggcgggtggatcacctgagatcaggagttcaagaccagccgagattgcgccactgcactccagcctgggcgacagagtgagactccgtctcaaaaaaaaataatatttggcacttagttaaatctgaattttaaaaaaaaaaactattttttttttagtataagtatgtcccatgcaatatttggtatatacttatactaaaaattattcattgtccaaaaatctccagatgtttctttttttggggggatgaagtctctttgttgcccaggctggagtgcagtggcacgatcttggctcactacaaccttcacctcctgggttcaagcaattcttctgcctcagcctcctgagtagctgggattacaggcgcccaccaacacccctggataatttttttatttttagtagaggcagggttctgccatgttggccaggctgatctcaaactcctgacctcaggtgatccaccattctcggcctcccaaagtcctgggatgacaggcatgagccaccgcgcccggcccagatcctttctttagtcttgatcatttctcccactgtggtctggctgtcaacacactaggtttgcaaaggtgactgggaagtgtagtctgccttgctcaccaggggcccagctacaactatattgcaatggaggaagggagaggaggtctgggtgaaaatctgaaggctgcactgtgtgtgtgtcccttttaaaaaaatgttccgtcttcactgaagaaactcttgaaaacccagatgaaaccaagtaggaagtgacactctccttatctcagcggtagcagcttttctgggcatgtccttcctctgactcccatccgtgagtcccagggctgggaccaggtccagcaacacgtgcctgctgcctggagttagcagcagagaaatgccagtggccagcccacgggaaggactgtgcccagagccctttctttattttatttgagacagggtctcactacgttgcccaggctggagtacagtggcacaaacatggctcactgcagcctcgacctcctgggctcaagcgatcctcccatctcagcctcccgaggagctgggaccacaggtgctcaccaccacacccggctaatttttttattttttgtagaaacagggtctttccttgttgtccaggctggtctcaaaatcctggcttcaagcgatcttcctgccttggcctcccgaagtgctgggattacaggcacatgaccagcccagagccctttaaagaacagcctgtcagacacctgaggtcaagagtttgagagcagcctggccaacatggtgaaaccccatctctagcaaaaataaaatattagctgggtgtggtgacgggcgccagtaatcccagttactcgggaggctgagacaggagaattgcttgaacccaggaggcagagattgcagtgagccgacatcgtaccactgcactccagcctgggcaacagagcaagagtgtctcaaaaaaaaaaaaaaaaaaagcaacctgtgagctgtggatgagtgaggtcagcacagctagaagtcagacacaaggaagaacttcctacctagcaagactctgagatcctggagcccagaagggaccaagtgagccaagctgtggctcagaagcctctgtccctccaaccatgatgtggtctacctcccacaggtaccacatggcttacctcactgatgctgcctggagccccgtgaggccgaccgttttctttaccaccaggatggacggaaccctggatatctgggacttcatgttcgagcagtgcgatcccaccctcagcttgaaggtcacgcgcatgtccctccttgtgcatccaggtcctcagggagccaggtcccggcgtgggtgtgagtgtggggtgctgtgagcacgtgtgcagtgtgtggccaggtgtgtttgggcctctgtgggggagccgtgtgcaggctgactgcagcgattgcttttgagcgtgtgctcctacaaaggttaaggggcctgggggatttggcatcctggtagcacaacagaaccacctgggggaaatttaaaaagaaacaaaagcaggtacccggcatctcctacccacaggccgattccttcagagcccctggggtttggctgctggaccttccccttcatgtcagggtggccagagctgagccccactggctggggccacggaagggtgggggcattggggaaccacagggtgactgtgaggcggaactgaaggggtggggcgggagatgaggcagggaagccaggagccttgacaaccagtctccgagtttgaacttcatcctgtgggcagaggcgtcctgaggatgtttgaatagggccaagtggctgagcctccccaggggccagttaatcagacacacataactttgctcctctcctctacctgggtctgcccggccccttcaataggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccgtaagcaccgggtgcctggggaaaatccctccagcacgtcccgacctggccccacagcagagcaggctagtcagacaaatagatggccccgccctcccacccccagaacataggtgcacattttgggggaagcagtgtgggctccataaataggtgttggtgtgtccatttgcctttgctcaactgctgggtagctaagtggccttcagtaagtcacgtcactctccaggattcagttttttacctgtaaatcaaagaggttcgacttggtcagtttgtctagtttcaaataacacttttttttttttgtggaaactttccaatgaaggcttagtattgtattatattatattgtattttaatttaattatttttatttatttatttatttttgagacaaagtcacgctctgttgcccaggctggagtgcaatggtgagatctaggctcactgcaatctctgcttcccaggttcaagtgattctcctgcctcagcctcctgagtacctgggattacaagtgcataccaccacgcccagctaatttttgtatttttaatagagacaggatctcaccatactggccaggctggtcttgaactcttgaccttaagatgatctgcccaccctggcctccgaaagtgctgggattataggcgtgagccaccgtgcccagcctaattattttatttatttttattttatcagtttattttattttacttcattttgagacagggtcttgctttgttgcccaggctggagtgcagtggcacaatcatggcccactgcagcctctacctcccaggctgaatcggtcctcccacctcagcctcctgagttgctgggaccacaggcatgcaccaccatgcctggctcattttttaatttttgtagagacagggtctccttatgttgcccaggctggtctgaaactccagggctcaagcaatccttccacctcagcctcccaaactgctgggattataggcatgagccaccacgcccagcctgaagacttagtagaatgctaatagggaagccagatagaaggggacttgaagagggggactgagatccattcctacatcctttccccagtggacagccctgcaggcaaccccccagaaccatggggaacactgtggaattgaaaacccctagtgctagggccgggtgtggtggctcacgcctgtaatcccagcactttgggaggccgaggcgggcagatcacctgaggtcgggagttcgagaccagcctgaccaacatgaagaaacctcgtctctactaaaaatagaaaattagccaggcatggcggcacatgcctgtaatcccagctccttgagaggctgaggcaggagaattgcttgaacgtgggaagcagaggttgtggtgagccgagatcgtgccattgcattccagcctgggcaacaagagtgaaactctgtctcaaaaacaaaacaaaacaaaaaaggaaaacccctagtgctgaggcctggagagcctcctggctctgcctgagactgggatctcaccattgagctggtccttgttgggccaaagccgccatatttcatagctccaaagggcgctcttctgcctgtggttctggaactccatgctccttggcattgagtaactcagtgtccctgctgcagccttccaaccccaatattcagccctccttccttgacaccagccctgggtacagacctctacagtacagggactgtatggagagcaaggagagctcagcagaagccccacctggccccagcactggagtcgcttgccatcctgccctctccccaccgggctctctctgtccctgggtgcccagatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcacagagctgaagaagaaggaggcagacgccataaagctgacgccagtgcctgtaggggcctggacaggggttgggtgggttgggaactgggtgggacacatggcacttgggttctgcttctgcttgccaacttcctgggtgaccttgagcaagtagtcttacctgctagatcttaatttattcacctggcaagtgggaagaattattcccttccttccaaagcatcccaagtctccaaacagacttcaggctccttacaggcaggaaccatactccatgcctcctggtatcctcccctccccccagagagggcacatggtgaaaatgcgtgttgagtgactgaacgagggaacatgtgtgttgagtgactgaacgagggtcctagaggtaagtgagctgtcagagaggaatgggccttgagacccctggagggaagggctgggacattagcggtgtgcacgtcatgctggcttacccaggtttggtgtcaggagtgtgacctgtggtcagctcatctgcccatggccccagctctaaagcactttctagctgtatcacctgagctggtcacttcacttctggcttccttcatttccatctggaaaatgaggagatgttgctataaagatggtgtctggtcatcttccaggccctcttttgtaccagcggagagaggaagaaaagacattgcctgtctgggtcacctccttcaggccccacagataagatgccaagatatgaaagagccaaagagcagcgtggaagggaaaagaaacagcgggtatatgccaggatttacccttgtaggcaagactggctgcagacttggggattgcaggcactgcaaaatgaaaatgtgagggccctcgtttaaaaagtattaataattttaaaacagtgacaatagagcgttaaaccaagcgtgggccctgctgagacagggtccagtgtatctgcacagagcacccacccatgacgcctgcttgaagaagagctgtatggcaagttcttggtccctgatagagtggacagagcgaaggatggtgcatgagcacacagggaagataactggttccatcttgtgatttcttccctcttctgcctccctccccctgggtctaaagctgtgatttccacaggtgcattttgcatttgggggtacttggttatgagatgttttcttctcacactgggtaatacaggtggggcagagagctccctccacttctggtggaggcaaaactagaatcctggattctgacgcctaatccagggctcctcccactcaccactcctggcctatccagccctgcagaaggcaaagatgacactggccaccttttacaacgcaatggtggctggtaggcaccatgctttgtgacatatgtcccaaaacgtgctcctcaccatggcttgaacattctacatgaagaagttgagccttggaaggggttcaggttcacagaacttggccccttcctcctcctgcctgccacacacttcctgtctctctcttagtctgcaattggcccaaaacgctggtggtcacaaagtaccgcgtggtactgaagctgttttacataggctgggtccttatgcccactatttctaatcctggccacagccctgcaaggtgtcctgtcctctctatgggtgagggggccaaggagactcaggaggagctagcccgaggcctcccagtctgcatgtggcagaagccaggcgtgaacccaagtctgccagattcccccagctctgcccactttccgcactgtctgggccctcaccagccgcagagctggcacccgggttccagggtgctcagcgacccaggcttcagccatttggctgctttggtcctcgtggggttcacatcccaggggagtggggaaggcctgtcccctaccaacaccaacacttctgtgctgtcttcccctgcagcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttggtattgccccgctctcacaagtgggaggctgagctccgccttaaagcagcactgggtggtgggctaggagcatcgggccctgactccccagcccctacaaatcactagcccccactgactcactgggcactgagtcctgagccaccccttggagagagggaaggggcggggcttgtcccggagctggctgccccattgtctcagccaccctgagcccaccccaaggccgaggccaccttagtcctagtcctggatgtctcctgggattcagcttctcacaggctccccagcaatcattttcgtttgtaaccttgcagaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgccacgagttagtacgtgtgatgcatcctgcacccagagcctgtcacgttatctcgtgtaactcattcacgacatccctggaactgtgtgctcccatcacctttatactacacaggaggttccaggagcggtacagggacgtgcccaagtctcagaactcgtgacggggcacagcggggacgggagcccaggcagctcattcctgaccctgcacggtcatcaactgtgggccaggtgctgtgcaggcctctcggggactccagggtgggaagtgggctgccctgggggtgccctgaaaccgcagctcaacagagcagtcagtgaccattaccagagacattgggaggtcgagagggcacttcagtgccaaccttgcacaaggaacaatgccctgaccatcatcatcctgtggatggcaggtgaccttggcagggacccaaagtgcccttgaaaaatgcccttgaaaaatgtgttggtcaggtttcgtggctcacgcctgtaatctgagcactttgggaggccaagacaggaggatcacttgagcccaggagtcaaggaggatcacctgagaccagcttggacagcatagtgagacccccatctctaatttagaaaaagaaagaaaaatggccatgttaagaatctccttggctgggtgcagtggctcacacctgtaatcccagtactttgggaggccaaggtgggaggatcacttaagcccaggagttcgagaccagtgtgggcaacatggggaaaccccatctctataaaaaatacaaaaattagcctggtgtggtggcgcaccactgtaattccagctactcaggaggctgaggtgggaagatgacttgagcccaggagctcgagactacggtgagccacaatcgcaccactgccctccagcctgggcaacggagcaaggccctgtcttgaaaacaaaataaaatggccaggcgcggtggctcacgcctgtaatcccagcactttgggaggctgaggcgggtatatcacctgaggtcaggagttcaagactagcctggccaaaatggtgaaaccctgtctctactaaaaatacaaaaaacttagccaggtttaatggcacatgcctgtagccccagctactcgggaggctgaggcaggaggatcacttgaacctgggaggcagaggctgcagtgagccgagatcatgccattgcactccagcctgggcgataagagtgaaactccatctcaaaaataaataaataaaataaaataatctccttgaggagggacccagggccagctgccccccgtactcaaagagaaaaatggagctgtcgactgtggttaaccttgataaaaacaataattcaggttatgctgagtgcttgatcttcacaagtgccccaggagtgatctcacatttcaatccccacgttatggatgtagcaggcgagagagagagagggagtaacttgctgagtccagtgggagtgggtagcagagctgagacttcagcccagagtcacagccctacagcttacgccatgcacactgcactcccaggacccgggtaagaggagtgggctgggccattccagcatcagacggagggggccacgagggagcagcaggcccctcgctgagcagggacacacacagcctcagtgccgtcctcaggaacgccctgcctagagcagcgattctctactggggaagattttgcccccaacaggacatctgtcaatgtctggggacaaccggtgaggagagtgcttctggcattgagtgggtagagacagggaccctgctcagcatcctgcacacaggacagccccctacattttggacagtggagtcatgctagagaggcccaatttagagaaaaatctacccaaatggagcatcccaagagaaagtacaggctctgcacacactaacctgagcacaccgaaggcccctgtgagaggctggcaccatgagctcgaaggcaggaggaccttctttcactgaactggaattttga

SEQ ID NO: 15383 - DNA, 20935 bp, Human
gatattttacatcaaaatcataatataattaattatttgaaaatgcaagttagtaatgttttcaagatgttaaaagtttgtaagacttaagcttagtaattctacttctaagaatctatcttaaaggggtacattccagataatcctatagatatattgtatcgtagaagactgtaatggaaacatttatttcctggctttacctcattttaacagaacaggtgtttaatttttaaaaatgattatggaagaaattctacgattgcaatttaaaactttttagatatcatggtaaataactgggaaaattttatattgtttgctaggcaggttttatggtacttcataaagtatcttcagtatacttcataaagtatatttttcacatactttaccaacatattccaatgactttatataacaatagtaaaattattaagggacattttcaaattacattttctataaatatcatttagcttaatttttaacatacatgatacccaataaacacacttttatttaattttcttaacagaaactccaaatagacatactgaaaatcacctttttgtatatgtgaagtctgaaaatgatcagaattctgcaagggtataataatgcttttgattacttgaaactttctctcattagaaaagactaataaagcttcaaagatatagaattcagaatgaaaaaatatgtcatttttagaataaatattttcattccatatctaatgatttaggcaagcttttacatattttccttcaaaatatcagctgcttactgacaaagtgttcaagtttttgaaaatgtcttatcaatattaacatgaaatttgatacaaagcaaccaattccaaattatcttaaaacattccgtagtacaaaattagtgtctactcacatcaataatatctattcctgttcgcttacttctatttgctatattaccttaatatacaatacataaatagtattttatttactcattacatactcataaatcatgatcattgtaaagttttgatgctgttatttatctttgaaatagttggctgtagcatattatttttttcattctcatataaagtcaatatattttgtgtgagaagtttgcatctagttagcaactaccatggttatctcaggctttgtggcacagagtctagcttagtgagaatggcaaggtacataactcacatagatgttgtgagatttgcatgacgtaactgtataaatacctagaatactgtcagcatctagtaacagcttactaaatattgggttcttgagtgaattgaaatcgaggtaaagataacaattacccatatcttagttgtatttaactttggtgcagtagtggttgcggttcttgccattaatgcaatcacttttgcaccaacctatcattactacattttatccaatttttttccatttttcacttataatatagtaaaacttatattggttgtcatcgtttttaaaagctgtgcatttttgagtatgaatcattaattgacaacatattttctcatgtttagtattatatgcttctctcataatcttaaatattgtttcttaaaattatgtataatactatgcacttcttttgtttcatgttttatcgcagatttaatgagaagttgtttaaaaaaatctcatatttatacatttgcaattgtgttagtagcaaaaagatacctactatttttcaattgattgtggcattatttttttgagggacgtgttttcaaaattgttgattcctctctaaaaggtctgaactactgaagttgtcaaataaggtttcagatttctcccttcccctccatctataccccagaatcagcttccttctctgccatggattatgtttggggtaaaaaaggaagacggttcagattgataaagcaatactcctgggaaaagactattaacatgtataaagggatttccttgcagtataaatactagcgcgcaccctcctggtgcctcagagccttcctgatgtatatatgcaggtagtgagaattgaatcggccctttgagacagtaatataataaaactctgatttggggagcagcggttctccttatttttctactctcttgtgggaatgagttgccaagcttttacttcggctgatacctttatacctctgaattctgacgcctctgcaactctgcctctgataatgcatcacagtgctgccgagtgtctaccagtctccaaccatgccaccaatgtgatgtctacaggtactgactcctatgacagtttacatatgaccgggcctaaatatttcagaatgaatgctttgaatcttgatagttaataatctctttgcatctttcattttacccctccaatttaatttgtcttaagtgaagtaagcattaagcatatctaaaaagccaacatgccaaataaattttaaagaaatattagtaagtgtagtaatttaaaatcactgttggctttgttgtaaggaagaaaatctgttttctacataagaaaagaatgaacttggacattttaaatctaaaaacctttttaatggaaatatttatagaataaggagcaaatgaaatgaatattataaaataacaatatttaaaaggtgctacttctttatcttaaaggtttattcggttgttaaattacatttactatctaaaaacagctataaaccttatattaaacacaacagaacaatctgaatatcaacaacaatggatttcatagaataaaatagagttttaattaacatattttagcataagatacagaaattatagcaagaaataacatgacatttaaagcccattaactaaggtaaattttctcaaaattgcattctgaagagacttacttcacttctaagttttaacatttatctcacataactttttagaacaaaaattaaacctaagaattcacaggctcaacacaatcagccaaatacatatgttttgccagtgtgttcattctttatgcagtaacaaagtgttttagagttgatttacaaatggagaaagacttgaattgggtaaatttcttccattgaatagcaatataatattcactttccacttgttttaaatgcaatttttctcatatttaggaatgaaattatatacatttagaaatcaaagtttgagttgatacattattctgatttgaaggatttaagctctatcttttattattattaagcattttctaaatacatgcgtaagtttggcaccaatcttctggtggattttaaagaatctagaggtcagatatttagactttggtaaaatcatttaatgtagagatttttcaatattaccttttaaattaaatttcaggaatccgccaaagatttctgtaatttaatttaaagggtaatacaggaagtatcctccaacataatttttggaagacacaatagtttttatcaaaaatatatgctataaataaatctaagcaattaccacatagctaatcacatattttaaatagtaggtcatcctatagattgagaataatgagaataatacactatttctgtgtttgaagataatttggccagcatgaaaatacaattcagaatcgaggtaataatctagtaaaatctaattttatactcaaaatgccatttatttactttaaaataagtaacaatttatttagtaaattagcctatcctgtatttaacttcctaaaatctgaaaagcaaaaattatttaagccttaaaattaaaaaagaattataattaataaaagtgacctacaaatgttttaaatgataatagcattgatttataattttttaatgaaatttgaatcatatacatctaattgtctaaggaactattatagaaacactgactttaatgggaacacttgagtattaaatgtgtttaatgataatttgcttaattttggaatgcacagtaatgcattatatgtaatcattatattgcaaaatgactttagttcttttgagctattaattataaaataaaaatgtatacagatttttaaaaattaaagatttttctctattttaaaataatttattttactttatgaagaaaggcatgtctttaatcactagtttgtatattggtattctcaaaggattctaaccgtactttataatatctcatttattcaagaaaattaatttatgaaaattaaccaatatattcagaatatgaaggaaaaaattgagaaaataaaatatataaggaaatattggttttattgtcaatattttgtgctccctatcaacttgatgatttgtgtttaaaacttgataaaagtctaataattccagtttacttccaaaatacacattgatttcctgaagcatataaccatttatgaacggttatgtttatgtaaggctttatggctttatggatattaagtcactcaatgaatgaactcattttttgaccagctttatcattagaatggttgtatcaattgtgtatatgcagacaactaacaacctcatggtttcaacatcaaaataaatagatcatatattgttacaggtttttaatagcactctgaatgcagtgagatttttatgattgtatctaataaaaggctacttgctctgccatttccactttgatgaaacaaatttgttagacaaataagcaaaaatacactgttcaagagtgaatttctgtattcattcatacagactgctttataataccatgcaacacaagaattttaaaggactattcttctagtcggcgagttgcaatgtctgcattgaacagaaccaacaagcattctgcaactcccaaagggccaaggtctaaattggtcagtcaccccttcacggggcactcgtagccatagcacagagcacaggataattaatgaagtccgttttgatgatttattatctcgttacatgagacaaactttgatcccccctagttttaacctactcgtcagagaacttacccaaaatgagaaaaacatattggcatgtaactttaagaaccacataaatgtgtatttttgaaataaaacgaatgtgtcttgaatccttatacattttcttaccagtcccatctattttgtctttgatccaaactcctaaatgtttgtgcacacatttctcggtgacaacgttgggaaacacagcaacaggacttcattattctgttccttcctgtcattatggaaaccagccatcaacctatggagtgatggcaggtaagaaaagttgtcttttacatgttattgaatttggggacacttagatggattttctgggcctgaaagaattgtgatcagagtgtgacatgaaatttgatttcttaactttgaaaattactgttaaaaatcaccacttcttgtttcctgctctgtgacacccacagagaccataggggttatacctaatttccctacttacgtatctctgaactgctgtgcttcttgagtttgctttgtatggtttttattgaaattcactatcgtcaaactgttagttgtaacatgatgctattggtaggcttaccttcactaaaaatatagtagctactagacacgtgtggctatttaaatttaaatgtaaactaggtaaaataaaacaagatttcaaattcagtttctcagttgcacttgctacatttcaagtgctctataaccacatgtggctagcgactcccatatcagacagcacaggtttacagaacaccccccccatcattatatttcttctggacctttggtccataaacataaataagacattgattgaagctaagagtgattggtaggggctttagtgatagctgtttcaggctttagcagccctttctgaattgcttctgagtgagtcttaagtgagattgaaatcattgaagttacatacttttctcctataggtaagtgaagtatgactgtatcaattatggctacctgcttattgatccttctataaaggcattgaagcacagtttttgaggaatgcgtagatctggcttatgagatctattcatcaaaaattcttgtttaatttcatggcatggccacataagattttaattgtttttaaaaagtacacagttttattatgcgcaggattttcatttgttggtttatttttaagatagctttaggagatatacctaacgctaaatgacgagttaatgggtgcagcgcaccagcatggcgcatgtatacatatgtaactaacctgcacattgtacacatgtaccctaaaacttaaagtataataataataaaagaaaagaaaagaaattctttgatattttatctttattactacagcaggaaaagaattcttattgatgacaaactgtgtgagtaaatgtgtgtgtgcgtgtgcatggtgtgtgtgtatgtgtgtgatactgagggaaaaactgtggataaaggaatcacttattagggaaatcttttctaattgacttgtgttttgttatgatacagataagcagtaaaaaaaaaaaaccgcagacaaatattgatttattcctataattttcaagtaaaatggagcaaatagtttaattttaattaaattgtttaacctttgatatctcaaaatttgtccatgtaagactaaatagaacattaaaactttaaaataataatccagaaaaatatgagcttctcctacattctatcaagcaacattctgaataaaccagtatcctagcatttatggttaaatgaagactggtgttcttaacaatgacctgtaaatcctgacgtctttttttaaaaattaagaattaaagccatattttttcttcctctctgaaaattgattatttatgatcaacatgcttaattagtattcatggttaatgagaatagccctcctcaatgatgaactactgtcattataaaatagtaaaataaatgcgtttagctactggaggtgcgggtggattgctttctgtggcctttacagcattttgattatgagacaggaaatgacaaacacatgccactgtttcctggaggaaagaccttacagttcatttagaggaactcccaggaaccaaggtacattgttagtttctctcttaacccagcacagaggcagtccctgccagttgattgaggttggcaccaagattaaaaccagtcacagagcaggggccaataatctctggcccaaataccttcagataatttttgctaccaactcccaccctgcctaatcagagagggccaccactggcctcgggagtttgcagctggcctcagaattctaacacccttactgcttccaggactggagccaatatgccaatgttcacattgagagtgttggcagctcatgtctttctgatacaagtttcctccagcatgaactcagcaaaccctcttccacgaacctcttcctcatttcaattaaaatgtaaagacccctggaagagcctttcaaaatgattcaaaaccctgtcttagtgacatcaagagcagaagacttacaccaaggtctggagctatcactgtggtcttaagattaaatatattctgtgactgaaagaaaaactcaccatcacaagcacaaagatatttgaatatttttgagagggattgttaaatccctctcaaaaattttgttaaaatgtgatatgctttaaatgtcagaatgtctatattgggacataattcagtattagcatttgcttcatgagagattagatcttagagaatctgaactctcctgactttatccccagtaaagctgcataaattgagttacaaaatacagcaattcagaaataagagagaaaaggtaaataagagacaaatgtataaagtacacaatagaaaccttattatgtcatctgaattttctgagaagtcttaagtcattaatcaaatcagccccttgcacacaatccacagaagtgtcttaacaacaacaacgacacggtgtcacatactctatataaaagtgaagctacaggaagaactatatttctaaaatatgtgaaattactttattttcatatggttatttcattactcatactctgatgcttacatttagtttgagcatttcattaaattaataactcacaggaaaagaagagctataactaatattttgtcaggttggtaggtagaattttaatgatcagatgaatccactgtacgtaatagtccaggtgcaggcaaaataaagagaatgactaattgggagtaatgaattatccatgccattaactaattactaacattgttcaagtgattaacacctctgagttccaatctcttcatatctacgttgtggtgggtactacaactctactggggttgagtagtagcaaatttgtgtcagctcaaaatgatttctcttttgcccttctcttcacgtactcttgcagctaaattccttctgtcctttcactcctgagaacttagagaattcaaatcaacaccttacagtacaaataatagaaaacctagaattacagatgctgttcaaagtctctcctagataaacacaaaacaaaacaaagtatcaaaaaaaaagttctcaaaactctgactcttgggtttctgagattgtttctgttctccagtatctgaagcagagtacaattcaggaaacaagctcaatgggggttcaccctttctgctgtcctgtggaaacagcaaatcaacctcactgtaataaatgttaaacccaccatctttacatgatgtagtggccaaaccaagaagtagtgtgaaagtccttgctttaaaagttaatttcaaggggaaaacaaaacaaaacaaaacaaacaaacttgtttaagtcccaaactcttgggacttaaacaagatgatgagcatccaattctttttcatgagaagtggatattaaaagaaaagattgttatggctgaaaatattcttgctgcctgggctaatacagaagaaaacggaaatcagcctggcaactgacagggagagatagtctagtctatttttggaacccatcttttcattttttgaaatttgaaatttttttttcttaatttacttcttttgtttagttctttgttttatttggccctaaattgttctggttgtaacaactctaaggaaacaagtaattctgaagatcttttgcttccacatcgtgaaaggtcttttggtagcagtaacatgatgtattttcacttccagactaggggttggcaacccttttctgtaaagaaccagacagtaaatatctcaacctttctagtttttgttgcaactattcaacctgtcattgtagtaggaaagcagtcacagcctgtgtgtaaagaaataggcatttcaaattaaacttaatttacaaacacaggcaataggccccagttgtacacggataggatttaccaatgcacaagagtgaaaagatcacagtggaagtttataatttcctttgaatttttatgcctaagcaacagaggggaatatatggaaatattcagatacatgttcctgtgcatgttacaagcacagcagggtggcgtattttactatgtccctctgcttcccctgtttgtttttttaaggcatcaagccagtaacgtgagatgatgttgtcagctaaccacatgctgcaaagatcaatttgccccatgctatggtacattgagtcagcgcctagtaaggcatccctatctctgacccccattgcctgctttaaaagatttacctctgttcttctctctcctctgtcacacagaaatgcatacatagcaatttagaaaggctctggtgaattaatcttcaatgtgaaaatgtatttggaactacagtgtgcaaacacttctgagctatgtgtgtgtgtgctgtccaggcctcaagataatttttctttatccatgtttcagaaaatgttgatgagacctctgtcacacatgactcacaacatcttttatcttattcctactttttgcagtaatctgggttttaaaaagatttgaaaaacatattgctatacatatcatcccaatcactctccacactcccccaaatgcaggctcagatgctagaaacagaggttcgtttggctgttcttttaaattgttgtgatgaaattctgtgtgaagttagttccaggaaatctgtgaccttgcagataattgtagatactttcatgcaatgaaaaatgaaagtgaaccaggtgcagtggctcacaactgtaatcccagcactttaggaggccgaggcaggcagatcacctgaggtcaggagtccgagaatagcctggccaatgtggtgaaaccctgtctctaaataaaaaattataaataaaaaataaattaaaaaatataaaaattagccgggtgtggtggcaggcgcctgtagtcccagctactagggaggctgaggcaggagaattgcttgaagctaggaggcataggtttcagtgagccgagagcactccagcctagggaacaagagcgagacgctgtgtcaaaaaaaaaaaaaaaaaaaaaagggaaagggaaaaaaataaaaaatgtatcacacatcacattttccttcttgttctggatgccaaaccttggagcatggtattttctgtgtacttttcatggattccattcaaatttgttttctgcgtgtccactttcccagagtacttacaatgtataaactacctttcaatttttgtggctgggttctgtggcttatacctataattctagcactacaggaagctgtggctggaggattgcttgaagccaggagttttgagaccagcctgggcaacatagtgagatcccgtctgtgcaaaaaatttaaaaaagtagttgagcatggcggtgcatgcctgtagattctacttaggatgctgaggtgggaggatggcttgaggccagaaatttgagattgcaatggctaagattttaccactgcactccagtctaggagacagagtgtgaccccatctctaaaaataaagaataaataagcaaacaaataaacaattttacggaaacagggatgacacactttatatatattttattgtaatatttttgtggaacagtgtttgtttaatatagccaaaggtgtttaaatgcagagaaaaccttttaaagagaagttatttaatttgcctgagtatagactgcctggagaatgaaccgggcaatgattttgatgtggcttactgcaatgcttattagactttagttctggtttaaactgcaaagttaattcgttgggcactggaggcaagttatttactttctttctacttaaatttcctccattgtaaattatggggaaaaatatatatctttcctgactcattttttgtataaggataaagatgataacaaatgtgaaattaacacgacacaaagtgttgcatagaagatttgtagcagtacataattatgatcagcaagagaaattgaaaataataataataattgataacaaatttagaccttttagtatgcgtaagtaaaaaacacacaaattttttatataaaataaacataatttgacataggttaaatgagttatctaaagtgtcttaaaatatgttaaatgtacaaaatctaacagtagcctggcttttctttgtactctttctcagggtattttatcattaaatgtattaagtgatacctgatggacctaaataatcaaagaagtgaaggttttataaatatatgtgagaatcaattctgaaagcataagcacaaaacaagtcttcagataaatatgagattaaataaatgataacataaatgtcatcaattttcttttacatctattagtccttcttttaatttagcagaaaattaaaattaataaaaagctaaaaataaaccccacggcaataaatattttcaagaaaagctatataataaaagaaaagttggtaaaattgcttttaaaaatgttctctggtctgatcaagatgccacacaataaagcataaaatggatagttaactgacttttacaaaagtaaacctggataattttggtttgtaaaagtagcaggaattttttaaagacaaaaataatttctttcacatcttttcccagctttagagcagataaatttatgttatgctaatttgtttaatctctcatttgtatgtttactttgttttagaaaaaataatataccctattagatataattacatatttataattacatatttttatataaatttataattatatatttataattacacatttataattatatatttataattacatattttatataaataatacattaaattaaatttatataaaatttaatacattaaattaaatttatataaaatataaattttataaaaataaattaaattaaataaataactacatatttatgattacatatttttatataaaaaatataaaccaacaatttgctgagttacggtattctttgctcattatatattgatatattaatgtaagatttctgtattctggaaaatatattattactcatgtctttgatttgagaatgtatgtgtggagaaattataggtagcatgaactcttgatgcatttttttccagtaagtttctaagaataattattgcatgtattccatagtaatttattttaaaatatttatatttataagaaaatgattaattactcaatatttttatataaaaatgtcttgcttatacaatcatccttctatgtggcacattggttccaggacccccaaggataccaaaatctttggatgctcaagtccctggtataaaatggtgtagtatttgcatataacctaggcacatcttctaccttaaatcatctccagattacttataatatctaaatcaatgtaaatgctatgtaaataattgttatactgtattgggttttttatttgtatcatttttattcttgtgttgttattttttactttattttttaagtgtatttaattcatggttgcatcaatccatgaatgcagaacccatggatatggaaggcacactagacatgtcatttaatataaattgaagtagaatctttgtcgataaaaattgtaatgtattgataaagaaaacaagaaacaaaatgtgttggaatttggcttatatactgtcctctcacctatacttcccaactgagatagactcttccaatgaaaaaggaaatctggaagcaattgtgtaataatttcagacctttttacattttttgtgatttaacatatccactcagtagagtcaatgctttaccatttatcggtaatcacttatcatatataaagttgcaaactttcttgcttcttatatttgcttttccttaaataataatcaagaaattattctattatattgtatatttttcaagaaatcttgttagtgactttttaatagaacttttaaggttaccttttgttaatatttaatcactcctcaagcctatttagccatattaatatactttatattctcatcattctctttctgcctaccttcatttaattaaaaaagatgtgattatttcttaataaaatcaagtttttactgattaaatagtggggcgtttttatattgtgaaatcaatttcccaatcacaagaaaacttctcagcatagcacttagccgaagcatttagtgccatgatcacaacaaacatcacccattatttattcaatgaattaagaaaacagagttcaatgcatagactctggttagagttcaacctcagattcccaggaataggtgtcatttaagagaaaaacatgatagaaaatgtatgcttctgagagaagttgtttgtttctattttagttatttgcagtcccctgcttctttcctttaaccctatctttggttttgctgctctggagaaggtagaagacaaataatctcaattctactaagctactttgactccttcttcggaagactgaatgtaaggtaaccttgtaagtactgagacaggctagagcagaataatgggctaagtcaggcaaaaccctttcttatatagaaataaggagaatgacaaatggtctttttcattttatttctttgtttactcacaggtagtttaaccccttgtctttataaatttcctgaccacaccttgagtcatggatttcctcctatacaccagcctcttctggcagaggaccccacagctgctgatttcaagcaggaactcaggcggaaaagtaaattggtggaagagccaatagacatggattctccagaaatcagagaacttgaaaagtttgccaatgaatttaaagtgagacgaattaaattaggtatgtgcttgttaaaggcaacaggaaaaagaacttggtttgcaaatctttattgctgttaaatctcttatatattgctaaaaagtacaagatgattctcattcttcatctctactgtggacgtagttagtcgttatggaaatcctccaaaaacatttgtttccttataatttcttaagagcctaaatacataatttttaaattaataatactctttcaaaacttacctcaacattagttttgaagtgcccatttttatctatattttatttgaaattttgaataggccacacatttatatgattcaaaagtacaaaagagtataagtgacatgtatcccttctgcttgctttttctgtatatcgttgttagttccttgtgtatctttccaatgatatctcatggatatataagtaaatatatatggaaatatatgtattgtgccaaacatatgtattatttgaagttttcagtagtaatttttctagagctccttttcctttgtggggctgtcaagttccactttatgaatatactgcaatttatttgaccagtcctctactgatgaaatttaggtggtttctgatctttggctgataaaaacgataccacgatgattaaccctataaatgttattttgcactcatataaatatatgcgcagcaaaaatgttagaagcacaattgcttgatcaaaagtatgtgtactggtaattttgatagatgttatcaaactggtctctagagaagttgtaccaaattttactactaccatgagaatctttttcaccatcctcaggctatataaactccaaaacggcatgagtttttaaaatctatttctttttattttctccttaatgatatctccagcatctagaagagtataactataacacaaaataaataaatggtggttgaaagaaaaaatatgctgttaatcttttagatctttgcaaatcagacaggtcaaagtgacatctcactgttttttcatttaaaatttcttttattatgagtgtaaagtatattatttaatatgcttgacaatcatttatatttccttttctgtgaactatctgttcagagcctttgctcattttctactgaagtgtttttaaaataaaacaactataacaattgactttggttaaattgcataaaattgtgtatttttttaatggattgaaataatagttcaaacctctgcacttgcagaatgaacaatagataatgtaataagaatatttattgatgggcatcatatgcaaccattttatacatataggtatatagccttaggtcctgaaataatatgtagctattacatgtgataagcacagtagtaggaatctttgtgaaattcattttcagttttctatctatattactgtgaatgtttcaaattatatgttatttcagctgtactctaaaaatgtttgcgacaaacaataaggatcattagtctgaagacagaggcattatcaaaaactataaaatgggctcagaagtatacatgaaatgtgtaatcatagcctcttaataaatatggttttagggaaagtgacataattcttagttttatttagtacccttcaacaatatcattgaatcttttagagttgaaataagaatgttatgatatataaccgtatattttatgcattatagttaatatattaaaattttttgagcatatattatttggtaactaacaataatgataaaaaagccataattttcaagtgccttatgaagtgtttaggacacacctaaacactggttaaatattatgaatggcagatgtttctatctgaattctttcagtgactagataaaagtaatttattaactagaagaaatatgttttgaagtattgcacaagtacttcaaagtataatgaatcttactaaataattctgatttgccaagaatatatagttaaaaaatagtgtgtaatagttgacaaagatacacagatttgtgtgacaatgaaccaaaattaacatttcctggaaagttggagctgatggtctttattgtcccttcacaggatacacccagacaaatgttggggaggccctggcagctgtgcatggctctgaattcagtcaaacaacaatctgccgatttgaaaatctgcagctcagctttaaaaatgcatgcaaactgaaagcaatattatccaaatggctggaggaagctgagcaagtaggaggtactaaattgtgtctctgaaggctgtgctgtgttttaacctaaaaataatggcttcaataagtaggattaatgctaaagcaggaggtttgaggggtttttttccgccttttctctttgagatgaaaaataaacattttgttatatcacactaaaacaaacaacaaaaaaggaagggcaatgtaagtgtggaaataaatttattgaggatagaataacctatataaggaaagcttgttggcatcagcatgaaggggtaaaatacttatttttttacacatccatttttttcctctcttttatactagagaaattatatatgaatcacatttgtatcctaatattagtgtacacaaaacatttgcacacaccagtcttccaagaaaataatataagcaattgctagatatgcaacttaatgagctaaaattatctactcatacaaatgtcagagcctgataaagagtgaggtttgagagtatttacagcaagcattccaacaaaagtaaagtgaggatattatttgtagaaagtgtctttgcaaggttaatatttatttctgcgttgagatttttctctaaggtctgtaatagaaaaagactgcaaaaatttaagacaaaaatgtctagcatttttattttgcattgttttatgaagaaaatttgaaatccaaatcagatcgttttttataaaaagtctactttgtgtttgtaattatctctcttttccacattatagctttgtacaatgaaaaagtgggagcaaatgaaaggaaaagaaaacgaagaacaactataaggtattctttatattaaaagttactagaggacaaaactggtattttataaatggaatgagcatttgagtgtaatgcaggtgtaacataacatataaatgtaaggtgaattgggaggccaaggcgggcctgaggtcaggagctcgagaccagtctggccaacatggtgaaactctgtttctactaaaaatacaaaatttagccgggcatggtggtgggtgcctataatcccagctactcaggagactgaggcaggagaatggcttgaacctgggaggcggaggttgcagtgatccgagcttgcgccactgcactccagcttgggcgacagagcgagacaccgtctcaaaataaataaataaataaataaataaataaataaataaataaaaaataataataatgtaataacttaattttgagaaatggagagctaataattttcaacatttgatggaaaattatgtattgtttgattcaagaacacttttactccaaaattttgaatacaaacagaaagaaaacaatcatttctaagagactggccatatcttctccccttttagctataacttattgctctgacaatgtagtatccatggtgtctatagtatttaaaaatgtgacactagtaatcagtgtttcggtctcttcaagttcaacatgacctcttgcatttcaacccagaaagattgttcattgatctttttgtagtttctgtgagacatgcttagcaaatactaaaagacaggttttgttttggttggtcagttgtttactagagatttcctttatcgtaaacagccctaaatgattttggggagatatttagaaatgtctaggaaaatgttcattttcttctcaagaactcagtgccctctggtggcacaaagtgggaaaaacatagaaagtctgggtcccctacttaatgctttccgtgactctcgtgtaactctaccttacataagacaaaatatctacatatttaacacattatacatttgtccttgttaaagtgtcctgcaagtgtgttcagagtttttaagtttccttttcatgttaatattgaggaaattcaacctaccttaattttgagctgccaaaaacttcactaaaaacaacaaaatttcaccccctatgtccaccccccgccagcattgctgctaaagatgctctggagagacactttggagaacagaataaaccttcttctcaagagatcatgaggatggctgaagaactgaatctggagaaagaagtagtaagagtttggttttgcaaccggaggcagagagaaaaacgggtgaaaacaagtctgaatcagagtttattttctatttctaaggaacatcttgagtgcagataagatttttctattgtataatagcctttttctcccgtttcattcctttctcttcctcaacaaaaacagaaattacttggttgacttaaaatcattttatatcaatagcttttacagaagctttacttttccactttttttaaaaaaaaagaaaccaacaatttaaattatattgatgttatttacttaaaataattattctcagaagccacattatctattttaagccaaatatattaacagtaataaaatgatctctctgtctctcccgctctctttctcacacacacgcagacatgagtatgggtttataagttccttttccaaacatgtatattagctttttaacatgtaagtcagtaatgacacatatgtaaagcacatcaccagaaatatccaattcaaaaattaaccaatgttctgctttctaccaactctactaatttgtctgaactaaaagttttgaacttaagagctggaggtgtcttatagttttattactccctttaggaataaacctcaatcagaattgatactttgaagctaaaatttagggcatagctgatagaactgtttcaaaagagatgtgtagaaacattaatttttgatctttttattcttcctaaatattagctttttgatgtgtagctgtagaaaataatgctttatggattcttgagcctcaaaccattagtctgtaagctgcaacaggacaggaagagatctggcttgtttggtgttccctctccagggcttgggaaagttcttgctcatattaggcatgcaatctttgttaaatgaaggagtgtttaaggttaacaatggctacaaatgtgaatggtgtcacctaattttaaattataatgtttttgaaatctcacaatctagaaaatcatccaggtttctataacaagacatgatcacttttggtataatcgattagaatctgatttactatttgtaaaaagtttgacatattgagattttaattctgagaattttatcgacaagaacatatttatttaaattataagaatgcatttccttgaaacatgctagtagaagcaaactgtaatgtgatattaacttagaatagtgactgttttgcatttggatgtaaatctgctggctatgtttatctaacttattttatataacaaaagtggtaacaattagaccaaattttattgttgaattagaatgcttactaaataaattatactgtccagtctctttttatgatattattaaagacctagcatttttacaggtcataatctacatagatcatatatgtatgttcatacataatcaccatcaattagatgggtaaaatttgatatattactaacaaagatagacatttaactaacaaaacagctttcagtggcctaatcatccatgcttaagcacacatttagcatccaaaagatattaaatacaacattcttatttaagagtaaattccaaattattcagccacacaggcattcaagctccttctctggataactcagtatttcttcgcctacttaaaacacattaactggggaagggattctttagtttgctaaaagccagatcatgtatacataaatgtatacgtatatatgcaaaaatgtatatatgcactttgaaacttgcaaatagaaacaaaatgtcatgcaatataaatctagattagtgattattttgcattttaaatatgattcctctggtaatgtttactcttactttatgtaacaaaaataagcatgtatatatgcttaaatcaatatgtttagatcataagtagtattatcaaacatccatccataaggtcattattttcaagtttagacactaccagtattgggaaccatgtattttccctaaaagaaattattttgagttaatacttactaatgaaatagcaaattattattattattattattattattattattattattgagacagaatcttgctctgtcacccaggctggagtacagtggcacgattattgttcactgcagcctcagtctcttgggctctccacctcagtctcctgaagtagctgggactacaggtgccacgccaccatgcctggctatgttcaaaatttttgtagagacagggtctccctgtgttgcccagcctgatcttgaactcctagacctaagcgatcctccctcctcagcctcccaaagtgctggaattacagacatgaaccactgtgcccagtgaaatagcaattatttgctaactgatatggtttggctg
